United States Patent 7,868,149 (PLANT GENOME SEQUENCE AND USES THEREOF) - sequence listing, part 16

SEQ ID NO: 7719 - DNA, 19855 bp, Oryza sativa
aaaaaaatgtcttgatttgcacacctcagagtcctgcagaacaaaaatgagtagaggtgccatatccatttggttaaatgttccatttggggggaattccacctttctggttctgttttgataaccaatgtggaacaaaacacatcctgttgattccattagatatattgcataatcaactctttatatttgttgattcgatatgcataggaaagaaaagtgtcatgcttttgcctacttgctacttttgtcctttgtctttgctcatgtgtgagaaattccagatatccaatatatgttgctgctccctggtccccagggtgctgtgccccctttctcatattgtgattagattgtttccattcaccggatgacaatggcagtcttggcatgtgaatgatgtcctatgcaataatggtgctttggtctctcatgggcattgattccatgcgcagtttgtgaaatattattgcacataatgttactaacttgccttgttatatggtattactggccacacaaaatggacatacaagtttctttcaagtttcaactcctaatcggccatctcaaggaacattttattgtgattatgccgtacattttctattgaagcactccatcttttgaatagagaaggaagtgattcttagctttggaaaatagtaatcatgatgccagtgatcagatttaatattttgaactatggctgcaggtcaagaaagtaatttcttcccattgacctaattgtaaacttactattcaaatccaattccagttccatattgctttgtgactgagcacacctgggttttcactcctaacaggtcgagcactggaggagctgaggggttcactctacaatgaatttcatacttcagaaggggccaagcgccagcagcagaggttttgcggaccaagtgttgcactgacattcaacttttttgttgctgtcgggatcatcatggcaaacaaaatggtctggatcatcttttcacctattctataattctcactacacttagtttttttttcttcacatggcatctcttgtctgtctggcaggtcatgggtgctgttgggtttaacttcccagttgcactatccttaattcattacatagctgcttgggtcctgatggcagtcctcaaggcattttacttgctgcccatagctcctccttcaaaatccactcctttttcctcattatttgctttgggtgctgtcatgtctttttccactggcctagctaacatcagtttgaagcataataggtgagattgctgatttgatttctccatttaacaaatgaaaaggcatatatgcactatagggatgtgctcaatattctgtgtcttcagtgtaggattttatcaaatggctaagatagctgtaaccccaacaattgtagcagcagagtttattcttttcaagaaaaaagtttcccttcgaaaggtatatttgctagagcttagaaactataagcttcatatgctgttcagtattcagttgatctaattgttctcacaatatttaaggctagttcaagtgtcaaataattcaaataagagttgttctaatcgttcgcaggttatcacattggctgtcgtgtcatgtggtgtggctgtagcaaccgttactgatttagagttcaacctttttggtgcttgtgtagcggtagcttggattattcctagcgctgtaaacaagatcttgtggtcaaatttacaacagagtggaaactggactgctcttgcgtaagttgtgatttttgtctgtttcggcaaaaacatattgcatatatccttttctcctaacattcaggttcttttatcaggttgatgtggaagacaaccccaataactgtgtttttctttcttgttttgatgccattattggatcctccgggcttgttgtctttcaactggaatatccagaacagcagtgcaatcatgatatctgctttgtttggttttcttcttcagtggtctggtgctttggcacttgggtgaggcatattatttctatcacatgattgttcttatgttctattggcacactttttaaacgtgagatgaaactgagagaaatacagctctgccaaagcttgttagtagtttatggctttatgctctgaaactttttaactcgcttgctggtgctatttgcagctagccaacaatatcttatatttcaaatgaaaaaatgttcatgcatgcctattgcctagatcattagacatggtagcatcacattcttcatgtcaaatagactcataaaattgaactgcaaggatttgcagtatgcctctaattatctgtttgtaacttcatgttacaactgatgattatagctgataggcacttaggcagtatgttgacatatagaatgtcaactgacaacagaatgcctatgtcaggttaacatcagcagctttgcaaaactcacccaaatttgatcccgaaaaatataggacattgttccgtccatttattggaaaaatgtagtttttatcacttatcctagtttgcgaaacctgtggaatgaacttaactatttcactggattttgtgtgatgcagcgcaacctctgctcttgctcatgttgtgctaggccaattcaagactattgtcataatgctctctagttacttggtatttaactctgatcctggattcaccagtctttgcggagctataattgctcttggaggcatgtcagtctacacttacctagggctgaaagaatctgccagtggtggtaagagagctccttcaacatccaggcaaaactctcatttgctgaagtccaaggttattgtagatggagaaaagccagaaacaaggcctattgattctgtttaagttgaagaattgccatttattcttgtatttttgaaaatccactagaagcattaggtgattgcatttgttgaatatttgttgtcaaccagttcaaccgacctctgagtcgcatttgttggttcttgctagctatgattcttgttttaggcgattttggtcagctattgtttgtagctgaccatgtccgttgtatatatagacacatattatttttccagtgttaagcaattttgctctactatactagcgtttgcgatgtcacttgggtcgtggaattttctttttgtgaatttggagaatgtatgatctgttgccctgattgaatttcatttcgttcaggctatacactgaattgttcttggctgtgtacatccgattggatgtagaggccgggtttatcccattttctaaaaaaaaaacactgaattgttctaactcactgtgttgctcttcaaggagactctcgtgctcatactcacaacatcatatatgctagggaaaatgtacttcaaaatgacctagaaaaatgtacagagcatggcatgctcctagctgttgtgagtggcaccagcaaagaatagtgttcaaatgcagcataaacgttcaaactccatttaaagatagatcaaattaatccacagaaaaaaaaaacggatctccagaatttaccgaagtgaactggcatgctcgagcatatctgatgagaaaggatataaaggacaggtcgagaaaaagttcagattttcattttgaaccagaaaaaacaaagtctgaagcatttcggtttgctcatatcctgagcacttggaacagcagcatcaagatacgagatattccagcaatgtttccttgtagaacctgacattaagcgctcacaacagcaatttcgctccaaaaaccggtaacgtgacaaaggcacgtcctgactaaataaataatacaagttctgaaagacaactgaaacatgcaaaatgatatcgagtgatctgaacatatgaaaactataagctctgaatacaatttaaatttttaaaaaaggaatatattcaggatgctgatgtttccagatggacaaaacgagatcatagagaaaagttttacatttgaatgtacaaagcaaaactagcctaatatatccaaatcctggatacaccaagcagaagaactagccaaatatatagcgatccgggaactgatgatgcatctgcattatcttaggttttgatgtaactgtccagattccgaaaaatgcaatgtcatcaaaccttttcaccaagaaatgatcttgttgacagaaacccttcgaatgtttattacaatgccactggcaatgaatggaaaaaggaacagtgaaaactgaaaaggggctactttgcagtgataggttatgcattttgcttaactcttacaatttgttgtaaagctgccagccaatatccaaccttaatgacaaaccagtcgcaatgtcctgtttcattcttacagttgcttcagagacattcagtatatagattgattgatgctaatatattggcgccgatatattctctcatttagcatttggttactagctttttaccatgagaatagtgaggaagactggaggaattaccaatctttgatttaaaggagaataaggactttaactcattaccccgagtcgatcgccttttaatatcacggtagaaattgcaactgatgttgtttgaggaatgcgaggaacacatgcaaattagttcattcctatggtgacagataaactgtcagtacatacaggtacaacaatgctgttatcctagttttcctatgaatgaatgcatcaatagctattcagcttatcatttgacctgcattaaggactgtaggtttctgctgggaagaaaaagtctagatggttaatcttaaactcaattgtcacttttccatgtatcgttagatttggcttctaatttagttatctagtttccaatcgtttctatttgtgtatcttccaaatggacatagtcacataggcatgttcaaacatacatcaagagcacaatagcaaatgaactgacacacctggtgttttgcaccttggatccttatctctgtcattccactgaatcatacacatagatggctgatatttttcaagctgatttgcacagatattggattggcatcctgatattctgcaggtatttcatcaaacatcataatcaaaatttccccagtagcacttctgaacaccacctgtgcatttccatagggtcacttcattgaactctgacagctcctcatgggcctcctttcatcagaaaataactgggtgattcctggtaggcattccacctcaaatatcagcttgagcccagacatcacttgctgccacaataatagcactgtgcatcagcatcaggatcgtgaaataaggcaatgtagcagtctagcactgcctgcaaatgagttttcactaacaacgaggtcacagaatcttgctatgaatgagctatgcccatattgaagaactgctttccatgccccaatgaaacgctagttaaagagccagtgtgtcaacattacctgcagtaatagaaagaaaattagtaagaggaaaagccctgaaagtacacaaacgcataaacatcatcaacccacaagaacatggcatttggcaccttaatacctgacttaaggcatcagtgcagatgaaatgccatcactagctggcaataatgaatccgctgaattgctttgctgccacacaagttttccaaaatatatattactttctggttttgacagaatatcccatttctcccttcatatacctgccgagaaatgacttatctatgcacaatgtttcgcccctctccactaggtggatatgtccttttttttcccgtaaaagaaaagattaggtgggctaatattagttaatattggccactcccagaaaaaaaaagtatattcccctatttccctattacctaggtaaataaattccattccaaatagtagcctacaaattgtcaactgagaaataactacctctctcacagttcagatttgaaccaggtcatattttgtttggtttgctaccctatcagattttggggttggatttggtgttaccaaaatttgataatagaagtatttgaggcatgtttggtctgttattttaccaaaatctgctaacagaaatggcagcaaacctcacaggctcagaatgctccctagaaaacaattctacacgatgactctatacaagaatgaaacgcaaatctgctttacaggttgtttaaatgtcacaatagtggcacaatgaatcatgctattacacaggtggagctcctgattgcgtagcagaaggttgatccgaagctcctgtttcaatctgatcccacatcttaaggcatggcatccatttctttcccttctctttcactaacaatgcgacctcatcaaatgacagcaatacatgaatgacgatgtagataacacggcgatgacaagtgcaaaaatgtatgcagatgtcttgaactttctgcagctgccggctgcatatgccccaaggagaccaagccagtctaataccattgctgtcttcatggcaaggagtgatctcttgtacttgcttattgtgttgttcagaaggaggatgaccatgaccgttgaggccatgaatgctgttgcattgcaatagaagaataccttgtaccttataggatgggtaaccttgaggattgggtctcccgcataatggttgccttggtcactaggccaaagcccacctggagggagtagcccagcttggtatgtgacagtgactgcaagagttccaatcagcatcaaatctttgcgccatttgtgttctgttcgtttcttatcagtgcttccagttggaccagtcagagtcatggatctttgctggctctcaaaaccagaacggcgcttcttcagtaagtccactttttgttctgcaacttgtagaaccaggatttgaatcatgacatatgcaaatactgcagcgacgacaagaatgacgtagatagatgtcgacactctcctgcagcttccagcagcaaaagcacccatgagactaatcaaatcaaccagcacgcaagcgcgcaaagcataggacttcagacccttgtcacacagcctcttgttaacaagcaacagaatcactgccagagatgccatgaaagcagtggcgttgaagtagaagaaaatcctgtaacggcctggaaactcatcatggagcactggatcgcctgctcggtgacgatcgttgtcactccagaagccacctggtgggcttagaccagattgatatgtgatggaagccgctagaatcgcaagcatcatcagaaacttgcgccgcttctccaaatctttttcttcattttgcagctccaccgaatcacttcgtccatcatcactccccccttcagttcttctgaaacaaaatctcgtaaaacgatggaataagtttggcacatgttcaatttttgtcttcagttgagtcttgagagccatggacagcagaacatgaagcgtgaaataagtgaaaacaacaaggaccaagatgaacacatacactgacgttgagaactttctgctactcccagcagcataggcccccataagaccaaaaaggtctaatgccatggctgtttgcaatatgtgacgcttcatggcaccaacagtaatcagttgactctgaagtaagatgatgatcaccaaagatgccacaaacgcggtagcattgcaatagaagaatgccttgtagcgcttgggattgatggcctccaagattgggtcaccagcagtatgtccattattatcttgccaaaagccacctggtggatttagcccagcttggtatgtgacagtggcagcaaggataccaagcaacagaagatatgtgcgcaacttctcaacatcatccttagcagtatcggaagtgcctgaccttctgttgttcactggattttgtgctctgggagtagagcgcgattcttcagtaggattcctagtcccccgcatgatgaaagaacccagcttctgaagtaaatgggtcttcttttttcccacccattccatggaactctttatgcaaggtattggcaccatatgctcgatccactgaatacagaggtagaggaaaacagcaccaacaagggcaaagacatatatagatgtatggacttccctgcaactcccagcagcataggcacccataagcccaaagaggctcaccaacacacacaaccgcagagcatttgacttgacaacatgatccactgctgtattgctgagcagcatgatgatgatgacaagtgatccagcaaatgcagtggcattgcagaccaagaacgccttgaaccggcgcgggtagtgatctcgcagcaccgggtcaccggcaagatggctaggcttgttgtcatcaggccagaatccacctggtgggtttagccccgcagtgtatgtcaccgttgcagccaatgtggcaagaaccagcaagaagctgcgattctgttccagacgtttcgtcttttcagaatccccagtttctcccgtcttatcggttcctccatctccatgtatactccccagaatctccttccagtgtttccgaatcgtgtagaatatttcacacagccattgaggtgccagatgccggaagaatacgacatggagagtgatatatgcaaagatgccaacaagcaaagcccagatgtagacggaggtcctcacctccctgcagctgccggcagcgtaggcacccatgaggccgagcaagccgagcaccatggcgaactggagggaccggagccaaatggcgtcgcggctcagctccttgacgaggagcagtatgaggacgatgagggacgccccgaacgccgtggtgttgcagtagaagaagacgaggtacctcctcgggtagctgtacctgagcaccacgtcgccggcgtggtagccgtgctggtcctgctgccagaagccgccggggggccctagcccggcttggaaggtgatggccgctgctaggatggcaagcagcaccaggtacttcctcagcttccacaggagatcggcctcggagcccgcgtcgcacggattctgctcggtttggccttgctgcgtcgcttgtgccgaattagcagtagcagcagaagcgttggcaggagcatggccattgctcctgccattgcttgggttctctacagagctcatggagttgagctcaaagattccaagaaaatcttgggttttcctctgaagattgtagcattggatggcttgaagtcgtgcagatggagagatgaacttaactactgatggtttgcaagaagatggagatgagctgctatatgagcaggggtttgggtctttggatacacctccactagatagaagagtgaggtacaacaaacgataaaaaatgaaaaaggaacaaatccaagtcaacggctgtgattagttcagcgcaaagtttggattttggttgaaattggagatgatgtgactgaaaagttgtgtgtgtatgacaggttgatgtgatggaaaaggactgaagtttggatccgaactttggatctaaacacagccaacattgggttctcacttctcagccgtggaccagctcaaactggcagaaattattaatgtgtttggataatgagttaggctgtgtttagttcagcgcaaagtttggattttggttgaaattggagatgatgtgactgaaaagttgtgtgtgtatgacaggttgatgtgatggaaaagtactgaagtttggatccaaactttggatctaaacacagcgttaggagaggtgggattgggaaatggaaatgaatggatggattggatgaaatggagtgagaaaaatgtatggctaggattgaagcttaccctttaaggggtgggaaatcatatcccaaacccattatccagacatggcctattagtatgttgttatgtcattagccgtcgattaaatcacagtaattttactcagtgcagtctcatataaattgaagtcagtttggtggatcatgcaaacaggtctgaatctaatgtgtgcattagttcaaattcagaaaaaaaattctacatttcaacccagtctcaggagataatttggcaaattatgcacttcaacacggaaaattttccaaacaaaagagcaatataagagtcagtcaagtctacatactttattcaggaggcagtgtcttcgttgcttcttagtgactggactcctagttcgtctgctttctgccccctctttcttcctcctttccaattccccttttcactaaacttttaagaatatactaaaagttttcttttcatcattcagatttcttaattgtgactagtgagacttgatcagtactcagtagtatactttagttccaatactgcaacagctatgtgaacaaggaggcttctctttgttttaccagttgacttgacttggggacttttccttgatttctgtcgtgggggccatttcttcagcacacagacgattctttctaacaaccttttggtttttggcaccactagatgaaacaattatgacacggtttgaaggcccatttctgtctaaacaataattaatctgctcccatctaccattggttaggcaactagcttatctccatgagtaacaggaaagcagtttactataacaagtgtcttacagaaatacaacaaacacgccactctgatccgttgctcgattctttaattatttcagtataggtctttagagtgcaatccaagtcatgccgattttttgtatgtgccaaatacatttgcacgagttgccaatccccccttctctttagtccaaagaaaccccaagttgcattattgcataataagttaatactaattgcaatacgagattagaatagggacagtgacctgtttgttttatagtcagggctaacaacccacagttgccactagaaagcaaccttgcgtcgaagactttggcacctaagtcttccacctaaggccctaacatgaaaaataaaagcataaattggtttaaacctttttgaatccaattcttttgctaatctatgaccacgaaagaaccagagaaccctcccaaagttaccaaatgatataaaacaagtcctagtatatacaagcaacgaagcatcacagcagcacaagacgcaattcagcaaagagacgagcagctgggggtgggtgggaaggcacgcatagcatacctggcgccttcttgaactgtgaaatgcatcagccaggccagcagcactctgcaggtcccagcgcttgcgccacgacggcccatggtggtcggcgtggcacctcggggctgggccgagaaagccacgccatcgccatgagcgtggggaaaaggcgccggcccatccccttgcacgcatttcgtcgaacacctaccgggtggaccgggggcaccgggcattttcgtcgagcacggagacccccggcgctcccctcggcaagcgcgcagctctcgccgagctgagcagcagccgcgccgcgccgcgcgctcggctcaatgccgcccgccaccgcgcctccgtacggtcgaccgcctcccaccgccaccgtgcgtgtgcgccgcgccgcgcgcgagatattagcgtcacatgacggcagcagttttgcgtcgcgagattagtagtattgatagcatgcatagcagcagtgtgccgcggcccgccgccctggcaaacaactgaatttctttaaaataagaggaaataactggcagtttgaatagctggaaatcgcgaatctcaaataagaggcaataagaaattgaatttgcaaacgaattcagatcaacaacataaacaaccgttgaaatcacttctttaagaaatcgatttaaattatatggatcgatatgtatttaagtaaagttgttagtaaaaaaaatgggtactaggattttaggccaccactgtcttctctttttctctatggctcttcttttctccaacaaaattaacttttggatactcatggcacactttttaaactgcaaaacgatgcgtttcgtgcgaaaactttctatatgaaagttgttctaaaatatcagattaatccatttttcaagtttataataattaaaacctaattaatcacacgttattaccacatcgttttgcataaaaaacttaatcttcatcttcatctgaagatctcttcaggacattcaaacactctttttgcctcaacattgctcctttcaacctctcgacccaccctacctacgcctgccacctttctctcaaaagatcacacccaatggcgtccatagctacgagaacgagttatcccttcttcttgccctctctcaattctcctcctcttcgctctttatttattttaatctttcgtggatctaggaatggcaaaagtcaggtatggcttgagcagatccaggtagctgaggtactgaggaggtgggaggacagaagcgaggctgagctcaacaatggcgaactcatttgttgttgtatctttgacccatgttcttccccagtttatggctcaatttgtgaggtgtgtgaattttgaactggcgttagagacggtttacttatcacgactgctgttgatgtctccaaatacatctccacatgcgaccgctgtcttgtttgtaaaaatgcaacatttctatgtttgttcgttaggaggcagttggttttctcgcatatgcaaacaccattaactatatgtaaaatttgttttttagtgcaaaggaataagtaaaactaagagtttgaaaggatttgctaaaatttcaggaattgtccaaaaatataacctaacttttcgttaatatgataaccatttacatttatggttatgaagataattattaacaccattaccatagaagttgatggttatgaatctttttccgaagaaatacatccaacctgtggaaataggtgaatggtgaaaacttttttgtgctatcactattacagtatagattttcctggatgttgccccccttttatttccatacggtaagtggaaccgcatgggaaaataaagggaccggcaccgggttgttatctgcacgggaaaatgcattttcccttgcatgcgtcttaatccgaccgcacgggataatcctcgttatcccgtacggtcaacttaagaggaccgcacggaaaaaaacgattttcgtatacgggctttttaagtggaccgcacaggaaaatacctcccttctttccctcccacccacttcaaatttttgacatcctctctcttccttttttccccttttatcctccctcaaccactcccctctctctctctaccttatctcttcccggcttcccacctcctccccaccttaactcctaccggcttcccctcctcctccccctcccctccttcgtcaaagcgggcgtcggcggtggccccttccgtgcacgcagcgaggcagaggcgtcgtcagccattcgttgtgcatgtcgtcaaggcagcggcggcgagcggggcggtggcgagtggggcggcggcaagcgggcagaacctcctcctggtcattgtcctcgtcatgcacgtcgtcgctcggctccctcgacgatgacgctgtcgtcgcgtgcgtcgtcaaggcagcggcggcgagcgggcggcccccgcccagatccggcggcggcgggcgagcttgacggtgatgacggtggcagactcaacggcggctgggggcgtgcggtccggcaggcggcgacgattttcacgttttttttatttttggtttttttttgctccgtgtgggcggtataatttgaccacacgggataacgtgcggttgggccaccgcacgtgaaaatattcatttttctagacccctggtttcagacgggaaaacctccacacggaaaaaatcaatttgaccgcacggaaaaatctatcctgtagtagtgtatatatagatattctgaaattgagtacccgtatatccgtatatgctatcgttctgatttcttttatttacgtgccaaacatatttgaaagagttgccccatcccttttcttaatttattccaattttagaaatcctaattgcattattgaataataagctaataccaattgcacacgagactaatagagggacaaatagcagaaggccaacgacccaaagtagcaactaacctttgcatcaaagactttgccacctaagtcttccattatatccctaaggcggctaggctctaacacgaaatgaaaacaccaattgcttaaagcttttgattctcattttttttctataatttatgaccacacagagaatttttttcgataatttatgaccacacataggaaaacaagtaatttcccacaatttgccaaatgaaagtatttcttttcctgtacaagcaggcaaccttcacagatcaaattaaacgcagttaatctagacggtctagaccatggtctagacgaacactgtgttaacagcgtcttgatcatgacggtggatgatccacaacgcgctcgtccaggcagcggaagagggtctacatcagttgcggcggatctagggcgagccggcctgttcatggcgatggatcctggttgagctcgttcactgcggcggcgagttgatctagatgagcgtgtccactatgccactatggtgagaggcagatccagacaagctagtccacggtggtggtgatggttctagggtgggctaggctgctaggttttatgttgttttttaaggttttgaaatgattatcgcaagtggtcctattaaggaaccacatgtgataatcattttaatcattttcaattatcggtaggactgtcaacaagccaagctcgatacaagctcgagctgagcctataaaatattcagctcgagctcgactaccgagcttcatttttaattagaacaatgtatattttaaaagataatcttttaaaaataattaatttatggtttatcatattcatagaagaggaaaaagaataaaataaatatatgatgcaaatacaaggcatacaaataacatatttaatctattaatttattaaatagcaaccagaaatcatatattactaggctcattagaagctcgacctcgactcgacaaagctcgatcgcgagctttgggacaggctcgggctcgactcatttggagctcaagccgagctcgaatcaagcctaggacgagtcaagctcgagcagttcgcgagccttgagcttttttgacagccctaattgacgatagattctcagcatgtgggaatacaatgttttcctaggtgttttgttagaggcgaggatgccacccgcctctacaaataaattttatccacccacagaaacattttccctagtagtacttggaggcaacacatactagcattcaatttggttgaaagtcctctcctggttccctttgaattttagtttttaaattttagcgattttagttaaatgatacgtagtcacgtcccgatagttacaaattttcatctgggaagaataataggtggcatggcatataggagcagaatttaggtctgcgtggttgcattgtgtctccctcattgagcgccttcagctagatacagggctgtacctaattaatacagatatgaaataaaataccctctccttatttatatgaaaatttgcatgtgtaaatcgattaagtacatgtttgagattagtataaactgaattgaactggtaactctcatcctcaaaacaaccttattcaaagtttaattagttagaaggacttagcactttaaatcttcagccaccccaccacaaactagccatgattactgtcattttggagtttccattccattacctttgtcttttctttgttaatgacaacttttatggattgctggtggcttacgtcagcacaattggggtcatccatattctcacatccatgaactttagtatggctgtcacgcatcagtggcgcggggaatgaaaggtgagaagaaaatataaactatgacgacgcagttaacctacaaccaacgtatcttatgcagcggctataaatcatcggccgggagaccctgacagcatcaactcatccttccattacattttacagtttctaagtttcttacaccgtgcaaattatggagcgcaacgacaatccactgcacgccggctctggccaggccacgacgctcgagggttccgaggggcgggaacccatcatccgtgccgggtttgctcgaaccgacactgataatggcggttctgatgtgctattctgtggtagtgaaatggaccacaacaatctgcagcccgcgggctctggccaggccatgacgacggaagcagacaataaccgtgcgtggcagctgcagaagtacctcatgctgctcactatcctagtggcgaccgtgacttacatagcggggctcaatccaccggggggcgtttggctagagaccaaggatgggcacctcaccggcaatcccatcctgccggacacccaacccacccgacactacgtgttctactacttcaatgcgacggctttcgtggtgtcgctcgtgctaatccccttcctcctccagccctgcgtgaaagcggcggcgcagctgaaggcggtgcgtgtggccatggtgtttgatctggtcctcctcatggtggcctacatcgccgggagctgcccggataggccaaccaccatcttcgcctcgctattgtcggtggttgtttttggatgcgtcgtggttcactggctggtggctccttcttccaagggccagctctggcttgacaaaccaaacaaggtcttgatgctactcgccatcttcgtggtgacggtcacgtatgtggcggggatgaggccgccgggagggacttgggaacatgcccaggaggcagggcgaagcgatgccggtgaacccatctggctagagcgccaccgagggcgcttcatggccttcctcgtctcgaacaccatcgctctcgtcgcatcgcttgccgtcgtcatgctggtcttgagcagcaggctgcggagaaacatgtcgtgccttgcacttcacgtgttcatcatcaccatggctcttctcgggctcttgggggcctacgtctcgggcagctgcacggagtggatcttcaccgtgcaagtcggctgcgtagctggtgctatagctgttatcctcccctgcatttcttgtcttcccattgttgagtgtcttttcggtggattcaagagccaacaccactcgttggcaggagcacccggtcgcagagtgacaatacaaccattggtgccaattgttccagtgggagaaggtgaaccagtaatggcaggaacaccaggtctcccccgaatgacacctacggaatcaacaatggttgtgcatagacagcatagtagtgaagcccatgcgaatccattaaacaatggccgctctatgatacttctactagccacactcacggcaacagtgacataccaggccggcctagagccgcctggtggagtttggcgggacaatgagggtggccacaatggcggtgacctgatactcctcgctactcatgctatccggtacaaggtcttcttctattgcaactcggctgcctttgtggcatccatcattgttgtgatcatattgcagagcaaggatctagtcaaccgatatgcgctccatgccgctataatactggaccttatgggactcatgggtgcctacgctgctggaagctggagagatattggtgcctccctatctatcttcgtcttggttgctgccatcattgtattgttagtagtgacctacattgtgagttgcaagtctctgactcgagggaacaatggaaatgtgtcgttagcggagcagaaaagaaaaagggaattgcagaagaggcaaaagctgttgctcaatcttgcagtactggccatcaccatcacctaccaagctgggctaactccaccgggcggcttctggatcgaacatgccgatgaagaacaccataatggagatccggtccttggtgacaaccaccgtggctggtacacggcttcttcttctgcaacacgacgagcttcatggcgtccgttgtcaccatcgtttccctggtgagccaaagcctctctgagattgatatggcgtactgcaaggcgctctactgctgcgtatttgttgtcttggctggattgacgggtgcctttgcctgcggcacctctcgaaggatgcaagaatccatgtacgtccttggctcggccagcctagggttaactcttgccatcctgtacattcaccgttcccatccaatggtcagaaatggggatggtagtaaccatgccgacgatgatactgagcttgttggcgatgtggtcactaatggccagcacatcacaacacacaagatgtgcaagtacctcatgctgatcagcatcctggcagccaccatcacctaccaggctggccttacaccaccgggcgacgtgtggcccgccgctgacgacggggaggggcacgccgcgggcgacccgatcctccgcgacagcgaccggtggcactaccttgcattcttatacagcaactccgtctccttcgcggcgtccgtccttgtcatcgtgctactactgagggtggtggtggtgcggaagctgagctctttcttgccactgatcacggtggtgcacgcggtggccgtggttgatttgctcgcccttctggcggcctacgcgacggggagcagcagggaccgggggacctccgtctacgtcgtcacggtggccgccacggtgctggtctacgttgcgatatatgctggtctgagttcacgccattgtggcagggaacaggatggcaatggaggggtcggctctcgtccgtcgtcgcaagctgctcgtgtttgacgatttgcatatatgctagatgcatgctggctcggctcgtttagtgctctacgttttccaattatgtgtgcttagatgttgtgctacttgtaagaaataaccatccagccatctgatggaaagtcacatgatatgtattgttgtgcttgctggaaatgtgtgagagtttgtatctcgatgttaactattattagttggagtcttccataggtgattgttagtttgtctcccaaataaatgaaatcagttttcatggaacatgttttagtagcaaatttgtatcaaatcggcggcttcggccacggcggcagcggcgtcctggtttccgggctggaaccttggcgatctctctcctctacctctcttcatacctctagctacctctcctagttctagaagcttccagaacttgtattccctagtttcttcttctctttttcaccccaaaacaatggttgcttgtatggtggatccttgctattgaattggaagaattgggttcctaacaatctggtatcagagtcgttgattcgtgggatttctatcatggagtcgattggagtgcacttcagcaacgcccccatgcgagtggttgcttgatttgggcaagggtggtgctcatgacacccatgttcgatggaatgccaagccagcctgaggtgttcaatgatgatgaaaggatatcagagactgttcccatcaaatccaccatgaagaaggagggaatatccatggacaaagctttagaccggcttcttgagaagtttgagttgatggaggccaaccgtaggcaagaggagaagttcaatcaaatactacataagttgcaagagatagaggcttgtaggagcaaggctgctgttggtatttgatatggttacagatagaatccacaagcgcatggatataccgatgcacttcccctacggagtattccaagggtatcgaatccaagggaatgtgtgtgatcagagcttcctccggttcatccaaagacaccaagaaaacgataggccaggatagagaggatttactagtgagaaatagtgtccagggaatcctaacgcaatacttcaggcacta

SEQ ID NO: 7720 - DNA, 665 bp, Oryza sativa
ttgacatagcgcaagatgcgcttgaccaaggccaagtgagcgtcacgcggagagtgcatgtgtaggcacacttgctggacggcgtaggcgaggtcgggccgggtgagagtgaggtactgaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacagatgaaggccgttgggggtgcgctggacggagataatcggcgtcgctgtaggctgtgagcgtcgatgccgtggtagcatggagaaagagcccttgatccagtgaccccttgacatagcgcaagatgcgcttgaccaaggccaagtgagcgtcacgcggagagtgcatgtgtaggcacacttgctggacggcgtaggcgaggtcgggccgggtgagagtgaggtactgcaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacaga

SEQ ID NO: 7721 - DNA, 700 bp, Oryza sativa
taatcatgttacttatcaaaggtcttttcagtcttccgttatgagaatgtgagtataaccccaccaggattagatttaattctctttataagatgtaattttttgcactatctatctatctatcaggctatagttcatccagacgttggacaaagccctcctcatgaaatttccattctcttctgtctctagctgtcctagtcaaagcggccgttcccatgtatgatgttaggtcatctctccatcttctcttctaccttcctcttcttctctttcccatccttggttgccattctgttaaacgatttgtccatctattgtccttaagtcttgctacatgcccagcccatctccactttgattatctgactttctccatgatatctttaacctttgttttctggcgtatgactttgtgattaattttgtctcccagagataaatgcgacatctttctctccatagctcgttgagtagtcacaagcttctgttctaggtcctttgtcaatgaccatgtttctgatccatatgtcatagttgttagaatgcattggtttaacattcttcttcttagagacatgggtatgtttttatctgtcaacatgtctttgtatcttccaaagttcatccatcctgcttttactctcatcataacttcttcttttgtggtgtcctccattttcaaagtttggggctgcag

SEQ ID NO: 7722 - DNA, 5184 bp, Oryza sativa
tgtgcagcatgggtgtgctgttcagtgttgattaatattgatgattaattactctattcttttacaattcttaaatgtttgctaaatgctgcttttgcaaatgagccatatattttgccattgtttggtatccttgtgcacctgcatatttgctgtgtggcttgtcgagtattccatgtactcaccttgcaataatcaatcaaacctcggttgaagacaagttgcgaaggagaagacgtttggcttataccctagttgagctgcctgtgggagtagagtcggagcttcgctagaccgtaattccgctgttgttttctcttttcttttgtaagtatgtaacgttattattatgatgaatctgtatattaaattatcggtttgtgtacctcggctgattcctggacgaggatttcatgcacaaattagttcagaaattactagtgaatttatgggcgtgacaagttggtatcagagccatctcgactgtaggataagtcaaatggtcaaactttaaggaggaattttccgaaaacatgatttgtgaaattttcctttcttccttctccagaattctctgtaaatcattttatcatcctctcccctcccgctttcaacttgagtagttctgaaactagttgtttaaacttgaagacatcgatgtggtcttcttatggagattgagtcaagtggatcgaggaaaatgaagttgatggtcaatctgaagtgcccaaatgtcaagatgggatcgtgcattagaacctaaaccaccaaagtgactctaaagaatagttagtagggtagaacgtttgttgcttgcttctttgtaggtattgttgcatttcccatcattggtgttgttcagcgatgagcatgtaacgatactaggttgcttgtttaatcaacttaaacaatataatggtctacatacaccagattagtattaacctggttaaggtctgtctttagtgtaacccctctctttctatcttctctaatctgcaacaaatggtgaacattcgcgccagtggaagtgggaacaataacaatgaagggaacccaactcttactcaagttcttgctcaacagactcagttaatgaacatgatgatgcagcagatgcataaccagctcaaccaagggtacaacaatgctccactaccccggagcaagctagctgatttccttcgtgtgaggccacctaccttttctaagaagcaggtgattggctgcacactattgagaagaagttgaaattgctccagtgcactgatcaggagaaagttgtattcgcttcacatcagttgcaaggatctgcttcagaatggtgggatcactttcggatgaacagagcggaaggacaaccaatcacttgggaagagtttaccgaaggattcaagaagacacacatacctgcaggagtggttgctttgaagaagcatgagttcagggcattgaagcaaaaggatcgtaccgtgatagagtatcttcatgagttcaaccgtctagcacgttatgctctagaagatgtgcgtactgacgagaaaaggcaggagatgttcttggaaggcctgaaggatgaactgtcagttacgttgatctctcatgactatgctgattttcagcagctagttgacaaagcaattcgattggaagataagaagactaggatggacaaccgtaagagaagaatgactgttttccaggaggcacagggtagtagccagaggcagcgtatcaagccactccaagttggtgaatcaggtctgacatctcaagaacaatcgcaacagatgaacatcggtggtgagatcaattcagagactaatgcaagcaatgaagttaatatcgagcaagctactcagtcggagccagttcagcaggatcagtctcaagaaggtaatagtagtgcaagggagcagcgggtatgttttaattgttatgagccaggtcacttcgcaagaaagtgtccgaagccaaagcatcagtagccgcaaggtcaagtcaacaacattgtcgtcacaggagccaatgcagtgccagttgcgtcttcaagtgttacagttcagccaccagtctcaaatcagcagtagttttctttaaagccttagaataattatcggagttatggaatagaatagactgtaatttagccgttccgaatcacaggatgagattttttgtaaggggggtagatttgttacagcttaaatttctatttcaggatttataaattgttaatagaaattatattaaatgttcattaatttacaagtgaagttaaatgtgggaaataaaatttcctaagtataaagcatggctggatttaatttttattaaattctctatgattaattatactctctggaattttctcgaattttccagtgctcaattcctaaattctaataatacaaaaaatatttcagtaattcgttaatcattaaattaatcaattaatgatctaattataattatgttaaatgattttcttgtttaaaaatccttaaattataaattgttgtttaaaaggaattattagaaatgatcttaaaagcctaaaagagaatttctaattttaattctctaaatatcaaaataaaagtgggctagataaaattttattaaatacttctctcatttctatagttcctagatttttctgggatttatttgagcaaaggaagtatttttaataaacggaatatcatttcatgaataatttaaatagaaaaaggttttaaatctctctattggctttgggccgaaagtcggtccaagtctctctctccccggcctgcgtgtgctcggcccagccggccaagtccgccacgccctcccttctctctctcagccgctgataggtggggcccacctgtcagtcgtcttcaacctccggccgctcctagccgcgttgcaagccgccgcctccttccaaaatccggccgccaccttccttccccggccaaatcaattgaggggaaataatctcctcgatctcctcttccttttctcttttggaaacttcggctaatttcgtttggaaaccgacggatttgagctcgattcggatcgatttttcttcctccaaccatagctttccttctcggcgccgatcgccgtgggcctccatcgacacacctagacccctatagaaggacctccgggacctcctctctgcatcaccatctccaccttcgactgccgccttctctagcgtcgcctccgcgtggttctttgtatcgccgccgccggcgggtctccagtcggtcccgctgtcgcttcggtcatcgccgtcggtcgccgtctccttcatcagcatcgcgatgtcgtcgccgtcctcgtcccgtcctccgtttccgccgcagatcatcggagcgccgccggcaccgtcgactcgaagctctccaccatcatcgtcgatccagccacaccgcgccgccgtctcagccgccgccttcggtcgctgtcgccaccgtcgagatcgcaaggaggagccgcaccttgtccaccccttcgttgccgccgtttcccgccggagcactgccgtcaccactgactcgaagaccgccgccgtctcagccgccgcctttgtttgccgtcgcccaagtgctcggtgagttcactgtgccgatccctacctgttggtgccctccgtttgtgctgacgagcatagtgtgccgagccgctgtcggcgatgacatcatcgctgatgtcagcgctttgtcagccgtagacccgtggtagaccggatcgatctcggccgtccgattcggtcaagtttaggtcaattagatcttggccgttggttccgtggaccgcttctgtgaacccggtttaccgtggaccgtccttgatgacgcaataaatctcttttccttttcaaaaataattctttattgcgccataattcaattaaaatccatataaatgctttaatgcggtttattctttagaaattcataactaatacattgtaactcggtttaatgcggttcaagttgcaaaagttgtataaaataaagatctatatattaaaattatcaataaattgtgttaaatttattcaatcctttttaaataggctttaattatatttaatcttgtaaaattggtaattaattcttatgaagtcagaatgaggccgttcaagtctcataattgatcaaaaattttgatctacatgtttgtttactttatatgtattgtttatttggtttttattagtcttttttctcgttttgcgtgttagcttgtcgtttccgtcgttttgaaggatcgtgagtgcgtcggaagtattcaagaagattaattgaagaccctttattgcaaggcaagtcacacagatcccaaacacaattcctttgagcatgttgatcctatatttaaattctctatttatttcaactgtacatttattttcgaatgtcaccggctggtgtgaaactattcctttgttatggccactttgcattgattactctatcctttgataccttggattacaatttgactagttgtacttatataatggttcaactagatgtattagatgtaattgcttagccatgcttagaaacattagcacacaattgggataactaatgtttcactattacttaatgatggatatttaattgtatctcacgatggttaatagtgattggttaattaattaatttgccaactaaaacttgataatggtgggatgtgagcacatggttttgatagtagtgctcatgacaattaaggaccggttcacgagtttcggttgtaaaacattagccgtgccaaccacaagccagaatgcgcaacggttggacactttgtatagcaaggctcattgtggtgtgccagactgagaagtggcggagataagcccacgggtgtcgctggggagtccatgcctatggtttttgagggggtgactacgatcctggaaaggtgcgctgctttcagttgagctatgcgaggggtcttttcacaactacacaaatggtgacatgttcagcatgggcacatgatgatatggtgacatattgtggagttgtgtcctgtgggtacagtggtacacctctggccagagtaaaactattcgaatagccgtgcccgccgtcatgggcgggtctaataatgtctttcgtgattagtctcatacttctcaccataataaatgatgcgggctgc

SEQ ID NO: 7723 - DNA, 931 bp, Oryza sativa
tgcgaatattggcacacgagggtgcgatggttttgacgggaatcaaaaagctcaaaaaatgccaaaacatgatttttggacatattggagtatgttgcgtgcgttcgtggcaaaagctcacttcttgattcgcgcggcggacttttgtgaattcatggcaacattggcacatgagggtgcgatgtttttgaccggaatcagaaagttcaaaaaacgccaaaacatgatttttggacatattgtagtgtattgggtgcgtacgtggcaaaaactcgcttcgtgattcgcacggcaaacttttgtcaattaatgccaatattggcacacgagagtgcgatgtttttgaccggtatcaaaacgttcaaaaaaagccaaaacaaagtttttggacatattgaagtatgttgcgtgcgttcgtggcaaaaactcacttcgtgatttgcgcggcgaacttttgaaaagttcaaaaaatgccaaaacatgatttttggacatattggagtatgttgcgtgcgttcgtggcaaaaactcaattcgtaattcgcgcggcgaacttttgtcaattaatggcaacaatggcacacgagggtgcgatgttttttgaccggaataaaaaagctcaaaaaacgccaaaacatgatttttggacatattggagtgtattgcgtgcgtacgtggaaaaaactcacttcgtgattcgcacggtgaacttttctcaattaatgtgaatattggcacacgagggtgcgatgtttttgaccggaatcaaaaagtttaaaaaatgccaaaacatgatttttggacatgttggagttattgggtgcgttcgtggcaaaaactcacttcgtgattcgcgcggcgaactttcgtcaattaatgccaatgttggcacacgagggtgcgatgtttttgaccggaatcgaaaccttca

SEQ ID NO: 7724 - DNA, 1882 bp, Oryza sativa
acaaattaccgaacttcaatagattccccaaacagtcaagttccgcagaaaagtcacaagatataccatcaagaccattgatgatgacaccccaagaaaagattgaaaagcttaggcgtcgacagcaaatgcaagcactgatagctattcagcagcagcagcagcagtttggtcaagatggttctggcagcgataccatggtacctcaagcgtactcaccaaagagcaaaaatccagattccttagggagttctgttgtcatagatgataatgcaaataaagttttctcactagagctgattccaactggccatgaagagattcagaagagttctgggattcctgatgacccctttatagaagaaaaaatatattatcagcttcaagatgctcttgcgaaggtagcttatttagtatttcttcagatttttacattgatttttttatgccatgtaagaccatatctgttgcagggcttatttcaagataaattaattgaccatattttcttctttacacagttggataccagaactcggcgttgtattcgagacagtttactccgtttggcccatagtgtctcagagagacaaattactagtgacagaagtagtgctaacaagagtaataaagatgatgatgaagtttcagaagacacatctaaaagaaggtatgctttgcttcatgccataatggttccattaagtattaccatcctcgcatttggacactgctagtagtaatgcgttgctttactgtacataatgcaatattgcaatactccctccattaaaagtctaagcatatttcttttttcaccaaaaccaagaagaatataactcatcccccatgtaacaaaatcaaggaactatatgcatgcatgcaaccaatgagtattaagatggtttcttgggctctgatcaacaatttaatttagcacattgaaactgcaaatatgatcatctcatttggtaaaaccaaaaaaaaaatatgcttaagactctcggatggagggagtctataagtaatattgctattttagatcaagattctcctaagtcgaacgattgtacatctatgatataaattatgttccagtcatcaacagtacatcgggcacaacaggggataatgatctgaatggcatcatgtttgtgtacttctatctaattaaactaggataacagttctaatattgtgaattgtcctatcatatcatatttacccaatgatatttgaaattgaataggataaaatattgaaattaagtaatcaaaagtttcaacatctttgttttgttggggtttctcatttcttttaagattttatttgttagttcatccttagtaaaaggatactatggatccaatgctagtttttttgttgtactggttggagggaacagctgaaggttcccctgacattttggttgtagctggaatgtgcagccttgtacgaaaagattctgaaaatctctccaaaaaaataaacacaaccctagccaagaagctctgaaattccttcatcatccagcaagtagttgaagatctgcaatttctacctcgtaccaattcatcttatttataccatctttttgctgcttgcaagtagctagctgccgttgcgtatatatgagtacaataggtatattttttttcagtgacaaattcttgattgatacaatcccagatctccagcaagtgaagcagaaacaaacacaaatccaatcgaccgcattgtggcacatttactgtttcataagccttgttcaaaggtttcaacacctgcaaaagaagagatcaaatcctcaacttcattgccaactgaacctggtgtgtagtgtttataatatatttattggttaactagtctgaatatgcca

SEQ ID NO: 7725 - DNA, 1913 bp, Oryza sativa
tgaatatgccatcgttaggtatgtatacacaatgaactaacatgatgcttgggatttacaacactgtgcagattcgaagattcctacagacgcacctgggggaccatcagaaaatcaccagaatgggcaagaaatgacactgcagccttcactgtaatgtaagatgtattaatggaagattttgctcaaagaccagtgagatcataattctttgtgtatctgatggcccaatttctctgcgaatggctggtgtttctccttagagtatgtggcaggggaccaatgaattgctcaacatcaacatggttagctgcctctaaagatggccattgccagtccgctgatcacctccactgtcagagatcattacgtgatgtatcctgctgtatcagtttcaccatcctagtgccttgtgtcatatcccaaaaaaaaaaaaaaaaacaacactgtacagtttagactggattcatgccgaggtgacactttgggtgtgtatgttagagttcactgaaagagagcgaacatttggctctagaaatacttttgtcgttggaaattcctcgatcttattccccagaaaatgtcctgttccactccataacattcatgtgctatgtgttggtcgctaagctcgaaagaactttgtcattctaacggaactatttgatgacacatcttttgcatgtgtcggcgctaacgacttggcattcataggtggggtatttttcgaattggcattgctaaaattgtgtcgccatttttttcaaccggttgcagtcgatttttgctcggtccaattatctccaagatgtggggctagtatttgctttcactcgaagattaaactatattttctgctgttctgttttgtttctagcgtacatgctgatattattaacggataaattactcgtactaatcacatcgtacttacttcctctgtctcaaaatataataacttttagcacttaaaatttgtctcgaaatataacaatttctccatcaacattctcttcccaaccaatcagaaccctccaccattcacttttcccacctacctccactattcatccaatcacaatcctctaccactcacttctactacctactttcttaataaccgtgtccaaccataaaacttattatattctgggatggagggagtatattataattacatactaattacatatgtaattttaaacttacatatctaattttggaacttatatatgtaattttgagacttacattgtaaatacactaaaattacatatgtaatttagaaatttacaatatactccctctatccacaaaagttacacatattacttttgataccaagaccaaggagaaattaaatcatcttggatgttacaaaattaaggagtgaatgcaagcatacaaccaatgaatatttagatgactccttgagttcgaataaaacatttaatttatctcttcatttaagtcttgaatgcataaagaattaaagattataaataggaacaacttatttggaaaaactcaaatgtgaaataggtgtaacttttgtagatggagggagtatatgaatgccgactattttttagtaaaaaatatagcaccatatggaaacaaaacaggacagcaaaaaatatgggactatctacatatctgttgatagaaaattccacctcctatctttcaaattttggactattagatatgctttaagattcgagcagaccctttaaccctaactcctcttctcctccctatccagatcacgccgccaccactcctctcgtccctcgcatgaactcccgctgccaccgcccctctgcgccgctgtccagctggcagccaccgcccctctgcgccgccgcccgccttgccggctggacagagggcgtcaacggcgccggcgagga

SEQ ID NO: 7726 - DNA, 1512 bp, Oryza sativa
tgcagccctgtatatatatatagctcctccctttatttgaaaaagcacacatccttccttatatgcaattttgcaaattaccgaacgtgtaatttgtgaagacatctactacacaaaaacctttgtacctgcgtttgtttttgctcctgttaccaatttatgagtatgtacattaacagtgtagtccattaacaagtgtcactcatcccatcaaactggtggcatgtaaagcaactatctccctgaatttctctatacagtatttgaattaaccatgtatatgtgtcaaaaagagaaagaattaatcaaaagaactcggtaggagaccatgctactcctactcctaccatggtttccgctgttccgtctcagtactgtccgcgttgtggcgcctcctcagctccgcccagtggtcgtacgcgtcgcgcagccggcgacggaaccgtaccatgtccagccgcacgttctggccatcgaggtaaaccttcttggtgacctgccaccccttggcgttcacggtgtccgggtcggtgagcaccgcgtcatccttggcgtactgccggtacagcgagctctccgccggcttgatcttgtacggcatgtaccgcagcccgagccgccgcgccggctttcggcccccccagggttttaaaaaagttttttaatgctcggggccatcgggccgacggaacacctgatgaagaggagcccggccgcatgaagaggaatgcgtcatggccgcgccgtgcacgcccaccatgacgtccgatgcgttcagagcacggtacatcttggcgagctccgtatcctgacgaggctggagcacggcgacgcggaacccggcgccagcagctgcacgcaccagctcggcctcgttctcgatcgcgcgcgacccgttccgtgacacgatcaccagtcgtggcttgtcgtccttgagcgcgctcttcttcctgatgctgccttgggtcggcgtccccaaggccaccgccgcggccttctcctcctcctcgatgatcatctgtatgcggccgcggtatgcgtcgtcgagcatccgacggaagtcctggatggtacggttgcccggcattcgtgcggcgtcgatggcgagctcgtcgtggatgcgcagcccaacgacggcctccgggaagcagtgggtgcggcggtcgttggtgaagtcgataggcgcgtaatcggagagctgctcgacgatgtggccgtacttggtcatccaccagtcgtggtactcgagcatgacgaacaccaccttcttgttgtactggcgcgcggtgatgtagagcgggattatgccgtcattgaactcgtggtacacattgccggtgtacccgccggtggagaacacgacggctgggacgtcgtgccggacgtcgcagctagccggcgccgcacccccctcgggcacggcacggagccggagctcgtcgatggtgctcatgatgctggactcccacttccgggtgtaagggcggatgcgctcgtcccggccagcggcgg

SEQ ID NO: 7727 - DNA, 2854 bp, Oryza sativa
tgcggtcgcagcagatggtgccgttggacacggccgcgcacggcggcggcggcggcgtctcgtcgtccaggcgcgtcctccccatctgcagcaggtcgtcgaccgcggctgagaaagggctccctggcagcagcagcagcaggcaggagacaagcgcgaaccccgcgagcatccgcagcagcgcgtcgtggccgtgcttccggtggtggcacgcgtagtccacgagccggcgccggagctccttcatcttgccggctccttcctcggccaccagctgctgcccctcctctgccgtcgcatcccctttcctctgctgctggtgcagcaggagggtggccctatggtgttgcaccatgtcacccaaatcaatcccacctccgaccacaagtccaggagagaacaagaaagaaacagagcaagacgaacaagaggagaagatgaggtaaaaagagcttttcgctccgagttgccgtgcaaagaggctagtaccactcggtggcgtgatggtgtgtctcgtagagtctaaatgtgggtggggggaaggcgtgaggaaggaattggcattcccccgctaataaaaaccgcgtttcggtcagggtggctatagcttgcgggggaagggaaattggctgcgccgctgaccactggagatggactggcactggaacgcagcggcgtgtggtgggtggtggcaccgaacgaacctgcctgcctgcgtgcgtcgcgtcgcgtgggttgggacgttgggttggcggctgcagcttgctgctgccgttggttggaagcatcccacgggatggaaacgtttgcgcgtgctttccaatcgtttttttgtgggcagcatgggaatgcgtgcgtgcgagtattaggccctgtttagatgagactaaaacttttaagtccctatcacatcggatgtttgaaaattaattataaatattaaacgtagactattaataaaacccatccataatcttggactaatttgcaagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttagctgtctacagtccatgttgcactgtagctgttttgtgcgtctgggactgtatcacgcattgacgctacttcttgccccattggttttccacgcgtatatttttcaaactgctaaatgacgtgatttatataaaaaaattttatatgaaagttatctttaaaaaaatcatattaatctatttttttaaaaaaatagttaaaacttaattaattatgcaataaaatgaacttcgttttgcgtgcctggtaggaggggttcccaaccccctcctccgaatactacatgtggttccatttaggggtgaggtgatggagcaagggaacgattttttttgctttttgagaacagaagggaacgaattggagatgatattactactgctatagtacttcccttttctttctttttttcttttcgagaaaccagtttcctttcttttctgccagggaagttcggttcggttattgcttcccagtcctgccgctgaactttcgaaatagaaaagggggccatttctattcctacgtgtgagtaaaacaaaacaacgataaaaaaatactatgagctaaataagaacaggagactattgccttttatttttatatacttgctgcgcatcaatctgaccattacttggtttctggaatacagcaaagatttttcttttgaaagaatatactagtagcaaagatgacgaaatgtcctaggatggactaaaccatatcttctttgacacggaagctctttttccgtatactcctattttattagactgtatttagattaaggggtgtaaagttctggcgtgtcacatcggatatacggacacacatttaaagtattaaatgtagactaataacaaaacaaattatagaattcacctgcaagctgtgagacgaatttattaagcctaattaatccgtcattagtaaatatttactgtagcaccacattgtcagatcattgagcaattaggcttaaaagattcgtctcgtaatttacacgcaatctatataattagttattttttttatatttaatactctatgtatgtgtctaaatatttgatgtgacagggtaaaaaaatttaccaggatctaaacagggccttatccgtgctaaaagtttttcttattttttttaagaaaggtcataagacccataagacccagcttctattgaaagccaatccgtgctaaaagttggagaaaattttgattcagacttcaaatgtggggaacagtgggggcaccctgaattgaatagtgtttttctttttggcccttaggtaaacagtgcatttgggagtatatgtgagcaatgcaattactgggtttccagccagctaaccactattaggctgtggtcgggactccccagtacgcaaaacgaaacagtgtttagcacgtgattaattaagttttagctttttttaaaaaaaatggatcaatatatttttaagcaactttcgtatataaactttttacaaaaaatacaccgtttagcagtttgaaaagcgtgcgcgcggaaaacgaggagaaagggttgggaacatggacaaacgagttgtcgctatactacatacccggatagggaggacctaagtgatcgtgagggctgtcaccacctatacacctacatcgaacgt

SEQ ID NO: 7728 - DNA, 701 bp, Oryza sativa
ctgcagccctgtcatatactcaccttgcaatcattcatcagaggaggagttctacagtgatgctgatggtgtggaggattaggtgtagccctggtcaagctgcctgtggagtggagtcgtctgcgccgtttatcttattttttttccgctgcttagatctttattgattgagaggaactatttacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagcgcgcaaactcgctggcgaacgacggcgcgacgacgcgaacggaggacaccaacacgtagagggcgacgcggcgaactcaccggtgaccaaaacaacggcggaagatcaacgaacggcgatggcgtcgaggaagaaacggcggcaaccttcggcttgacgacgacggccgtgctctggcgatctacggcgacggcggaggggtggacgagatcggcgacggcttggtgaccacgacggcgacctcccctagcagcgacgacgactggaccgacggcggcgcacggctggaggtgcggcggctactgctgcgctaggctacacgatgctagggctctaccggcgaccaaaggccaagccaaggtggc

SEQ ID NO: 7729 - DNA, 3480 bp, Oryza sativa
  unsure (1)..(3480): unsure at all n locations
cttttaaaaaccttttttaatttaaattattcatgaaatacaatcccatttattaaaaatacttctttagctcaaataaatcccagaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacaaacctaccccccttaaacagaatctcgtcctcgagattcggaagaactggtgaatagatgcggatgagctgactttaattcatcttctcgttcccaagttgattcttcttccgagtgattactccactgaactttacaaaaacggataactcgattcctggttcttctctcatcggtttccaagatacggattggtttctcaacatatgtcagatcctcttggatttctatctgttcaagactagcttcctcagtgggtacccttaaacacattttcaactgtgacacatggaacacatcatggactcctgccaaagattgaggtaactccaactgataagcgacctctcctcttctactgacaatcttgtaaggtcccacaaaacgcggtcccaattttcctttagtgtggaagcgatgaactcctcgaagaggcgtgacacgaaggtacacataatctccttcttcaaaactcaaatctctacgacgattgtcggcataactcttatgacgagactgggccacacgcaatctttcttgaatgattttcaccttttcttctgcttccctcaggatatccgtcccaaaaacctgacgttcccccatttgatcccacaaaagcggagtgcggcacttccgaccatacagtgcttcgtaaggagccatatgaagactagcttgataactgttgttgtatgagaattccgcataaggtagattcttatcccaacttccaccaaagtctaaagcacaagctctcaacatgtcttccaaaatctgatttaccctttcggtttgtccatctgtctgcggatgataagcagtactaaagttcagcttagaacccatctcttcctgaagcttcttccaaaactttgaagtaaactgactacctcgatcagacactattttcttagggacgccatgcaaacacacaatcattgccatatacaattccgccaaccgacttccagaatatgttgtctttactgggatgaaatgagccactttggtaagtctgtcgactatcacccaaatagagtcatggcctgataacgttctgggtaggccagtgatgaaatccatgtcgatctcctcccacttccattcaggaatcttcaaagctgcaacaaacctgcggtntctgatngtctgccttgactcgctgacaaacatcacatactgctacgtattctgcgatttcacgcttcaacttgccccaccaaaatttttccttgagatcctggtacatcttggtactaccagggtgaatggagtataaagtatcatgagcttcctcaagaattgtattttttccatctttgttgtctgggacgcagattctctcacccaaccatacagttccttgctcatcttccaagaaaccgatagcttttcctcttatcatattcttcttgatttgttaaatatcaggatcattaatttgggcatctctaacttgatccattagagtgggctttgcttctaaggcggcaacgaaacctcaactgacaattcccaaatttaatctttcaaattccgtacataactccaatggcaactgtcgtccttccgtagcattgcaatagcctttcctgctaagagcatctgctacaacattagcctttcccgggtgataatgaattcccatgtcataatccttaattaattccaaccatctccgttgtctcatgtttagatctggctgagtaaagatgtactttaaactcttgtgatcggtgtacacctctgtacgagtaccgaaaagataatgacgccaaatcttcaacgcatgaaccactgcagctaactcaagatcatgagtagggtagttcttctcatgcgggcgtaactgacgagatgcataggcaaccaccttcccatcttgcatcagaacacagcctaacccaagcttggatgcatcacaatacacttgaaaacccttctttgggtcaggcaaaattaaaataggagctgatattaagcgattcttcaactcttgaaaactctgctcacattcttctgaccacttgtactttacatccttttaacgtaatcgtgtcatgggcttagcaatcttggaaaaattctctataaacctccgataatatcctgcgaggcctaggaaactacaaatctctgaaactgtctttggttgtttccagttggttacggattccacattactaggatcaacggcaactcctccagctgagatgacgtgaccaaggaacttcacttcagacatccaaaattcacacttgctaaacttggcatacaattgatgctctcgtagcttctccaatgcaaggcgaaggtgttcttcatgctcttctttggttcgggagtagataagaatgtcatcaataaagactaccacgaacttgtctaggtattccataaacaccttattcatcaagttcatgaagaaagcggggcattggtaagtccgaaaagacataacagtacattcaaacaacccatacctagtggtgaaagccgtcttaggtatgtcttcctctttaatcctcaactggtgataccctgattgaagatcgatcttggagaaaacagtggcacctttaagctgatcaaacaaatcatcaattctgggtagcgggtacttattcttgatagtcacatcatttagtgcacgatagtccacacacatcctctgggtatgatctttcttttccacaaaaataactggagctctccatggagatgaactcggtctgatgtatcctttctgaagcaaatcatctacttgcctcttgacttctgctaattcattggctgccattctataaggtctcttatggatcggagttgttcctggtaccaaatctattctgaactctatgtcccttttaggcggcataccaggtaaatcatccgggaacacattgggatactcccggactataggaatctcttccaaagtcatttggttcagacttgaccttaaagactcagaagacaatgcatgaacagttacaactcgaccatcattgctggtgagagttacttttctgttggcacagtctatctttatacctggctaaccagtccatccctaggatgacatcaaggtctttggattctaacaggataagattggctagaaatggtacttcttgaatttctattctgacagaggggctacgttgcaaagagagtgcttgattacttggggtactaaccatcgggctgcaggaa

SEQ ID NO: 7730 - DNA, 1760 bp, Oryza sativa
cttcacgcgtcggggcttcggacacttgtcagcgtaatatcctgggtctccacagttgaagcacgccctgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctttgactattcccctgttgtgccttgaagtgagcaatccggcgtttcttctgctccatgcggttgtacttgtcctcctggcgaatagccttatccactaacttctggaaatcatgataatccccagtcatgagtgggtaagaaagctcatcattaagtccttccaagaacctctcctggcgctcttcatcagtgcgcacatcttctggagcataacgagccagacggttgaactcgtgcagatactcggtgaccgtgcgagatccttgggtgagcgacctgaattccttcttcttgagagacaccactcccgatggtatatgcgtcttccggaaagcagcggtgaattcaagccaagtgataggttcagcagtagtcctgttaaggcggaagtgatcccaccactcagaggcagggccatgcagctggtgtgatgcaaatgagaccttctcctgatcagtgcactgaagcaaatccaacttcttctctatggcatgcagccaatcgccagcttcaacaggattagtggtgctagagaaagtgggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgatgttggggccattcccgttgctgcgagtgagcaccatctggcatgggcaggatcacaagaagagaaaccgtggaaaactacttaggacagagaattaacttttctactaacttaacttttattgatcttaactgagtttcattattacagaactgaagactctcacaccactaaactcaccaactacctaacactcgaaagcaaacaaacgcatgcacttacatcccaccactgatgtaaaccacatgcaggacccacacacacaaccaaacttaaaacaagcaaacgaacacaacgatctaggacaacggcttgacaaggcactctaggtcttccgggcatcggagttgattgaaggctcgttcggctcgtctcaatcatcttgagtagctccccactcgacctttgaatgggtgcgcttcgattcttctccttcatcatcacttacattgacgaccggaggatccgctagggctggggtaacttctttctccaccacacggacctttggtgccaattggtagcgagggacgaatagagctctcttcgttgcggtaagacgaatcctggccttctgcggtggtgcttctcccatcaacgcggctagttccttctccaaacgatccaccttgtcctctaacctgcaaatcttaccacgattccgatcgtcacgatcttgagctgctagcacaacctccgcgcgggtttcatccatagcccacagcatctcaaccaaatgccttatggtagcatcattctcaatcccctcagtctcaagatagctgccacggtcacttc

SEQ ID NO: 7731 - DNA, 1218 bp, Oryza sativa
tgcagcccatagttaagtaataattaaacaatattaatccaacgctagacaacataccttgttgcataggcccaaccattctgaacaaccatcccggctgcacagttctatctccaaaccaggaatatgccattccaaaccaggagctaatcaaattattaccagttatagcatcttttattatgatgagaagtgtgagactaatcacgaaagacattgttagacccgcccataaccgcgggcacggctattcgaatagttttactctggccagaggtgtaccactgtacccacaagacacagccccacaacatgtcaccatgtgccttcataccaccacggtacctcggaaaggagctgtgacagtaccccttgcacaacacaatccaccacagcgcacctttcctggatcataatcacccccttataaacaaggcatggactccccagcgacccccgtgggcttatcttcgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcagaaccatgtgctcacaacccaccattatcaagttttagttggcaagtaattaattaaccaatcacgattgaccatcgtgaactatcattaagccataattaaataatagtgagtcataagttatcccaatagtgtgctaatgtttctaagcatggctaagcaatcatatctaatatttagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaagagctttaaacgggatcaacatgctcaaagggttgtttgggatctatgtgacttgccttgctggccttggaactcttcaaattcttctcctgcaaaaacggactctccggaaacgtcggaatctaaatagaaatgagcaaaatcaccaaaacagcacacaaacaagcatgaacaatacatgtggatatttttaacatgtagatctcaattttagaaaaatttagagactcgaaccaactaaatccgagctaagatgaattacttatgaat

SEQ ID NO: 7732 - DNA, 7331 bp, Oryza sativa
cgaaactcgtgaaccggtccttaattgttatgagcacgactcccaaaaccatgtgctcacaacccaccattatcaagttttagttggcaagtaattaattcaccaatcacgattgaccatcgtgagctatcattaagccatcattaagtaatagtgaatcataagtaatcccaatagtgtgctaatgtttctaagcatggctaagcaatcatatctaatatcttgctgaaccaatatataaagcccaactagccaagttataataacccaaggtatctgtgtgacttgccttgctagccttggaactcttcaaattcttctcctgcgaaaacggactctccggaaacgtcggaatctaaacagaaaggagcaaaacaccaaaacagcacataaacaagcatgaacagtacatgtggatatttttaacatgtagatctcaattttagaaatatttagagacttgaaccaactaaatccaagctaagatgaattagttatgaatttttaaagattaaatcggattaaaacacttatatgggtattaattgaattatgacgcaataatgaattatttttgaaaaggaaaagggaattattgcatcagcggctagggttcgcggtgaaccgggtgcacggcggcggctgacgaaaacgaacagccgagatctttccatccaaaacgaacggccgagatcgaccgatccacagccggaccacggaagacgacgacgatgacgtcaccaccggcggtggctcgggcgcgcaaactcgccagcgaacgacggcgcgacgacgcgaacggaggacaccaacacgtagagggcgatgcggcgaactcaccggtgaccaaaacaacggcggaagatcaacggacggcgatggcgtcgaggaagaaacggcggcaaccttcggcttgacgacgacggcggtgctctggcgacctacggcgacggcggaggggtggacgagatcggcgacggcttggtgaccacgacggcgacctccccgagcagcgacgacgactggaccgacggcggcgcacggctggaggtgcggcggcgacggcggcgctaggctacacgatgctagggctctaccggcgacgagaggcgaaggcgagggtggcggtgggtagcggcgggcttgggggtccttttataggagcaaggaggcggcggcgaaggcccacggcgaccggcgacacgaaggaaagtctagggttcggaggagagagatcgatccgactcgaactcgaatccacggatttccaaacgattttagccgacgattccaaaagagaaaaggtagaggagatcccgaagatcatttcccctctattgatttcaccggagaaggaaaggcgcgagcgaatttggaaggagacggtggcgcggctcggctagggttcgggcggcggcagcgacgcgaggaagacgaagactgacaggtgggccccacctgtcagcgggcggacgcgcgcgcgagcggctgctgccgaactaggccgactgggccgagagagagagagagagggttttgggccgactttcggcccaaagccacaagaagacttttaaaatcctttttcaatttaaattattcatgaaatgcaatcccatttattaaaaatacttccttagctcgaataaatcccaaaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacagccacctgctacattgctgacttcaaacggccgccaaatctgcatacgacctccgtttttggcccatgagtatttgatggaaacctctcggagtcctctttccatcggatttggcctcaccaccaaattccatccaagtcatccgcagatgaaaaaacaaggtactacgtcacctgtcatgggcctatgggcttgtaactttgtttggaaccccggcccaagtggggcccatgtggggtgcgccccaaccaggtggaggacgacctagggtcctcccacctccttaaatagttaggtaccccttgagggtttctcgggttttgttagattaaagtttagcctttgttacttgcttgcagcgcgcgtgtcggctagaccatccgtctgcttgttcttcggaaccccaacttatcttgtgtattcattcctatttgcaatatcagattgcttttatcttgttcttgcttgtttctttgatttgcttgcaggaatagggttgatttgcaccggcgagatcaacaacccatggagaggtgtatcgatcgctaaggcgcaacacaacaacgtcttgtacggttgtagtcgggtcgtcaacgtttctcccaaatcatagttatctcaactcaccgaaagatcgggccaaacaacagtcttgagtgtcgagtggaactcagggttcatcagatgacctgatatgctatttggtgccttttaagaacaagtgcagcttcttctctaggaagaagaatgatgagtatgtgccacagtgccagttaatttacttccaatcatccttttttttaaaaaaaaaataaacgtggcataatcattagtgctaaggcacgctttatgttggctgacaagcttacaactatatgatatctatgtgcaaatgtgtgatatgtaaatcgacttataaaagccgacagaaattgataagattgccctgcagccactgttaccatgcggattgcataactcgctggcttaagatcaacaaggtaaattatacttctttatatttgatgttgtacctccaaaatgcaaaagaagtttctgtattctgtgtatagatactaaatgcatatatgcgaacaagagtacctgtaacgtctgaatattactcaagaaattcgatacatagaatgtgatacattgtctgaactttgtctgacgggctgaatgttgattgctttgtatacaaacttgtcttgtctggtataggaagattatccttctggatctgattttatgtttcttttctttcaggcatgcccagtctgcaatgaggaggtatttgggtgaatcacaaatccaaaaattctaaataggcctaacatgtccatcgaatggaatatcggagtatttttctcatgaatttcataaggtatgttgtatccctctttggttcaaattcattcaatattatatttcagtgagtagtgacgaagtaacaatgaaacaaagttctaagaacttaggaatctgtttgtgccaagaaaactttttagccttgtagccaaattattttgtcatgcacacataattgcctacattttctcttaaatgccacttttcatgaataaggacatgattttaaaggtagattactctgttggttgtacaatttattctattaattgctaaaagaaaaaaaagactatgctgctatatttcccttgaaaatattgttgtagtgggattctctacacttctaagcatacatcatgaaaagagagatagtgccaagtgagcaatgagttctttttaggagaaattagcaagttaatctgttctctaactttacaatgcaataatgcagatggcagatgttgaactctttatgttatatttcaggtagagaagaaaaatgttgtcctgaaattagaaagcgatagattgattatgtttgaccattctactcatttagccaagcttctattaccttttgttacagctgtcgaaaggggcttgcttaagaagcaatattaaccatgatggcatttgcaatagagagaaatttggaattcacactttcagagcaaaaattattctcctgtgacctctcacctatcacaagaaccccaaccactggatgaagcgggcatagtacatgtatatgcaatagtagcacccattaagaataggtatgttccagtgtctctcgtgttgctttattgtgtcgttaactccatcttggtaaatgataatctctgctactgttgatgttttgcactaaaattttctctttcatgtcaatttccattacagtaatactcattgtcatctagacacaccaattgatagatatctaggatggggattaaataggcctaacaaaaaaatacagcttgacatttaccactcaaaatttactccaaaccaaataatatagaacaacagtgtgcatgaagtactacattgcatcatgtaaatgacaaaccagcaaatgaaatgtttatcataatgttggtgagtagaaatgtgtcatggtacttgcattgttgaccaaaatgtgtagttgatatgtgcctgcatcatacagataataatatgacctctgaaacagaaggatagaaccctcttgcacataggaattgttatatcaagatggacccttttttggcggggaaagatggaccttattaactgatatgagtaaagtaagctactgaaacacatgaatatagcaaaatcacaactccaacaatctaaaaccgatttggactggaaagaaagaatgaaataacggtacaaaattcaatttccacgagaaagagaatatgaaacattaatttatttacatgatcaagctgaggcagggctatctctattctctatgatcagtcgcccaccactgttgttattggcaataaacagaaatatgtggttgtgcacaactcacagtgctgccctctccctgatgaagctacaaaccattaatttcccataaaatgcatatactacacatgccttcgttgaaaatgtacataacattcatagaaaataagacaacataaataacaccaggccaaaaagatacaattagcaaactaaattcgtgttcacttttatagttacttgttttattgtatagctacataaagaataaatcaattatttacaaattgcaacttgtatgagcgaaccacttatgcatgttaacagaattgcatgtataaagtattaaaaactgcctgataaaatgagaattagtgaataattaatttgccctcgtaagaaccacttatgcatatagcaaaccatattcaattatctcagggtcaaaaacacattttctgaatgcttttaatttttgttcagtgtactatgagctgagtaatgtagtagtagtttaggttttaagattgttgcatttctcaaggatcaattggatttgcttgattggattcccgtaagtacaattgatcagactagatatgcaaaattgataagagggaaattcatctaaaccttttgtaaaccttttggcgtgggaactgggaactaacttattcttttaggtagatactgcttttttagccaggattcaaatctggctaagaaacatggttggtgataggttacaaacatgttgtgtcagaggcatgttgtgcgtgttatgttaatcagtactagcttcttacatgcatttcagtgttcagttgagtgtttagttgcagagaacactctatttggttcaaattaaatagaatgttacagtgtctgtccagtagtaaaaatacattcctgttttttcaaggagaaagtaaaagaacttttaatcatgctcagagaccgagggatagtcatgcacaaaaattagttttagttagaactatgtgattccagacttaccatattcatgcatgacttttaagagattgtagctgtttgcataagatatttgtgatgcttctggatgaatttcataattgctccttatatgaaaacaatgatttacaaccagtggagcaaactactcaggagaaactaactagctaggggatgaaaacaatgatttacaaccagtggagcaaactactcaagagaaactaactaggggatgtccttcgcaggttattcaaaaagctatctgtggaaattgtactaatattttgctgaccataggggatattcttcgcaagctattcaagaagctatctgtggaaaatatactaatattttgctgacaagtagccattttacttagtgtttggtcagagatactagctatcccagcccacatccctaaaggacatcactacaaagtataaatttgttggaaacttggaaatggtaggttcataaccaacagcattctgcttgtaggtttagcgtcagtacttgggattttgcatttatatgcttttcctcaataggtttagcataatttagtgatccttcttgtgtacctcaccttttatattagatgaaatgcacatattttttattagtgtctatcattcaaccgtgtaaacaacagataataaaaattatgtacaggcggcgcgccattggcgcgccccagcatctagtaagattaaaagatggaggaatttttttgaagttgtcgtttgtgtaagctaatggataaagggaggaatatggattagacttttgtaggattagactttgttgacttaggcttggaatgaccaatgggtacaagaaggccccaaagcttgcgctccaatttgtgcctttcagtgcttctcaaagatcaagatctaagcgctgaaaatgccatcatcagcccatcacatttatctctcaacagtttgtgaacgcagctcagcatgtttacagttcaatttgacggtgtgttacggtttgacattttagtaggttttcaactttggactctgcctaagtattgcgtgccaaaagctctgctgtggaaatagattgcagtagaggcttaatctatgtgatggtgatgcatgggccaaaatatcatattgcgagagaggcaatccattttgtcacaagagtctctctcaaaaggtccaggttgtccacaagattacatttgacatgaatttatatcagcgataaattttagtggagaagaaatgcagagcatgtatgaagcctacattctgccgatcgaattctataacaggagaatttattactaaataacaaccttatttagatagatacttcaacagatttattgaagaggaggccaagtcttggatcgatggtccaatatattcgttgacagtcagcttagatgccactcccaagtagagccatcaggaaactcttgtagtcaccagatgtatcgttgccgatggctttcttcagggggaccgaggccctcttctccagggcaaccgaggccctcttctggaacgcgtccttgatgcccttgaggtccttctccgcgtgcagcacgatcacacgggtcaggctgtcctcgttagtccctgacttgtgcatcgcgttccttagcacctgcatgcatgcgtacatacgtgcacaatttgcagac

SEQ ID NO: 7733 - DNA, 2215 bp, Oryza sativa
aggatacgtagtagattaattagctcgaagcaacaggggcgatgaaacacataacagagatattctgtactagcgagagtacgcacactgcgaagatttccagtggcgcgagcggccacgtcttcttctagggagcacttgtagaggacatggtaggttcgttttaccgctagaagctccgaggacgagttcgtgcacgcgatctcaacgatgacagcgtagtcctcgtggatgcatttcgtcgcggtgttcaccatcacggcctgcctctcaacagggtcaagtacccagtggtacatcgctctctgcagttaaatatagttagaagggggaaagaagaatcacatacttaactagctttggtttaactaatttgagttcttgtggtgtgtttatgaagatttgcagcactcttacctccaaatcaccagaaagttcagactgaagacgctggatgaggttttcgttgtagttctcttcataggtcagtctgatctgcttcctctgagttgcgtcccggtgagctaatacgcctattactgcctgctcatcagtgccccagcctgcaccataaaaatagttcactggatcaacaaagtttttccgatggaacaatgcaaagagaaaacagtgctagtgttgaataacttttcgtttctggaaggctggaactaataacttgttcagtctttacaatcgagacaaaaagggcatttaattttttgccatttttaagatgtggcagttaagaatttatcactcgttgtctataacatatgggttctcgtgtatctacgacatgtgggcacaatttgaagacccttttatatgcaaataatgaacttttgtcaccaaatatttgaacctagttttccagtaaatttcagtcacatttgtacccgtttgattttataacctatggtggtagataatccatgttttctgcacaaacttattgagcaatttgaacgggtttgggcttctgtttgttaccccccgatttgtggacttctgcgctagctatgtcggccttattttgtagctttctggtatggtcttccatcttaataagtgggcttcattcgacttaagaaattttacgtgtttttggaaggaataccaagcctgaacaaaacaaaataagtaccttcacgaaaacacactaggccatacacatgaggaaaaccaggtgatttctgtgctttgttgtggaaatcgctaagtactattttcgttttaagttagacgttttgactttggtcaaagtcaaactgtttcaagtttgactaaatttataaataaatatagtaatatttatattactaaactagtttcatcaaatcaataattgaatacattttcataaaaaaattgtcttgggttgaaaatgttactatttttttctaaaaacttggtgaaacctaaagcagtttgacttcaaaatgttttataacctgaaatggagggagtaaattttaatatattttttagataatcgagttaggagtaaaaaaaaatgatacccacactttaatgtgaaacatttttttatttatttttaaatatattacaaaaagatagatctatggaaatattatgggtgatgtcatgatgattggatatgcttgcatgttaatttatataattaaatatattgtaatgatattgcatgcatacatgagattaaatatataattatagctagtgggtgataatgtggcatggttttatgttaagctttagacttagcgggttgtaaatttatagaaattatagatgaacaaacaattacaaaagagtattacaactaacagggtacaatagttggtacacagaaatctgtataaatattatttaaaaattttctataccatagagtaaaaagttgcagtatgtataatttacaccgcaaaatataacaaacgtataatcaatttaaattgattatatttctattaatagcgtgatccatgtattaaaagaaaacggctataattcatttatccggacacaaaaatccttttgcctttgttaatttcctcactataattttaacgggtgaagatatgaacagcattgtaccactgatgtaaatctgcaatatttaccttctctaacatgtttggtttgttccaaagtctacaaatgaaaaatttttgcaaaaaaaaaaaggtgccgaaaaaattcaatagtaactgatgataaatatcatgtg

SEQ ID NO: 7734 - DNA, 1210 bp, Oryza sativa
tcctgcagccctggtatttcttatgaccacagataaatccacaagcgcacggaataccgctgtagcatttcaccttcgggtaaccccaaaagggtattgagctcagggaacgtgtgtaatctatctaaggctaagattatccaaggacaacaactaatggtaggctagctaggctagacaggactttctatgtgttttaattatctaagctaagtgaaggtaattttctgctggtctactagcgtggttccggctatagctctatgatgtacccgaacgtggaggattactaggatgagattcagagctgtcaccacctgccgtctacctctgacaaatctgtaggatacagaacaaacaaaaggtaatctctaacctagacaccacgcctaagttattaattattactctaatacttgcgcaggaacttccttctttatcaagagtcctagtactagagcacttagtatgaatactaaacaatgaacccgcaaagatggaaacctatctcacttagactaagtaattaaatagcacaagaaaggatctcgaatacttaatttatagaagaaatttctccgaaccttgagcagagcataccgatagctccgatactcctccagaattcctcctagaaagctacactcatcaaggcagaagtcagagagagcgccaaacttttgggcactcctctagagcttctcctcactctctacctatttctaatgtacaaaagatacaatagagcctcttgtaattcagctcaaagttgtgtgttggtgaagtgagatgagctcctccttttatagcctccatatgatggttacagctatgtgaaatgtccaatttgccctccaaccatcattgtgaagtcatcaggaacgtacacgtggaaggcaaggatgaggggcgcctatggtggttcgaccgaaccctgggccccacctcctagcctctcctttggcagggacactgactggttggccctgatggcggttatgacagttatgacccattccgtggcagtatcacctgacttgtgggccctccaatccgtgtacttgcgtctgattggccggaggtgtgtttccttgtatgccgggtgtgttttctccttaaaatacttgcatacacatatttcaccaacactagtggaattgattagtaataatccctaccactaagttggataccacattttttaattttt

SEQ ID NO: 7735 - DNA, 14952 bp, Oryza sativa
acggctgtcgtaatgaactcggcagtaaggggtggcttctcgaaacaccaagagaacactgggtacggggtattggttgcatgactgtataatagcaagtatagactaaaaatgtatgtatactagaagtacatgaatgatacttttcttattctttcaccacttagcttagactatattttagagagagtagttgttagttctttcttctgtgtgtcaccctaccctttgaactgactttgatgtatataagtaacgtataaactattagcatagtactctcttatcatatcttcccttgggataaaataaatacgataccttggaatactctcaggtgaaatgctacaatggtatatccgtgcgcttgcggatcacatctgtaaccataatataccatgagtatttctagtgctattgctgggaattatatttccagtagtgtcgctaagaaataccaacagagcccacgtatgtagccaacgagcccaagtgaagtggctaagcccatgaaggaaaaatgcaaatagccctgtagcatctagtcctttactcatttacttgtctgatgtctccaactctggatcgaatcaattgattccttctcttctcgttcacctagtgacgctgcttccttgttctcgttcccctcttgccgattctctcatctcgcgttgccattgattatcatatcttctcgtagtgccgttctaggcccccaaccatcgacgcctaccctattcagattctcctcgccgtctccttcaccggctttgcctcgcggcactcgacctctgccactcaacctctgcttcgccggttgaagcactgccacaccacgccatcatatcccctctgtcggatattcctcgtgtgctttttcctcgttgacctagctagcctgttgccagtagccttcactgggcaacaaagtcgtggaggtcgcggtaccccacctcgtcgccccacgcagcagtcatggctccacctcgtcacctcactagcttggctcacgagccaaacgtgctagctcgagcttgcaggcaagccgagccgagatggggttctagctcgttaggataacgagccaagctagctcgttatagctcgttatcctaacgagctagactgagccgagctgagccgagccagctcgatgtccatccctaaaaaggagggggtgaaacctgaggtgggtatgtttggttagggagggttatataaagggttttttcatgatttccccctttgcagtatcgcggtggtactttggggcatggtaacatatgtagaatcgtgtcttgtgagtaaagttgtactcctctgatcagagttaaaactatttgaatagccgagcctgcggttattgggcggtcaaccagctcaccgtgattagtctcattctagttaatatgacataattaactggtgtagttaaggtggtttggttgggactattgcaacgtggtttagcgttgagcagtgatttttaatattgcttaattataattattgttttattgtattcactttatgatttataaatgctgcttttgttgcaaatatcctatagcctatcctttgtgaatatcttgcatcataccttgttccggacattgaggatccctgtgggttatgaaggaagcaacgtgttttggtcgtgaagattaagtttagattatttgtttatttctatagcatttgtaaaaattatttattatttttgtaagacgtggatttgtttatcaaattatcgtttgtgtactctagctggtcctggacagagattttattacacattctacttggagttcaggtagggaatttctgggcatgacattagctgagaaggaattactggcggctagcttgccatcggctgtgtggccgatggctgtgaacttttggaaattttcattgtcttgaacaattgagccagccgtggcgactgttatccctaattttgcggacttgctctgattttgggaaatggaaagaggagatcaagtggataaataactctcaaccaattttaggagataaaaaaaggctcaactggattttgatataagggcacacaagaattgtcatacaaggattgtctttcaaaggttctagacgctgagtgaggcagccggccgtgctagcttggtctacgactctatttgtggacgggatagaagagcggcaggccgagcgaaaaaaggtaggaatagactgtgctaggactgaaaaggaaaaacttaatgggcttttggctcaaaaccaagaaaaaattttgattaactttttcattatagtgtatagcaatcataatatttcaagttattgctcagtttataataggtgttgtttcactatgaaaaatacatttacccgttgcaatttttttcagagcgtgtacattcccgtgtttgtctgctccggctccacccgaactccggcgcccaatccgccggcctcgacgccggttcgatacccccgatgttatcctgtgggcggaggacctaatcctatctatcctgttccccaacacccatggcaactagccacctcacctctcgctccctcctcgtccaagcccagtaccccatctcacggctcccatccaacctccgcctctccctctcccaccacaagcaaccagccgccgtcgccaagcgccgccgagcccccgccccctcccacccggccttctcttcggtcatccgcggccgtcccaagaaagtccccatcccggaaaacggcgagccagccgccggtgtccgcgtcactgaacgtggcctggcctatcatcttgacggcgcgcccttcgagttccagtacagttacacagagacgccgcgcgcgcgccccgtcgcgctccgcgaggccccgttcctgccgttcgggcctgaggtaacgccgcgcccatggaccgggaggaagccgctccccaagagccgcaaggaactgcctgagttcgactccttcatgctcccgccgccgggcaagaagggggtgaagcccgtgcagtcgccggggccattccttgccggcacggagccgaggtaccaagcggcgtccagggaggaggtcctcggggagcctctcacaaaggaggaggtcgacgagctcgtcaaggcgaccctcaagaccaagcggcagcttaatatcggtgagttgcatctgatgcagcatcactcaattgtacacatggaacatcaactaattcgacagataaatgtctgcaagatttgtttcccccttgggctctggtaccctgttatgtctgtctgtgttcttttgttttctttcctataaaagactcgtgctctatgtgttttggctttctttacaaagccagatcaataataaatattgagtaaatttcacaaaactacaggtatttttgcacaatttatcagaaaactacagatttaagagctttcgcaaaactacagatttagtatgtccgtttattgtacaatctatcacaaaactacagatttaagaacttgtttcacaaaactatagatttagtgtattcgtttatcacaaaactacatatttagtgccttcatttatcacaaaacgacaaatctagtgtctccattatcacaaaactacaggttttaacaaggaaggggatggagaaagaaaaataagtatattttgttattatactcaccgatcaccgtgacatttatctcttgagtttagttcttatcatgtagccgctttgtcagccctatcttgtattcctagtcagtctctcattgccaacttttgcaggtagagatggtctaacacacaatatgttggagaacattcattcgcattggaagaggaagagagtgtgcaagataaaatgcaaaggtgtatgcacggttgatatggataatgtctgccagcagctagaggtcaaattttgctacttacctcagaattcttaaaatgcatacggtgtactactcagttaaattggtgactgttttattttttttttctttatggaccaatgttctagtaactcatctgaaactaatagaatttagaagttgtcttagctctggttattcattagtgaactcctttctgcttgaacttctgttttccatttccatatctgggagcaccttatctgtgactcttccctgattacttcatatcatacatgagcaggagaaagttggaggaaaagtaattcatcatcagggtggtgtgatatttctctttcgtggtagaaactacaattacagaactcgcccaatctatccacttatgctttggaaacctgctgcaccagtgtacccccgcttggttaaaaagatcccagacggcttaactccagatgaggcagaagatatgcgcaagagaggacgtcagttaccaccaatttgcaaactcggtaagtctctttgtttccatgtagttgactcctttaactgcctttcaaattgtggaatctgcaaatttcatagttaaaagaatgaaaaatatatgcgctagttgccaaagtttatttttgaaaatattagtgcctttgcagccaagagtaatgtccaaaataggaagtacctgagggaggttgatgtcgaacatgaaactactacttttatttgtcagaaacacttgaaatgtggaattacagttgaaccaatgctgcttcttttgctgagtgtggtacatattgtctatccacattagcccatcttcttgcatagcactgttccatgtttgtgcagtttgttgtcattgtttacattccattttttttaaaaatttttaaaggaaaaaatggtgtttatcttaacctcgtgaagcaagttcgagaagcatttgaagcatgtgatcttgtccgggttgattgctcaggtcttaataaaagtgattgcagaaagataggagctaaacttaaggtttggtaaatgctcagaatattatatcgttatgttattttgttcaaaacatgattaattctacctttgcaggatctagttccctgtaccttactgtcttttgagtttgaacatatactgatgtggagaggaaatgattggaaatcatcccttcctccattagaagaaaatgattttaaagtggcgagcgaccaaattttgaatagcaaagaagcaggttctggaagtgctctgaccccaattgagctggtcaacaatgccacgtctctcaagaaatgcaacttgattgaaggtgcagaaaaattggaagattccatgaagtctagttttgaaaatggtatgattttgggttctgcatgtggaaaccctggagtatgcaactctgaaggtatagatggaactgagtcctcagctgatgctccaattgaattttctcctccaaattcagcaagggatttagatccatctcaaacatcaacattgtattgccaaagctccctattggacaagagtgaaaatggagagctcattgagatgtaccctgacagatgtggaaactcggaacaatctccagatgtaccagaagctttaacttgtctaatgggcagcagtgatgagattcatgaattggaaactatgaggagaaactgcaaacatttaaacggcagcgatggtgttaacagtgattccatagtcccttcctacatggaaggaattttactccttttcaaacaagccattgacagtggcatggcactcgtgctgaatgaaaatgagtttgctgatgccaattatgtgtatcaaaagtctgttgcttttacaaagacggctccacgatacctggtactccggcatacaccaaggaagtcccatggtacccagaagactgagccagccaagaatgtaaggataaataagcatcttgaagaacataaagtatctgatcatgtcaaaaagaaagaaattgtcatgggaggatcaagaatgcagagaaatgatcacgcacgagaatttctatcagatgttgttccacagggtaccttaagagtagatgaacttgctaaattactggcttaaaggtgatcggtcctttattaaccgaaggtgtgttgcgttatcaaccttgaattaacgtgcaaagtatatacatgtacattgatatgggacgtataaaacttttcgtcaatttggtcatgctgtgtaactgatcacgctttctgcattgaaatgttggaatgtaataatatggaacggcgaagcattttcagacaatgagctctacctatagtgtgatcatctaggttgtgtccgttagctatggttgggaaccttcccacctagcacgcaaaacggatcaattcattagtgcatgattaatcaagtattttaaaatatttaaaaaatggattaatgtaaatttttaaccaacttttttatagaaactttttctaaaaaacacaccatttaacagtttagatgtgcatgtgaggaaaatgaggacttgaagttggtaaagtgttcgaaataacccttttcaaaccattgatcctaagcatatgcctggaagttgaagtaagattttatagatgtagcttactgtaaaatcaagaagttgatttagattttgtgatgaaaatattggttgtttgctgatgaaattttggagatttatagacgattgattttgtgaagtgagagtgttcggttgaccctggcgatcagaccagccaaaccaatggtctgaccggtgggatcttgaccgttgtcggtttcaggttgtcttattggatatggatgtttcctttagggatttgactttaagatgatttctatgcatatggatattgttgttatactaatatgagtcaagttgggacgaacttgtgctcggaatatggtttcttggttgttttacatgtgcaggtgttgcttgaggcctcgggagagtattgctggtgatagattggagttaacttgggagaagttgatgtctaggtatcaacagattataggatcaagatgtcgattagagggggggtggtgaatagacgatttaaaaatgaatggcacctaatcaaaactaacctaagttgctaggcttagtgagggttaagtctaattaagcaactaagttatattttacaaacctagggtgatagtggcttaagtatatctctaagaaagtaaatcacactcctaagttaagtttagcaatcctagagtgatatgatctcaagtatgtctctaggaatgtaaattgcacaactgtaaatgcgacaaataaatgagacaaggagacaaaagattttttaccgaggttcggaaattcgccgatttcctactccctgttgaggcgagcccaactccaccgctcaactagtattaggtttactaactttttgcagagaatgattatgaagtagaggagaatcgacatcaactcggacgataaatcaatcggacgatgtcgagaaccagacttgtgtgtgaataggccaagaactcagaattgacacgatgaattaggccaaaattcacaagtctgcggagtggagcaatagaggaggccaccagccgaaactgggctggattggctagccccaggttcggccgaaccaatcctggcaccgttggatccaggttttggcatggacgtccaggattgcatcccaatgacggttggagggcacttcggacaattccccttccacaaccgtcataaccacctctgtataaggagctcactctcttcacttcaacacacacctcaagcaatagctctctcattcctcccaagtttagtttagtagtatctagctggtgtaatagaaatagaatatgagtcaggagtccggaagccttcagaagagttcgggtatggctctagcagctttcctttcctcttttgtaagatttgtacttttattagaatactcttctatatatatttatggtattgaaatactttccgagtatatgagtaactattatacattatgttcttgttatactgaatataaggctaacttatctgggagatgctttggtgcgggtatagtgtttgcttatgcaattactctatgtcatgatgatgatattatagtagtatctagtagtttagacgtggtgtctagattacgagatatcattatttggggttatatattgcggatgagaggtgggccactgatggtgacagctcagtacgggtattcctctgcgcctatatataatcctaagttaatttcctggggagggtattcctccgtatttaaccctggttggatggtcatgacaggctgccgtaaggaactcggcagtcaagcgtggcttctcgaagtaccaggagggtatcggatagagggtattagctagtatatcagttaactagaatgtatgtatactatgtatattagaagtataggaatagatttcttttctctttttttttccacctagcttagataaattattaccgaggatgagtagaaatgcttgggtgtcactctacccttggattatcttaacccctgcttagaatatgattatcacaagtaatatataaattattagttgagttctctctacatgatcttccacgggataaaataaatacgatacccttgaaatactctcgggtaaaatgctacaatggtatatccgtgcgcttgcggatgaactctgtaaccataatataccaggagtgtttcggcgccattgctgggaattatatttctagtaatgtcgttaagaaataccaacaccggcccacggagaggattacccaagcctcgatcactaggggtagttcttccttcactccgaaggtggtgaactccaaaccactcacaaccagcgtcggccttcctccgcaatcttctcggagaggtcaccgggcaactactccacaagccgtctaagaggcggcaacctccatgagtaacaagcaatgacgcggctcggagatagctctacaatggaagcaatgcacttgactcttggctagaacaaccttcaaccactacaacggatgaacacaagctcaaatgagtgtgggagaggtgcaaggggtgtatacaattgaagtggatgccaagagagtctccttgctgctggtgggggagtatttatactcccacccaccaaaactagccgttggggggtgaaatcccccaactctgtgtactgccagtctgaccggagttgtgtggccggtcagaccgtgctactctgcaacggctagttttctagttgttgtagggctgtcattgggccccatcggcctggccggtcagaccgcagttgggtggtagaccggcctcggctcggtcagaccgcccctagctcggtctgaccgaatgcggctctggcggctctggatcgccaccccgagagccacagggagaggttccctaggccggtcagaccggggttcacccgccggtcagaccggctgacctacgccggtcagaccgccactaggtggtcggtctgaccggccctggtcacacagcaggcacaacaggataatgagagcaagccaaatctaaatgcataatgacctaatgtggaaatttaaatcatctctttgctaggtcattacccctcttaatagtacggcaaagctataaataaactagcacagtttgattgcccaatacctcgatcaatttagaattcaactactagtttaccgtcatctatactttgctttgcgccatcaatttttagtccatcgataatcaaccatgcgcacacatgatgtgtacctaactcaaaacacataactcgatagaacggttagtccacaattagcgcttgtcattaattaccaaaactaacaacgggggcctagatgcttcaatctccccttatttggtaattgatgacaaacacttcaaacatatataatcaaatataaagcacatggatatatttttcaatgtatagaaaatactccccctaaacatgtgcatatcaatctcaaagaacaaatttggaacaaatgcacatttcaacatagttcaacacaaatacaacatatgatgtgaacttcacatatagatcaatcaattgcataggatggtcacaaatatatcaaaatcacatccaccatccatcattgcacaagttcacatcaataaaccatccaaatcataaaagttcatccatagatcatccaagtcacaaattatccaaagagggctcacaaataataacctaggctattacatgaccacggagggcccaaatctcacaagagagttcaacaaacgaataaaaccacccaagatagataatatagcccattacatatagatatagccctcccaacttagcctaatagatatgaggactaacctcactacttctagtcccaacccacctaagatagatgaatttcttctccccctttggcatcaaggaccaaaaagcttcattcttgaggaatagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcctcagccctcatgctcggtagttagcctttgaatgctttcacttaagctatttatagccccaagcaccgagttgaaatagtcctgaggaggcatgccaaagtatgcataaggaggagtgaagtactcattgataccttgaggaggaggaggtgctgagcttgagattgccccagggtggaaagaaggttgcctcatcctaggagtatggggagtgccaagctgaagacgaggcttatattgcttatgcttctttagattgtttccaacactcccaagctgagcttgaatctacctcataatgtagggcgcatggtaaattcattgactaaacgtgcccttggatattgcaatctcttgcattatgaggttcaccacatcaaactgacgaccctgcatgatggcatctatcacatgccaagccacccccttaatatcatcattattcccacatcgagggagaatggtggctctcacaatcctgttcaccacactacgaatagtcatcaaccctgcaactttcccatgggtgtgtcgccttccatcttcatagaactgtgaaagataatcaatggagagcgggttgtgagtatgctcctcatgcagatcatcaccaaagtcaaagcggatgttgagtaacctccggaactgcctcctagagatagagtactggagggtgtgtgacatccacttcatctcactacaatcaccggcaacccacgttgtggcataaaattggcggatgagctcctcatcatagtcttgtgccataatgactatgcaatctatccccacagccctgaaaagggcttgcaagcttgtaaactctagagtctcatttatgttccgccatgaaatccacttgtgctttgcaaaagccctgctcctgtagagctgctcataaatagtcttctggaaggccgtgtgaaaacggggatcagtggtgtctctaggcctcttgaactgatcatgatgccttaggatggtgtactgagcggagttcctgatgttaaccacaaactgaacagaaggatcaatttccatctcatttccttcttcctcatcctccccactgccactgtcatcaccatctccactttcctcttcaccctcttcccgtccctcattcacatcttgctcttcttcctcacttgctcatattcctctccgctcgactcctcatgctcgcactcgggctcttgcacggccgcttgatgaccatggcgagtgcggggaggcattgctgaatccaaagagcaataaaggaatatgagcaacaaatttagaaaacactcggttaggcggaaagaaattttgcactgccggtcaggggcggtcagaccggtggccaatggccggtcagaccgcccgtagggctgaccagaccgccactaacaagtccaagcaaaaactctttcaccacaacacaaatgattctaaataggctaggataattttgcacagggtaagatcgtgaatcaacaaggatacggtctatttcatcaagattggaacaatgagggaaactacccttaaccctatttgagagtaagcacaaaagggagagtgatttaccggttgaaaggagatggtttgcacgaagaacaacccactaatttgtgcaaatccataagcacttcttccttcacctagagttccaatccatggatcaaaaactcaataaaaaaacaaaagaatccatggaatagagagcggaagagcaggagattcacttacggtgtaaccggagtgaaatccacggtcaaaccgaggggatttggtggaggagagtggctagggtttgagagaggagagagagatgagtttttcgagttggggatgagtggggaagagaagagaaggggtaggtgcaggatggagaagaagaagaagggcaaaactacctgggcccacttcagccggtcagaccggccttatgtggtcggtcagaccgcctcacctggtgtcacgtctagaaatttagcccatatttccagactattttgtgtattaaatccctgtccaggaccaggaccagctagggtacacaaaacaataaattaatatacagacccaaatgtaaataaagcgtaaaatacttacagaagaggcacttagtcctcacaccgaaagagaacgacagcagcagaaaaggcgatcctagcggggcttcagctccactccacaggcaaaactgaactagggtttgagccttggtcctctaacttcatcttcaactcagaagcactacacttctgaaaagggggaacaacagcaagactgagtacaaccaccgtactcagcaagccacaccattgatgcagacgtgcaaggggattcaaaaatggcttgtggctatttgcataaaggcagttgtaaaacattttgttgagcaaaacagtaaaactgctgattaattaaggtaacattaaatctctattgatcaacactacaccacgttgaacaggcccaaccaacccatctgaactacagtgcattgggtcgatttattaagtgtgagactaatcacggtgaatctggtcgaccgcccataaccgtgggcacagctattcaaatagttttactctgatcagaggtgtacaactttacccacaagacacagccccacaacacgttcccgtgcgccgacatgccaccatgacatactggaaagaggccgtgataggacccttcgcataaccccctctaaccaatcgcaccacacctcaggtttcacctccactcctcgcaaggcatcgggcagtcccctctcgtgcctaggtgaatccggaagcgacaaaggccgttgcagggcccatcccgctccatcatgcccacccttgcctggatacgtcggctagaggaaagctacactacaaacccagccgttgcccacgctggcttgtggtaagtacgataagttcttccagggcatcccgcgaaccagtccttaattgccatgggtgtgactagcaaaaccatgcacccacagcccaccattcagtcgcattttagttggataattacgaccaatgaaacatggccaggtgtctcgagcacgcagctcgttctgatgctaaaaaggtctaatacttcaattatcccatcaactgagctagtggtaattaagcatggctaagcatatagttctagctgggtcacataagtaacaagagctagtcgatttatcacccaaggttgacaaaggacaaatatcaagtaaacatggcacaagtgagcagataggtaaacccgattcccatgtaattggcaaaacatgcatatttatttgcaaacagtaaaacatttgtaaagtaggctcaacatgctcaaggggaatgtgtgacttgttttgcttcttcacttggatcttccgaactcttatccttgcgatcgcgatcttccgaaacggcataatctacgtgctggcatgcaaaatgaggaaaaactctaataaaaaccaaggaaacggtacataaagagtaaacaaacatgtggatctcagttttagatgaattttgcaagttgaatggcccaatttggagttcgaatgaattatatatgaattttagaagttttgagccatttaaatggatttctataattattattgatttattacgcaattaatgattatttttcacaaggaaaagggggttgctgacgtcagcaaggggtgaggcgtggaccgcgtccacaaaggggtggacccacacgtcagcggcacaagggcgccggtccaccgtggaccgggaccaccgaggcggtccaccaccggtccacgggaatcgacggcccggatcggcccaagccgatcgggcggccacgggcggcgcaacaaggacacaggcacggcatgaagctggcccgggcgagccatggcacggcagcggcacggccaccggcggcaacagccgacgacgccgaacagtggcgagcggccggaagacggcggcgttcacgggcagcggcaatgcaaacggaagggaaggggagcgggaggaggggctcaccgagcgtgtgggccgacgaggcggagccggaggtggccagcgatgggaagaggcgacggtgctcctcaaggaggcgaagcggacggtgctccggcggccttccgcgagcgggaactggcggacagtggccggaagaacctggagaagaagacaggggatttagggagcgaggaggaggcacgacgccgagggaaatggcggccgaaagcggcaaggatcagcgaagctcaccttggacggaggaaagcggtctcccgtgatgattcgtgaggagggaggggtggacgggcagtgcatggtgactgcggtgccggggaaggcaacgacgcagcgcgaggtcgtcgggaacggcgtcgagaggcggccggaggcggctgctatggtggcggtttgggtggtgtggtaggggctgca

SEQ ID NO: 7736 - DNA, 6328 bp, Oryza sativa
ggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgacgggcggcggagctcgggcgcgcgttgcggcagtgtttcggaggcggagacgggaaaaggagtaggggccagggtgtggcatggcacggcgatgcaaatggtggtggcggcgtggcgcgacggcgtctggagcggcagtggcgtgcggctggaagcacggcggcgagcggcggagctcgggctcgcgcggggagagcgggagaaggcccgatgggctcaggaaagttggggaaacgagcgaggggagtgtggggaggagttttatgggcgcgggagggcgacagtgggctggggcgatgcggattcggggcggcaaccaccggcggtgtggggtggcgacgtgggcgcgtggcggggcaaaccggtgccgttttcttggtggaaaattggtgaaatggtggaagaagtggtgggggtgcagttccaccacttgggcgtgagcgggaagggctgggtggtgcggattttgcgacggagtgggcgacaatggcggccacgggcggttgctggcgaggtggctggaggaacggggaggagatgacaggtggggcctagggtccacctgtcggcgagggaaggagagaggaggccggggggcttatgtgtacttagcgaaggaaaggaaatggcgagtgaagcaaatcgggccgagcggcccaaagaggagaggggagggaggctgccgggctggagggcaaagaaggagggagagggattgggccgagggcggcccaaaaggaaggagagggaattttcttttttttctttttatttaattgtttaaatgaactttgtgactttaaaattatttcttgagctccgaaaattcgtggaaaaatccggagagtactttagggcacagagaatattgcaaaatatttctggccaatgatttttatgggaaaattttaagtctaccattatttcacttgattaaattgctttaacttttatttaatttatagaaaatgatttattaattgatttttaatcccgaacgaaatcgaggtgttacaaatctaccccccttacaggaatcaagtcctaagattcgggtatggttagaaagaaagctgggtgtaggcggtctgatcgatctggccgatctgcacactgcattgatcccttttgttttaaactgactgatggactgaccaaccagcataacttaactgaactgactggcatcgaccattctattcttttgctcaaaacaaccgaactgactgggattcgaccctggagttctattgcttcgcaaaacttaattgattagctctactcgatctgaccctgacctgaatcacgagggctcatggaacttcctgtccctgtactgaactgctagcattatcaccttttggtaacctgagagctcaccaagcagactagaaattggcagatctttcatgaaatcttgtatgtgacctgcatgaatgacagattctaactttactttgacctgctcctgactaccagaactattctaagaggctgcttgaccggtctttcgtctgaactgcaactgtacctgatgttacttctctgatgtgaattgttgtcctggcctcacgggtgtatcttagaattcaatcggatgacttgagatcggcatgactctattgacaccttgtagctggcttcttcgagtactacctaaattgttgtactgggttgaatctttaagggaaatggcgacgaggtgaaccaaaattcatctctgcgacctaccccccttacagagagtagtcatactttcgggtgaccgggaataattgaactattgtccttcaagaacaatcgacacttctcggatttacgaatggccctgacattgaaaacagaaaacttcatcgatcaatcaaaataaagcaatgacgatgcactttcatccaggtcaaggcttggaacttaaccctcagttgctgataggaaattccacataaagaaattctcatttagctcttgatcttactaactcttgactacttcccaatcagttctactgctggcatatttagcatgcttctggcctgacttcggtgtcatatgcttgaacagattgcatagtcgacattctttgaaacacatactgaccacttaacagatcaaactcaagagtccttctcatgacataacatcacacgtcgattattcttttgctgactcttcctgtattgatgaactgtaaaccctgcaactgctttcccaaaaatattgtaatctgcacggctgccagaaactgactttgatgctgtcgagagtttctgttctttgatcataacaacttcgctttcatatcttcggtaaagctgatctgtcgaaaagaggttctctgccacacaccctgctgactacacatttctgaacctgattcttggatatttcttgcccatgtatggaacaatttctgccaacttccgagaaacatcatgaggatttctagaattcgtagtggttccttcgaacatatggagaaccatccatgattcataatcgtaccactagggtgtaattgttgcttaccattctctaacagtttccaagggtagagagttcccaagattccttgtatgatgttacttctgaatttttttttcattactccctacacttgaatacccttgatactacctttagagagatttcatagtgtcgagcgctatggatccaaccattgtcacttccttggttaatcctttctttactcgctcgcaaacaggttttggagcacaacaaaagtgcgatgagttagaagggaaactcttggtttcttgtaacttgcagatacacatgttaacttgcttttgcatactcaaaggtgaaaagaagagaaacgcttgactcctactctattcaatattcccttttcaactatatcactggattggaacttctatgcacaaggaaggtatttgaacaccaaaggcctgtgcacaattgttgactcttgctgacagaactgctgatcagtagcacatttacccattgtgattctgacatggttgacttgtccttttgttggttactagctgaagctcccacaagaacaaaactttgactgatgacgttcctaagacaaacatcaatcctcttggtagctaaaaggaacgagaccttctcactatcggtgcaactcttctgttaatttcttgcgagacctctgaattggagcagtatgagatgcatggctgatgttgacaaccacattgaagtctgatgcttgagacattgattgcagtcgctgctgaagaattgagccgtctctccgtagctaaagtagatcactgatttcctggcttcgtctgctctgctggtgctgattctgtaatcttgaagtgattgctagagaaacaatagagaccttgtcagtgcacttaatgacaattcatcatgatggaaactttacacccaagtgacggttggtagtacttctctttctagggtctttggactggatctgaccacttcatacaggaactgatgtaacttgaggagacaaaggagttttaaccatgttgctgacttgatgagactgacgctttggcgctgaacaacctgttgagagatgataggtcttccaacaattggaaacaatggtggactatctttcttggtctcgagagtagaccattactgaggtggtgtcccggctcaaaacgattgagacacttctcacttgatggatctttgatgtgcactcttcccgctgtgcatgctcccaactgaaaccagagtagagaactcataaccttggtgacaatgttattactatcactgtgggttgccactgcagatggagctaggggaagaacggaactattgctactgctgttactgagtgccataagttgacgaacaggttgcaaagttgtcttttggtctctcattgccttagctagtaccaaactcaattgattatccttgagcacatggtgcattccctcacacaagaatcgtgcatcctttctctgccaaagactggactgcagtgtaccatagtttttgtaagcaagctaacctggacatttcttctctcctgggcacagtgccctattgtcggtcgttttgacaaataagtccaatgggtgattgaacactttgtaagaaactgcccttgtacaccataaccaccgtgggtagcacttgctgcttcagggatcgatggtggcttagctgtgctggtttcctcaggacacgactgtacaccggcaggggttgtaggtgcttccattggacaacaatggcgttgactctgactccgactccgggcttgcacctgagcttgtatctattgttggggacactgtcgttgcatctactgcattggactctgcggtggctgcatcaatctatgacacattgttggtaattcttacggtcacagataaaatccgcaagcgcacggatataccgatgtagcacttcgcctacggagtattccaatggtatcgaatccaaggaaacgtgtgtgatcagatcttcctccggttaatccaaggacaccaagcaaatgataggccaggatatacaggattttctagtgagaaacagtgtctagggaaagcttaactttaatcctaatgcaatacttcaggcactggcaatccgctgttcccagatgtcgctctactatgcacccggacaggaaggacttaagtgatcttgagggttgtcaccacctctacacctacctcaaacagagtgtgggatacgcagccattactatattgaatattatattgaattcagagtaataaacagaggagaagattaccgacaactccggaattcttccgacttcttctactctactctcttcctattctagtatacaatatagtacaatagagcctcttataattcagctcaagcttggaagtgtgtgtgtgtgaagtgagggagtgatgtccttttatagggcagttatgacggttgtgagaaggggaaatgtccgaattgtcccgcaaccattattgggagagcatctggagcgtccacgccaaaccctaggatcaacggtgatcggggcggtttggccgaacctgggctgggccctcctagcctagccttcggtcggtggactccctagactctcctctgtctatttctcggagttttgggttgatttactgatgttttgatgaagttcacaacccttccttgtatggatacataattctcactttagtctagatttcctcccaacatcagggtttatcatctgcatacaaatatacaccaacacttgtggaatatgtgagattaagcacctatcactatgttggatgttttattatctaaactttatgcagatgggatttttataaattttcgcaaacaagctcttttcctcatgttgacttcctctcttgtctctcaaggatgtatattttctttttggatcctcaatcaaggcaaagtgtgccaaaatctaccctattctaaggctgatatgtggagcttggtagggataaattgtgacatacttgcatcatatatatattgtaaagctaaaaatacggactcaagaagatcatcaatcatacttctagatcaagagtctttatttgtggtgaaaaaaaaatggaaaagtaaaatcttttgtggaataatggaaatgattctcccctttttcctatacttcctcctcccttttgttttcttggcatgaatatggaaggggcatggctatattttctttccaactttgctcaatgatttgggagcaagcatttattttcttcttcttttttttatttttttttcatagtcatgcctttcctccccttttttttcatttttctttttgccgagaacttttttaggagaagaaagcatagtctaatgtagaagtttattcgaatggaatttttgtggaaaaccaacttccagtttagaagcttagcttaattatatatgtggagaaatggaaatggaaatgaccccttgatcatgggagtacgaaagatatctcacacgagtcacctaaatttaacaaagctcaatataatgtcaagcagtcatatgcatgataaggttcatcaaagatatacttgcatatggccttggtaggtataaaatgaagtcaattaggaggattgtgctttttaaaatgattttattttgtgaaaaataatttcccaagagtcataacaa

SEQ ID NO: 7737 - DNA, 11329 bp, Oryza sativa
ggccgctctatacgtagaggatcccccctccgaatgcgcatcacaacatactatagacaagcgggggagactgaggttcaaaattggggctgatcgggcgcctgtcacaccctgaaaatcgctaagttataaatcgttgtgaaaaaaggaatttttagaaattatttaataattaaagtaattgtgtgaataaaatctatgaaatttttgaaagttaaattgatatagataaaattttattaaatactttgtgtgcccaagtattttcaggatttttcttggatttatttgagcattggaagtatttttaataaatgaaagatcatttcagtaattatttaaattaaaaagttgattaaaatttctcttctgtccactcctctcctgtctctcttccttagcccgcagcagcccactcttcctttttgtcttacttagataaagtccattttgggtccctcttgcaatcaggcctagtaaagaaaaggaagcccgaaaagaagtctatttgacagagccagttcatcccgataccgcgccaatctccaccgaatccgtcgcatcccgtgctctgtttccaaaattggttgcaaaaacggattcccctcgatctcctctaccttgtccctaagaaacccctttgaataccgttgtatatcgcgtgaattcgatgcggttttgagctccgtttttccggcgaaccctaactaatccgtcgccgattcttcccgtaaccgagccgatctctccctcttccggctataaatagcagtcccaagacctcctcttccgtttgctcctttttcccgaatttttccctaaccctagagccgccgccacgctcggctttgctctcctatgctggccgccgctccagccacgtcgcgccgcctcctcggtcgaccccgacctgcgccgtcgcctcccttggcttcgcaagggtgagagctacctcggccactggttgttttgcgccaaatcccaccagaaggttgccgtcgccgtgaaccagtgggttattgccgtggtttggtctccagccgtgtcgttcgtcgtcgtccatcgtcgctttcggacgccgttgcttccactggattcgcagctgtgaggagaagcccgtccacccctccgttgccgccgcttgtcgccggaaagccgtcgccatcgtcaaccaaggtcgccgccctttggagctcatcgccggccatctccctcgccgtctgtcgtcgcgtaagtggtggtaagggccgtgcttagaaatattagctcattaatgggataaattatgcttcactattacttatggttctattaaatggtagctcacgatgggcaatcgtgttatgataattaattgataattaaaatatgattaatggtgggttgtgagcacatggttttgaaggttgtgctcataacaattaaggaccggttcgcgagctactgttgtgaaacattaaccgtgccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattgttttacaattcttaaatgtttgctaaatgctgcttttgcaaatgagccatatattatgccattgtttggtatccttgtacacttgcatatttgttgtgcggcttgcggagtattccatgtactcaccttgcaataatcaatcaaacctcggttgaagacaagttgcgaaggagaagacgtttggcttataccctagttgagctgcctgtgggagtggagccggagcttcgctagaccgtaattccgctgttgttttctcttttcttttgtaagtatgtaacattattattatgatgaatctgtatattaaattgtcagtttgtgtacctcggctgattcctggacgaggatttcatgcacaaattagttcggaaattactagtgaatttctgggcacgaagattctattgtctacaacgaacaagatcgcataagttaaaaatgcatcggcttgtagttgataaaattaacagaaggtgagaattttaccagtgggacatcgtcagggaaaaggtttgtcaaatacatggacggtgattgatggaacaggtgttttttccattctatccaccatcggtcaaaggccatgctcctgaatgtccttagtttgatgttgtcaatattgccaagaggtggtcctggtagattcagcagccaatccatcatatggaatgatgaaatctctcctctactttgaatcctgtcggcaaagaataggctaattggcagttgacccatgccgaattgccttgcagcgcttgttggatgatagaattcgtaggtcatctggatattcttatcttgatagatgccaacagggatgatacaggggctgatagctgttgagaatacttctctggatttatcatatttttcagagttgatttcatcgaatcgaaaatcacatgttagttcaaagctagcagatccttcatatgcaaaccagatcctatcattcttggggaacccatcatagaaattgttgaaccactccttgaaaggttcggtcgatagcttggacacggcgctaaccgatgctgcttctccgaaggacatacatcatcagcatgtggtgcttgtttctccatcgtccctgacgatcggctcaaatcttgggaattctacattggctagtgctggctgattggcaacttttctggtatgaagattcagccaaatttggagtaaccacgatggaccccctgtgccgattgtttttccagaggctatcttgtcaattgcagtattgagggtctgatacaagtagcccagcagatacttgccaaggggaaaatgcttcttttctaccagattttcatctacccgttaccagtttgcggtcggaccataggttggaccacagaataagaacttttccagccacatcataagaaaagctgtgttcatggcaaccggcccagtcacatcactcttggggtaaccggcctagttcccatcttcttggcaacataacctgaccaaccacctatgcttctggttttgaactcatgggtaagttaggtgttcaggctggacaagttagctgatgaagtgatatctagaccagtgatcatgatgatatctaatagtattggggtcatcggtccttgagagaaaaggaacgtgttcatggctgtggaccaaaaataggtggatgctatcatcatgggttcattccttgccatacttgctgcagttaaggccaaagcttgcgatatgtcgatttcgtcccagtgggctaatttgctagccaacatcctgttgtaccaggcaagccagctgacttcggttgatggccaggatttgaaggtgcctttccaagggctaagatctggattggcaaatctaaaggggattcggttggtttctccattgatgaactctatggggtctaagttgccgattgggccaaggaaaaactggaattcatcggctacgctaggaattgcaacctggtgggtgagatgctacagaggaggaaaatcgaggattgagcgaaagaagaaccaaatctatgaggaaaagaagggatttagctgatgggtacttacttcgacgtattcggtggccgatgagctcggtggactagcgaaggttgacattgtcgttggcagagattggaatcgtcggaatcgtctgcggatcgccagaaagcttgaagggtgtcgccggagaactcaaaggagaatattggggaaagtttttggctagagcggttaaaacggaagtgacgccgtgaaacgagaagagcggtggttactatttaaaagggagcgctgtaacggccaaaacggaatcggtttttgaaaccctagatcggctcggaaaagaaatttgagaaaatccgccacattacaaataattacaaatatagcggacttggggggcatgtgttgacgaccaaatttggtaagatatgaaccaggttcgacattggaatcgaggcggattcggtaaagagatagattcgaagaacagagtatgcatcggctgcaaaggcatcggctggagtctgcatcggctaagatggatcggacagaggacatccgatacagctgatagaggtgatgtagccgattctgatgacgatggtttcaaggatttttctagaaacgatcaaagtgcttcacgaggattgccacgatagagataaagctcttggataggaaattgtatctattaattaggatatttcatgtaatttccttagagatatgttggggcaaaagtctgccgcaaagacttatggtattttagagtttgttagagataagtgtcgtgtccggcggggacatattttgtaatctcgggtataaatagaacccgaacccatgtaatcaattatcagacgatcaatacactttcggtgcatcgccaccctttttacttttgttctatttcgacgagttcttactttcgggttgagcttcatcgattcgatcttcaactagaggtaaacttgtcatgacggcttgcgttatcaggattagtgcttccatctttatgacactctaatcctgttcatgtaattcatcgagttatcataaatataatctttgtgagcgtgcgggccgacgaggcggagccggaggtggctggcgatgggtagaggcggcggcgctcctcgaggaggcgaagcggatggcgctccggcggccttccgcgagcgggaactcgcggacagcggccggaagaacctggagaagaagacagggagtttagggagcaaagaacaggcacggcgccgagggaaatgttagccggaagcggcaaggatcggcgaagctcaccttggacggagggaagcggtctctcacgatgattcgcgaggagggagggctggacgggctacgcacgatgactgcggtgccgaggaaggcgacgacacagcgcgaggtggtcgggaacggcgtcgagaggcgactagaggtggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgtcgggcggcggagctcgggcgcgcgctgcggcggtgtttcggaggcggagagggtaaaaggagtaggggccggggtgcggcacggcacggcgatgccaatggtggtggcggcacagcgtggcggcgtgcggctagaagcatggcggcgagcggcggagctcgggctcgcgtgggaagtgcgggagaaggcacgacgggctcgggaaagttggggaaatgagcgaggggagtgcgggaaggagttttatgggtgcgggacagcgggagggggccggggcgatgcggattcggggcagcaaccaccggcggcgtggggtggtgacgtgggcacgtggcggggcaaaccagcgcagttttcttgggggaaaattggggaaatggtggaggaggtgggggggtgcagttccaccacttgggcttgagcaggaagggctgggtggtgcggattttgcgacggagtgggcagcaatggcggccacgggcggttactggcgaggtggctggaggaagggggaggagctgacaggtggggcctcgggtccacctgtaggcgagggaaggagagaggaggtcggggggcttatgtggacttagggagagagggggagcgagcgggccgagcggcccaaagaggagaggggtgggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaactaccggatgtgctctttctatccactttgcaaccggcataatccgaatcggaatagccaactagcttaaacttagtacctttttgctaccacaagccaatagttgaggaatgctttaaatatgttagaatccttttcatggccactaagtgacactcgttaggagcggcttgaaaccgtgcacacatgtaaacactaaacatgatatccggcctagatgcggtaaggtaaagcaagctaccaatcatagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttaacttgagcttttcttggcatagcggaagtagataactcatcttgagtggaggtaaatggcttgttttccacttcaattcgcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatatcctagaagaaacccttttcatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtcagaccatgctactctacaacggctagttttctagccgttgtaggctgtcattgggccccatcggcttggccggacagactggagttgggtggccggtcagactggcctcggctcggtcagaccgcccccagctcggtctgactgaatgcggctctagatcgccacgccgagagcaccacagggagaggtccccttggctggtctgaccggcattcacccgtcggtcaaatcggccgacctacgccggtcagaccaccactaggcggccggtcagaccggccttggtcacacagcaagcacaacaggaaaatgagacaaagccaaatctaaatgcataataatctaatgtggcaatttaaatcatctctttgctaggtcattacccctcttaatagtacagtaaagctataaataaactagcacaaattgattgaccaacacctcgatcgatttagaactcaactactagtttaccgtcatctatactttgctttgcgccatcaatttttagtccatcgataattatccatgcgcacacatgatgtgaacctaactcaaaacacataactcgatagaacggttagtccacaattagcgcttgtcattaattaccaaaactaacaacgggggcctagatgcttcaaagatcatgcacgatactaaaaggctagagaacaatggacgtggtgataaagaatctatatagtatactgttggcggatgttaaatgctgattctataccgccaacatctgcataaagtttagataataaaacatccaacatagtgataggtgcttaatctcacatattccacaagtgttggtgtgtacagttgtatgcagaagataaaccctgaagttgggaggcaaatcagactaaagtgaggaaaattatgtatccatacaaggaggggttgttaacttcatccaaacatcagtaaatcaacccaaaaactccgagaaatggatagaggaaggtccatggagtccaccgaccgaaggctaggccaggagggcccagcccaggttcggccgaacccccttgatcctggggtttggcgtggacgctctagatgttctcttgcagttaagggagttcttttgatgtgaactttgtttagcaagcatggtggaataaactcattcatagcacaacaataataatatcataaagaatatcacagagttccacaaatagcacataaatcatgatgcaatcgactgcataagtacgcagcccaaatagagttcatccaaaagctacatcgagctaatcatcaaactactcgtcaatctaggtggggggtgtgtctcgcgctatccaaaaaccatatgaagcgagagcgaagtcgcagtagacctccattctagtcgtccaaccatccgcaggatccttgcgcgggaagagggtatcgcatgctcatgcaaatctgagtccccacggctcagaggtggtggcctccggatctggcttgggcttcttgcccggggtcgtgtactcttgcgggcagtgctgagggtgcgagggcgtccaactcacagttgcggggcagttcggacatttccccttctcacaaccgtcataactgccctataaaaggacctcacttcattcactctcacacacacttccaagattgagctgaattataagaggctctattgtactatattgtatactagaataggaagagagtatagtagaagaagtcggaagaattccggagttatcggtaatcttctcctctgtttattactctgaattcaatataatattatcttgtgagaattatctcttggttagttcctaaatagcatacgg

SEQ ID NO: 7738 - DNA, 1107 bp, Oryza sativa
aaaaatcgtgttttggtgttttttgaactttttgattccggtcaaaaacaacgctccttcgtgtgccaatatttgcattaattgacaaaagttcaccgcgcgaatcacgaagtgagtttttgccacgaacggaccttttacgctccaatatgtccaaaaatcttgttttggtgctttttgaactttttcattcctatcaaaaaacatcgcaccctcgtgtgccaatgttgcaattaattgacaaaagttcgccgcgcgaatcacgaagtgagtttttgccacgaacgcacgcaacatactccaatatgtccaaaaatcatgttttggcattttttgagctttttgattccggtcaaaaacatcgcaccctcgtgtgccaatattcgcattaattgaaaaaagttcgccgtgtgaatcacgatgtgagtttttgccacgaacgcacccaatacactccaatatgtccaaaaatcatgttttggcgttttttgaactttttgattccggtcaaaaacatcacaccctcgcgtgccaacattggcattaattgacaaaagttcgccgtgtgaatcacgatgtgagtttttgccacgaacgcacccaatacactccaatatgtccaaaaatcatgttttggcattttttgagcttttttattccggtcaaaaaacaccgcaccctcgtgtgccattgttgccattaattgacaaaagttcgccgcgcgaattacgaattgagtttttgccacgaacgcacgcaacatactccaatatgtccaaaaatcatgttttggcattttttgaacttttcaaaagttcgccgcgcaaatcacgaagtgagtttttgccacgtacgcacccaatacactccaatatgtccaaaaatcatgttttggcgttttttgaactttttgattccggtcaaaaacatcataccctcgtgtgccaatattggcattaatttacgaaagttcactgagtgaatcacgaagtgagtttttgccacgaacgcacccaatacactccaatatgtccaaaaatcatgttttcggcgttttttgaactttttgattccggtcaaaaacaacgctccttcgtgtgccaatat

SEQ ID NO: 7739 - DNA, 2286 bp, Oryza sativa
tagacagtgaaacgcttaccgaggtgggggcatagtaagcaccggagcagttaccaacctctacttcaatcgctggaaactatgctcacattggtccgtccattgaaacttacacatccttatgtgcgacatcgtcattggtttagcgataattgagaaatccttcacgaagcgtcgttagtaccctgccatacccaaaaagctcctcacatccttaacattagtcggcctttcctacccgacaacacttgaaactttgctagtatcaactgatataccctgctgatcgattacatgccctatgaaagtcacttcacgaagtcaaaattcacacttctttaatttagcatagaacttgttttcctgtaaactccctacaccatcctcaaatgacactcatgctcctctacatctttcgagtaaatcagaatatcatcaataaacaccaccacaaacttatctagaaagctatgcaacatgctattcatcgcctccataaaataggccagagcattggtcaccccaaaagacataactctacactcataatgcccatacctcgtggaaaatgcggtcttctcaatatcctcttctcgcactcgaatttggttataaccagattgcaagtcaattttagaaaacaccttttactccctttaacttatcaaacaaatcttcaatatgaggcaatgggtacttgttcttgattgtcgcagcatttaaggcccgattgtccacacacatacgacaactcccatccttcttctcagtaaaaataacaggtgcaccccatggcgacacactccgtcggattaacttcttggataatagatcatctaactgttttttttcaactcttcttggaaaggacgagctaaccggtacggggctctagagatcggtcgtgtaccaggaacaagatcaatacagaactctacatcacgctcaggtggcatccctggaaattctacgggaaaaatattgggataaacttcgttcggactccgattattataaactcatagtctatttttcactactcagcgagttctacgcatccacggttcctgatcgcctattcgaacaatggtttaaaaattaaacttttgcacgtttgtgctaatattccccgaaatatactattttgaaactcggggcattacagatacacctctcagagggttgttgatcttgccggtgcagatcaaccctattcctacaagcaaatcgaagaaacaagtaagaacaagataaaagcaatatgatattgcaaataggaatgaatacacacgataagttggggttttgaatacaagcagacggacggtctagctgacacgcacgctgtaaggaagtagcaatggctaaactttcatctaaacaaaacccaagaaaccctaaaggggtacctagctatttataggggtgggaagatgaccaacggggccgtagggtcgttctccaccaagttggggtgcaccccacatgggccccacttgggccgggatcccaaataaagttacaagcccataggcccattataggtgacgcaatgccttgtgcgtgtgagtccggacacacgagatggaattcggagatgaggctggatccgttggaaagagggctccgagagctttccatcaagtactcacggtccaaaacggaggtcgtatgcagattcggcggccgtttgaagtcagcagtgtagcaggtggccgaatcggattccggcacttggaggactcgaacttgatatcttgttgttcatccatgatgtgagcaacggatgtatccgtagtagccatggtcacatcatcgtccccttcttcacagaaaaccgtcctcggtttttccatatggtgttcttcacatagtccattcaaaataacctgtttcatccaatcaaaactagagaaactcgaagtagtgtgattggcaataacatgtttctctaaatctaaacaaatgaaaactctatgcaccaaatatattcctctatcattatatttgccaaagatatgaaaaatagcagtagttggacatggaaaatcagacttagcaaataatttctccttcaaattatcgagctcacaaaaatcatcaaactgaacatagccaaagtatttaaagaagatagcaatttacgttcctcaacttcattagcaatgtgaacagcatgcttaatatcaacacacaaacaaacactagaaatagcatgttcattcactagttgtggcatgaatataagtgaagcattatcacacaactcttctttatcacaaggaa

SEQ ID NO: 7740 - DNA, 3937 bp, Oryza sativa
tacagatacaaccattgctcacatcatgaaagaacaagatgatatcaagatcgaatcctccaagtgatggaatcagattcggccacctgctacactgctgacttcaaacggcagcagaatctgcatacgtcttccgttttcggcccatgagtacttgatggaaagccctcggagtcctctttccaacggatccagcctcatcgccaaacttcgtctgggaccccggcccaagtggggcccatgtggggtgcgccccaaccaggtggatcatgaccctagggtccctttggtcatcctcccacctccttaaatagctagctaccccttcagggtttctcgggttttgttagattaaagtttagccattactacttgcttgcagcacgcgtgtcggctagaccgtccgtctgcttgttcttcggaaccccaacttatcatttgtattaaattcctatttgcaatatcagattgtttttatcttgttcttgcttgtttcttcgatttgcttgcaggaatagtgttgatttgcaccggcaagatcaacaacccatggagaggtgtatcgatcgctaaggcgtaacacaacaacgtcttatacgtttgtagtcgggtcgtcaatgtttctcccaaatcgtagttgtctcaactcactgaaagatcgggccaaacaacaaccttgagtgtcgagtggaactcagggttcatcaggtggtatcagagctttcgttgctcggtgagtttttatctagctataacctgaaaattttcctacaaaaaaaattgcatcctgtacctagccatctttgtgccattgtattgttcttttcagtttttgcgttgttgaattttgtgttgcatcgtcacgtcgtgttgctggtcttagcgtctagttcgtttagagtttcgaattctagtcacgttttgtaccactgtcgtcgcagccgctgtgtcttggttgtcatcgggacctacgaaattggaatcgtctttccgccagagttccatatttgtagttttcagaagtttctgtcggttagttttgaagttgcgtctagggtatgctgtttagacgggcttgtgtttgtgccgtggttatgttttgccgtgaggaagaaaaaatgggaaaggaatatagcatatctgtttggattcggttcggtggaaggaaaggaaaataataatacattggatcggcaaatcagtttctgatttatctcattcatttaatctggccggccgatccatccacccactgtacccgcacctccccaccatctacagttgtttcccccaataccgtgagtagctcaacaccatggtgaaaatttttcaagtgtcggattggaaatccgtttgaaacaacggaacctatgagggacgagagcattccatttttgtatagttctaattttgggattgaacttttacacttgagtccctgtaatttttagattcgcatttgagtccctgtaatcttgcattgaggtccttgagtttgtttttttaaaaaaaataaaaaaaaggcagaaaggtgcataaaaaaagcaaagaaaagcagcaccaaaaaagaaaagaaaagaaaaagaaaagaaagaaaaaaaagaaagaagaaagaaagaaaagagaaaatattgttatctttgagctgaacttcatatatcagagtgtgcttgagttgtttctagtgctatcctgtggtatcgtttgtgtttaggctcgcgtctctagtacgttctagcctaggaccagcacggtacttgactttgaacgattattcaactttgcattctctgatttgagcatttgctattcctttgctacatatttaagcctacccagagctccacagatttgattacagccgtacaacaagtgtttgccaaggcattcatacatccaaacttcgttgtggtgcttggttgagtcggtgtacatcaccattccgcttgctttggtaagaacttgtaagagcttggttaaaagcttgagtgtgtgtgatatttgagctaccactacctagtagttgataggaacgtgcatattcttgtgtgtgtttcttgtttgctactaaccatggcaggattgcgcaagggaatacgagaacatcaacttctacaccttcgatgagatatgacgacttctccacgtgatgcatatgaggtacatgactataattttgcacaagttgcatcaaagttaccattctatgatgggaagtatgattttgttgcatatattgattaggagctagcagtagacaatgaatttgatatatatgatttttctgatgctcaaatgattaaggctgctagtaataagtttacctcttctgcattattttggtggagttatgtttgtaacaaacctgaaactttggatgaattcaaaaccataatgagaaaatgctttgtgagttcttattacaaatgtactcttcgggagaaattagaacatctgaaataaggcgatagaactgttaaggactacattcatgaatttaaggtctgtatcatctacagtgatctcaaagagtgcaatgaaaatacaatgcgtagatttttcaatgggcttaattctaaaattcaggttttgtttgataatgtgacatataatcatattgggcacctattcatgcttgctcgtagcattgagagttagatcatatcaaatgcgaggaagcatgaacaatgtgatttatctcccatttctgaatctcctatatccttatgcaatgatgatgtgcaaacattggaggagcaatcttttgtctctcctgttactaacgttttgcagggagttcagaacattcaacaaaaggaggagaatggtgtacttgataagaaagaggatgaagcacctgcggtttcggaagaaagtttgcaaggtaaattaaattgtgctgagataaatgaatgtgagtattctcaagctgagctacacgtgtccacttttcatgctatagtagagcaaccattggtggaaccaattgttgagatgcctttgtcacaagttgatttacttgttgttccttgtgataaagaagagttgtgtgataatgcttcacttatatccatgccacaactagtgaatgaacatgctatttctagtgtttctttgtgtgctgattttaagcatgttgttcacattgcaaatgaagtagaggaacatgaatttctatcttatttaaatactttgggctatgtttggtttgatgatttttgtgagctcgaaaatttgaaggagaaattatttgctaaatttgatttgccatgtccaactaatgctatttctcatatctttggcgaatataatgatagaggaatatatttggtgcatagagtttacatatgttcggatttagaaccttctgtacatgtggataaaacatgcaagctagagagaaatgttattgctaacaaaattatctcgagtttgtcttgttttgattggaagaaacaggttgttttaaatagactacgcgaggagcaccatatggaaaaaccgatgacgattttccatgaagaaggggaggatgatgtgaccatggctactacagatacaaccattgctcacatcatgaaagaacaagatgatatcaaagatcaagtcctccaagtgctggaatcagattcggcttacatgtgtgtgaaccctcgtccaggaatcagccgaggcacacaataaaaaattgataatagagtacaattattactctaattaataagcgaataaaatgtcattacagaggtagatagttactctcaatcaataaagatataagcagcggaaaaaaaataagataaacgggcagacgactccactccacaggcagcttgaccagggctacacctaatcctccacaccatcagcatcactgtagaactcctcctctgatgaatgattgcaaggtgagtatatgacatactcaggaagccac

SEQ ID NO: 7741 - DNA, 1033 bp, Oryza sativa
atgaaaccctactatgccatcctttgctatcctgtgcacttgcatatttgctgcgtggcttgctgagtatgtcatatactcacctagcaatcattcatcagaggaggagttctacagtgatgctgatggtgtggatgattaggcgtagccctggtcaagctgcctgtggagaggagtcgcctgcgctgtatcttatttttccgctgcttagatctttattgattgagaggaactatctacctctgtaatgacattttattcgcttattaattagagtaataattgtactctattatcaatatgttattgtgtgcctcggctgattcctggacgagggttcacacacatgtaagcgtttggaattttggatagaaattccgggcgtgacactacaccgatcttgaggttgcccaaaagatgcttagggctctaccggagaagtatgagacccttgtcaccatgctcatcaactccgacatgtcaaggatgacacccgcaagcctcttggggaaaatcaacaccaatgacatgtacaagttgaagaagaaggagatggaggaagcctcaccttccaagccgaagttgaagataagggcaagggcaaagtgaatgaagtcaatgaggacttggaggaagagattgctcttcttgctagaaggttcaataatctcttgggaaggagaaaggagagaggaaggggctccaactcaaataggagaagaaacagaagacccaacaagatagaggagaactagtgatgcttgcaatacatatatctattagaataataatattccactagtattaggtatactaatcttttgcagagaatgacaataaagtggaggagaatcaacatcaactccgacgataaatcaatcggatggtgtcgagaactagacttatgtatgaatgggccaagaactcagaaataacacgacacattgggccaaaattcacaagtctacgaagaaggacaacaaaggaggccgccagccgaagatgggctgggttgggccagcccatggttcgg

SEQ ID NO: 7742 - DNA, 649 bp, Oryza sativa
gcagccctacaacagcaaattaatttaattaaatttaacatagaatatattttgataatatgtttgttttgtagtgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccagataagattacgcactttcatttactattattagccaataaatccatacacaccttacgatcatttgcttgatcagcatgtccatcttgtgaaaaatatgccaaaatcaagttccccagaaaggccccaatatcgtaacccattagaccatagaaagcaaattctggatcaatcacttgagtagaatctggtgtcaccatgatggaactagtgtggagatctccatgaagaaaagcttatactctctcaataaacctgcatatgcaaatcatgtccatcatc

SEQ ID NO: 7743 - DNA, 689 bp, Oryza sativa
ctgcagccctgtgtgagcatcgatggctttgaggatgtacctcaaaatgatgagaaatcacttcagaaggcggttgctcaccaaccagtcagtgttgctattgaggctggtggccgcgagttccagctctatcattcggtaaatgaacttgcagatatcaccccatgcatataggaggttttggtcgtaacaactattgatttttacattacagggcgtcttcagcggtaggtgtggcacaagccttgaccatggtgtggttgccgtcggttatggcactgacaatggcaaagactactggattgtccgcaactcttggggcccgaagtggggtgagtctggatacgttcgcatggagcgcaatatcaatgtgaccacggggaagtgtggcattgccatgatggcatcataccctaccaagagcggagcaaacccacccaagccatctccgactcctccaactcctccaacaccacctcccccatccgcccctgaccatgtctgcgatgataacttctcttgcccagcgggcagcacctgctgctgcgcattcggcttcaggaatctctgcttggtttggggctgttgcccagttgaaggtgcaacctgctgcaaggatcatgccagctgctgcccgcctgactaccctgtctgcaacacccgggctggaacctgctcagcggtaatct

SEQ ID NO: 7744 - DNA, 717 bp, Oryza sativa
acaactagtacatctgatcagtgaatttcagaacactgattacttgtaaggatccaatggaaggatgcaagaatgttcgtgtttgcatccttccctcttattgcgatgtgatatcagattgttgtcagcaatgcgtcaggctgagatttgcggcacaaattggtaggccgttttccgtttattgaccaacagttacaaagtttggaatcatgcgatctgaacgacaaaacgctgacaaagttggtgatcgctgatcagttcagttgccaccacctccgccgccgccgccttcttcagctgccacagccgaaggcaacgccgccgccggcggcctgaagcccggcaggtcgcaggggatgtgcggcacgaaggggcagtgctgcggcgggtcggcgtagaagcgggcgcactcgagcgccggccgctggtgggggaagttggggatgcagttgaggcgcacgtcgagcaccttgctccggacgagctcgaggcaatggcggcggccgacggagtggaagtagttgtcggagagggagaggttctgcagcttcccggtcttggccagcgcgcaagcacgtcggggatgtggccgtacagctggttcccggcgaggttgagctcctcgacgagccccaggcagccgagggagagcgggatgggtccggtgatgtcgttgccgccggcgtcgaacacggtgagcccctcccccaatccgat

SEQ ID NO: 7745 - DNA, 3163 bp, Oryza sativa
ctgcagcccaaagtgttcatggaatacctggataagtttgttgtggttgtcattaacgacattctggtgtactcacaatcagaggaagaccatcagcaccatctccgtctggtgttgggaaagttgcgggaacatcaattgtatgccaaacttagcaagtgtgagttttggttgtccgaagtcaaattcttagggcacgtgatatctgctaaaggagtcgctgtggaccccgaaacagtgaccgccgtcattgattggaagcaacccaagacagtcactcaaattcgcagcttcttgggtttggcaggatactaccggaggttcatcgagaacttctccaaaatcgctcgacccatgacacagttgttgaagaaagaagagaaatttgtgtggagcccgcaatgcgagaaggcattccaaactctcaaggaaaggttggtttcctcgccagttttagtctgaccggatactcgcaaggacttcatggtgtactgtgacgcttcgcgccaaggattggggtgcgtgctcatgcaggaaggtcatgtggtggcctatgcctcaaggcagctacggcctcatgaaggcaactaccctacccatgatttggagttagccgcggtagttcatgctctaaaaatctggcggcactatctcattgggaatcgctgtgaaatatatactgatcataagagtttgaaatacatcttcacccagtcggatctgaatcttcggtagaggagatggttagaactcatcaaggattatgatgtgggaattcactatcatcctggtaaggccaacgtggtcgccgacgctctaagtcgaaaaagccattgcaacactcttgacgtccgtggcattccacccgaacttaatcaacagatggaagccttgaacctaagcatagttggtcgtggattcttggctacgctggaagccaagcccaccttgctcgatcaaatccgcgaggctcagaagaatgatccggatatgcatggactcctcaagaatatgaaacagggtaaagccgctggtttcacagaggatgaacacggaaccctatggaacggaaatcggatatgcgttccagacgacagggaacttaaacagctgatacttcaggaagctcacgaaagtccttattccattcaccctggcagtacgaagatgtacttagacttgaaagggaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggcggatatgattctatatgggtagttgtggaccgactaaccaaggtagctcggtttattcctgtgaagaccacctatggagggaacaaactagccgagctctacttcgctagaatcgtgagtctccatggcgttcctaagaaaattgtatctgataggggaagccaattcacctctcacttttggaagaagctccaagaagagctgggtaccagattaaatttcagcaccgcgtatcacccgcagacagatggacagaccgagcgtctaaatcagatcctagaagatatgcttcgctcatgtgtcctagatttcgggaagacctgggataagagtctcccctatgccgagttctcctacaataacagctaccaagccagcttataaatggcaccctatgaagcgttgtatggacgcaaatgccggacaccgctattgtgggaccaagttggggaaagccaagtgttcgggactgatatcctgagagaggctgaagctaaagtcagaaccattcgggataatctaaaggtggcacagtcccggcagaagagttatgcagataaccgacgccgtaacctggaattcgcagtggacgattttgtgtaccttcgggtcacgccattgcgaggtgtacacatgtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggagaggcccgtgaaaatcctggacaccatggagcgcaggaccaggaactgggtaatccgtttttgcaaggtccaatggagcaaccacgccgaggaagaagctacatgggagcgtgaagacgagctgaaggcagcccatcccaatctcttcggcagttcttccgaatctcggggtcgagattccgtttaagaggggtaggtttgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagaacacaaataataattattaagaaataaacaaagttaaaatgattttataaaaagaaaaactctaaaaagtcccctttcctccctctccctcttgggccggctcggcccatctccttccccctccctctcctctccccgcggcccatccggcctctccccgcgcgcgcgccgctgacgggcgggcccgcccgccaccctcgctgacgggtggggcccacccatcatccccttcctcccgccgcctcgcccgcgccctagcgccgcggccgccgcgaatcccgccgtccccgtcctccccgcgtgcaatcaataggggggaattattccccgtgattccctctcccttgccccccatttttccctctctccctcgcattcaaacgggcggatttgcccccgcaaatctcgccggcgccattgatggcggccggacctcccgcacctattccttccccgccggccgctctctcccccttccaaccctatataaaccctccctgcacctcctacctccgtttccgcctctcgccgcccttcctcctcgccggaatcgagctcgc

SEQ ID NO: 7746 - DNA, 4239 bp, Oryza sativa
ccgctctagtagtagaggatccccccgtcgctctcgctctccgccgtcgccgccgagctccgggccgccgtcgtcgtcgcccttgaccacctcccacctcggcgccgcctcggtcggcttcgccgcatcctcgccgacctcgtccacccctccgtttcgctcgtcgaccgccggagcgccgccgtccccgtcgacccgaaccgcgccgccgccttcctccgctccggccgccttttcgtcgtcgccgtcgacctagggtgagccgtggaccgccgcctcatttccccctttccctcccttctctcggccgccgctccgccatgcctatggccgccgccggcgaccataggggcgcggacgcgccgcctcccgctggccgtgccgccgtggccgccttcgggcgcaccgagctgctgccgcgtggggcccggccgtcagccgctcgcgccctcgggtgcggctgacgcgtggggcccacggcgccggccggtgtgagcccgggtgcacccggtccaccgtggaccgtgaggctgccgcgtgggccccactcccgtggacccggtccgcgtgccccctcccctcggctgacgcaataaacccttttaaaattaaaatttaaatgaagaaattcgcaaatattcatttaaagagcatataaacttcaaatggtcataacttggccatttgaactcggaattggaccgttcaagtctctaatttttccttaagaagtcaagaacccatttttgtgctttgttcctacttgttatatggagtttattagagtaaaagccttttcttttccattgatcgtgtagacgctgcagcttcgaaagatccgctcttcgtggaagttgaagccgacggttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgaatttaggtagatgcttcgctggttaattaggcaacattaggtggttttacaactctacactttgggaatattctcatcacctggacactatggaattgttggatcattgtggaattggattcacacctccccctctattcaaaaccctcaaaatggttttaggctgggctcggggtgcatggttttgatagtagcacctcggccatataaggaccggtcttcgggcctctgttgcaaagcgctaccgtacttccacatgtctagtgggtaaggtttagtttgtggctcagtctggttataaacaaaagtacacggatggagatggacgaagtcgggggtcgatggacatctctaggacaaatgaaggctacacgagctacggcctggtagccaagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaacctaaccctttatattacaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgcggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggtcaattccggtcgtgacagacagggcggtgaggagcgagcgagcgagcggcgacagtggcacccaggcgttctcaccggcccgtgctccttccacacgtagtcaactcctccttcctccgccccatggtcctcactgcgactcgcccgccgccctatcttccctcccttcccccacgtcaccgccttccgccgcccggcgaggcctatcctcctccctccgtcgtcactgccccgtcctcctcctcccgttgtcaccgccggccgcctccgccgccgcccgaccggctctcccgatgctctcctccctctctctctctctctccacagttacattttgggtacaaaaatctccaaagtggtatttcattcggtaggcaatatattgagtggcattttatccggtgcattgtattgagtagcatttcatccgaacccagtttagggagtggcataacgtccgttttctcggcaaattgtagcctcgatttgaaaaaaaaggcaaaatcatgaaccctaaaaaaaagtaaaattgtaattacaattgaaagtaaggttaagaatgcaattgctccttaatttttagttatttgtttgatataatataataatctagtattgaatgacctatcttaataatacgacctataatgcgctatgttgttatatttttaattgaaggagtataacaaatggacagtgaaaggtatacgtgaaggaaagcaataagccaataaataaaaaaattgtacatcgtaagtttaggatcgaataagaccaaaaaaaacctaccagatttgggggggggggttgaatggtaggataaaccaaaaacctaaaatcttttgcggaataaaagatttacctcgaatggagtagatgacgaagctcgtcgccaccggtcaaaacacccacctgccgccggtcaaaccaccgaaaccttgccggtcagaccgcccaaacacctgcggtcagactgctacactcccacctgtcaaaccgcgcgcacactgcagctagaccgtcgggacctagaaaacaccggtagataataaactcaaagatgtacattgaaacttttaactttgttgcatcaactagtatttacaaagtgcatcaacagcagccctcacaaaatctcgaactaaactcgaaaccctaacttttctctcaactcaagtctctctaaaaccgataccaggaggccacaccctccccctctatttatacatgaggtaggctgtgcaaagcccacgaatctaacacaacttagaactcctaaccatgtaggaaacactctcttgcaagtatccaacttattcctttccttatctctattaatcttcccgaattcggatcctaaatttgactcctctttccatacgtacacaatccctcttgtatatgttggtatttaatacggttacagataaaatccacaagcgcacggatataccgatgtagcacttcccctacgaagtattccaagggtatcgaatcctagggaacgtgtgtggtcagatcttcctccggtttatccaaggacaccaagcaaatgataggccaagatagagaggatttactagtgagaaacagtgcctagggaaagcttaactttaatcctatcacaatatttcaggcactggcaacccgctgttcccagatgtcgttctactacgtacccggattgggaggatttaagtgatctcgagggctgtcaccacctctacacctacttcaaacgtactgtgggatacgcagcaatcactggataataattacctaaacaccacgtctaagcagttagaatctactttagtgtttataactgggctgcagga

SEQ ID NO: 7747 - DNA, 4750 bp, Oryza sativa
cagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaacctaaccctttatattacaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttcttgtttgtctttgtgtgtgctgggccttcgccgcccatgtaataaattaactatttacgcttccgcttgataaactctgaaatgtatcaacttttggtgtaccttgcctcctgggataaggaataatacacgcacgtaaggaacgcccgttgggtcaattccggtcgtgacaagttggtatcagagcccccttgaccctaggacgagccgtagatcccaagccttagcaatattttcaaaataaaaatcctttcttatttgtgaaaatcctctagtctctctctgtcctgctgcttcatttaccgtcaaaatctgacctttaaaatgttgcttttctcttttgtttttgtttgtagatggccggcagcatcaaccgtcgtggtctggacctgactggattcgttttggaactgcggggcatgtgcgttgttctggggtatccgcatggagtggactaccagggcaagcagctcccggagcaggagggtgacgatgcagagccccacgctgcttgggaggttactgcagtgatcctcactggctcacccgagaggacttcgttggcggtcaccgcgggtggagattccttctccgctgcttgccagaacgccgcactcctcgccatcggcactcttcaccagcgctacccggacgagttgcagcacttgccctaccgctaccaccctcgtcgcggaggagcccgcgactacgccaccttccgggatgctagctcggaggatgacgctaccatcatgcacctggcgcacatggtggatgatgaggacatcccttccaacgatacaaccacgcctattacacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcaacactagcagcgctgatttgatgaagtcaatgctcttcactccggagggcaaacggggcaaatgagtacttgttggaaagatctcgtcgtctactgtcagctatgtgtggcctcaccatcaactttgacccaggctgctcagaatgacgaaaatagttctttacatcagaaacttgggcttgggccttgtatcattatagcccattaggggtccacaaaacctagggtttgctcccacctcctctcctggtcattcctccacctatataaactcctagcagccaccattttgcactttgggttttgtttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaataacgtggagtcggtgtaccggttgctaaggcgtagcacccctgtggtagttgtagtcggaccgccaacgtcgtatccttccccaaatcgaagtttatcctcctctcatcgaaagatcgggaacccccgttgctgcatcagtggaggcatacgacgcggcccgtatcgacttccatcagatggtgcgtcgcgggttggtcaagaacaacatgaagatcctggagctgcgtcaggagaatctgcagttgaagaaggacttagacgcagtggaggcgcagctgcgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccgcgcccgtggttcctcaggaggatggagcctccggcgttggcagtacggaggatgcgctgttgctcaccttccgccctggcccgtcgcagcagtagacgagcagttagtaggcttgcgcgtgtgttcttctcgttttttgtttttctgctagagtcgtatggggcatggttatgccggtgtgtggtataactgtgtcggagcctgtctttattttatttgcttaagcaacttgaactttaatgaaccaatttaatagcagtaataaattcaagaattatggtagtcgtgggtggttagttttaattgtcagctctctctgtttgctggttctgtgtgggattttcagatggtgacaaccaggagaagtgctgctaccggtgaaggcagtcaccccgaaggcagcaaccacaacaaccatgtcagcccacctccacctccttctccgcctccaccaccaccaccagacaccaacgccatcctcacccaaatcgtcgcccagtaggccaacatgatggctgctttcctccaccacatccaaaatccgccacaacataatgctccaccaccacccccacaacactctaaactcgccgagttcctccgcatctgtccgcctaccttctctagctctaataaccccgtggatgcattggattggttgcatgccgtggagaaaaagttagacaccgtgcagtgcagtgatgaggagaaagtcatcttcgccgcccaccaactgcaggggcccgcatctctatggtggaaccatttccaggctacgcagctagaggggcaacctattacttgggcccgcttcaccgccgctttccagagaacccatgtgcccgccggagtcatggcccttaagaaaagggaattccgagagttgaagcaaggcaaccgctccgtgatggagtatttgcatgagtttaacaacctggcctggtacgccccggaggatgttcgtgaagatgaggagaagtaagagaagttcttggcaggaatggatcctgagctgtccgtgcgtctggtctccggggactactcggatttccaacgtctggtggacaagagcatccgcttggaagccaagcacaaggaactggagtcgcacaagcgtcgcttggcgaatttccgcaatcaacagggggctaaccaaagggtccgctacaccaatccctatccagggggatcatcctcgcagcagcaacagcagcagcaacctcgctccgcgccccgacctcaattcgtggtgcgcatcccacagccgcagcaacagcagagtcagcaagggactcgtgcgccccgtccccctacgccagccgtgcagcctggtcaaggccgcagggacgttcaaggtcagcagcgtctgtgcttcaactgcttcgagcatgggcactttgcggataaatgcccaaagccgaggcgccagcaaggccaagcgcctccccgctccaacaacggtggtaaggatgtcattcggggacgtgtgaaccacgtgacggccgaggacgtgctgacaactccagacatcatcgttggtacgttcctcattcattccatccctgctaccattttgttcgactctggagcttcccactcgtttatatctgtgccattcgtggggagaaatcggttggggatagaaaggcttaggaaccctctgctcatcaccacccctggaggggttatgacagcaaagtattatagccctgccattcctatagaaatccagggaattccttttccctcggatctgattcttctagacaccaagaacttggatgtgatccttgggatgaattggttggctcaattccaaggagtagtggattgcgcaagacgcactgtcactctgtaccgagggccggaacaaccggttgttttctttgcacccccaacttctgtcggtagttcagaacttcatcagataggactgtcagaaatccccatcgtcagagagttcggagacgtgtttccagaaaaactacccggtatgctgccgaagcgagagattgagttccggatagatcttgctccaggaaccactcccctgtacaagcgaccctaccgtatggcagcaaatgaactggccgaagtcaagaaacagttggaagagttgaaagaaaaggggtatatacggccgagtacttccccctggggtgctcctgtgatttttgtggagaagaaagacaagacaaagaggatgtgcgttgactacagagctctcaatgaagttactatcaaaaacaagtaccctcttccccggatcgatgatctgttcgatcagcttaaaggtgccactgtattctccaagattgatcttcgttccggatatcaccaattacgtattcgtgaagaagatatcccgaagaccgcattcaccacgcgatacggactgtatgaattcacggtgatgtcgttcggtttaaccaatgctcctgcctt

SEQ ID NO: 7748 - DNA, 705 bp, Oryza sativa
tgcagcccgttctttacacttagcttctcacaacataatatcctgaagagcctccaatttaaccatttatgacggttttcagtcatacttataatcgtcaaaggtggtcttctggaacatctcttttaggatagcacatactgatatacatttatgaaaaaaagtgctgcatcaaaattggcatcagaaacctctactttggactaacttactgtgcctttgagcttcttacatttaaaaagggcaagtctagtatatcttcatagtctacacgtaaataatattcaccaaattgacttagtagtacagactctacataattgtactgtttaattacctgatcatttttgctgaaccaaatccaagactgtcatgaaataggcttgtcatgtacttcttctatacaaagctcaaaagctctgagctgttgtatatatggggcagatatgcttccccattcccatctttgtgtttattccataattcgacaaacttcttataaaaaaaattccatgaatcttcaattgtcttcaagatccatttcttgtaagcctgcaaaatatgtacagacatacaacttattttatgcctggcgaaacatcatgaaaataccttctagaatctagatgttgcaattgcactttaccatatcataacttatcatttctgcagtgcccattaagtactccctccatttcatattat

SEQ ID NO: 7749 - DNA, 401 bp, Oryza sativa
caaatcgaggctacaatttgccgagaaaacggacgttatgccactccctaaactgggttcggatgaaatgctactcaatacaatgcaccggataaaatgccactcaatatattgcctaccgaatgaaataccactttggagatttttgtacccaaaatgtaactgtggagagagagagagagagggaggagagcatcgggagagccggtcgggcggcggcggaggcggccggcggtgacgacgggaggaggaggacggggcagtgacgacggagggaggaggataggcctcgccgggcggcggaaggcggtgacgggggggaagggagggaagatagggcggcgggcgagtcgcagtgaggactatggggcggatgaaggaggaggcgactacctgtggaa

SEQ ID NO: 7750 - DNA, 758 bp, Oryza sativa
aaatttacattaatccattttttaaatattttaaaatacttgattaatcatgcactaatgaattgatccgttttgcgtgctaggtgggaaggttcccaaccatagctaacggacacaaacctagatgatcacactataggtagagctcattgtctgaaaatgcttcgccgttccatattattacattccaacatttcaatgcagaaagcgtgatcagttacacagcatgaccaaattgacgaaaagttttatacgtcccatatcaatgtacatgtatatactttgcacgttaattcaaggttgataacgcaacacaccttcggttaataaaggaccgatcacctttaagccagtaatttagcaagttcatctactcttaaggtaccctgtggaacaacatctgatagaaattctcgtgcgtgatcatttctctgcattcttgatcctcccatgacaatttctttctttttgacatgatcagatactttatgttcttcaagatgcttatttatccttacattcttggctggctcagtcttctgggtaccatgggacttccttggtgtatgccggagtaccaggtatcgtggagccgtctttgtaaaagcaacagacttttgatacacataattggcatcagcaaactcattttcattcagcacgagtgccatgccactgtcaatggcttgtttgaaaaggagtaaaattccctccatgtaagaaaggactttggaatccctgttacaccatcgctgccg

SEQ ID NO: 7751 - DNA, 583 bp, Oryza sativa
tccccccgaattacgaagtgaatttttgccaagaactctcccaatacactccaatatgttcaaaaatcatgttttggcgctttttgaactttttgattccgggcaaaaacatcgcccccttgtgtgccaatgtttccataaatagacaaaagttcaccgcgggaatcacgaagtgagtttttgccacgaacgcacgcaccacacttcaatatgtccgaaaattttgttttggcgttttttgaactttttgattccggtcaaaaacatcgcaccctcgtatgccaacattggcattaattgacaaaagttcgccgcgcgaatcaagaagtgagtttttgccacgaacggaccttttacactccaatatgtccaaaaatcttgttttgctgctttttgaactttttcattccagtcaaaaacatagtacccgtttgggccaaaatatgccaatattagcattaattgaaaaaagttcgccgcgcaaatcacgaattgagtttttgccatgaacgcacgcaatacactccaatatgtccaaaaatcatgttttggcgttttttgtgctttttgatttcggtcaaaa

SEQ ID NO: 7752 - DNA, 5292 bp, Oryza sativa
atcattaccaaacacttcagtttcaccatccagctgcactgtacatgggttaacaaaagctatataatttgctcacaaattatgtcacctcttcttttacataaatggtatccttttttccatgcatcaacatgcttatagattagtgttatgaaaatgaagcaggaataaaatccacacgcagcagtaataggatgaaacaaacctgttgtgtttcctgtgaccttctctaaactaggtgcagaactgaaatccaaatatgtagatgctatattatcatcgctgtagtttctatcaagtgtggcattcaaagaaggcaagtcaggccaggattcaacgtcaagttgtgtagctgaataatgttcactagcctgagaggcaggctgcttttccaaaactggaaactcagtttgaccacttgaacttcgttcagtaaggccaggaatattatcagtttcttcatcattcttcttctggtctccaacacttactaatgcactatcctctgtatccttagggtaaggcacaatatggtcttcattctcattgaactcagcccatattgcatctcccacctgcaattcaaacgataatctgaaaatactctgaggaaatttaagcagagtctcattgtcaaattattttgaaacaatttacggagccatcgtttcgcttattcgcggaataagcgaaacgcgcgaataagtgaaacggcgtatttgcaaatgaaaagtaatttgtgaataaaactgttatatacgtgttcttagcgatctaaaagaaaaggctgaaaaataaattttgatgaaaaaacctcaaaatcagctccaaatttaaggttgaaaattcaaattttagctgataagcataagcataagcgaaaagatgaggtcctaaaggagaacacacatgaatataccctacaatataaattcaattgtatagtagaataaataatgtgtaaaattagagtgcaagattcctatcatggttctctattcataatcgagagtgatatgagattatacaatttaggtcactaaaccgaaactattaagccacaacgttttaattcatatgggtaggcctgctgtctgaatcatgaatttttgataaaaagaagaccatttttcataatcaatccaatccattttacattacccaaagagtgacctactataagagaactttaatacaccaaatgacataagtatcagagtatgatcctacttctaataattcacaacagaaacactgtaacttgaagttatcagcgtccagcagccgtcacgtgaattcaaaaatatataaccttggttcacaatactgctatgtagagaagactaacgatagaagtcagattggcagcactcccgtggagtcgcaaaagattattgggacatccaccacccgtcgacgcaatagacaattctacaagttacataacttccaatttagtgtaaccttaccttatgagacctagcacaacccaaccgcacgcggtagcatctaaatgcccacaagactctctctgctaggtgagcctccttggaaataatcctatcatcctcgctcgctcgctcacaatcatcagctgcttcttcgagcactaaaatcccctagaaatgagaaggcggaaaagcaatatccccttaccagaccaccacatataaactagcttcgcgcggtacacgtgctcgcacagcaaagcagatccagccgccacagcatccgcggcacgaaactacagctaagaaaagcaaagggaaggacggatttcctctgcggcgcacctgctgctggtcgtcgttccactcgaacatcctcctcaggtggcggccgccgctggcgccgcacccgaacgagagcccgatacgcgctgccccccgggtcccgacggttgcatctccagccacggcaaaagggaagggcagaaaatcctccaattcggtgacgcggcggagaatcgcgttgcgcttgctcgcttctcctcctcctccactcgcgacctgtgttgtcgtcgtctgcgcttccctctcccccctctccctctctcctctcccttcccacccaccgagaggagtccagggaggggcggacgcgtggtgcaagatgattgggcgggcggtcggggttgaggtgcgggagggccacgtgtggagggggcgcatctcgggtagtggcggagatggctcgatcaaatgccgctcgttgattggctactgcgggacttagcgggttaacgggcggggcttagcgggctgggccgcgtcgactcgtgggggtcgcttttcatggcttgttgggcgggccgccacgggcaaaacgtaggaccagagatcactaagctttggtcatattagcgactccatatcaccgcaagtcgtttaggtattcaatcatgtttgtctactggttaaaaaaaacttatcaataaccattagtaaagtacaagtctagttgtgggttttgtatccaacgattgaccatctgtattattagaaaatttttatgattattagcatttttattgttattctttgggtgatttattttttaaaattttttcatagatttttcaaataagacgaacgattaaatattggatatagaaactcaccactgtacttagggtgcgctcgtctgtgtttattgtagtatcgaattaaatctgagtgtaatcagtactgtaggctgttagtagtaaatatggtgggtggctgaatagtaggtagcaaggctggatggagtttgatgccggttggagtagctccttgagattgccgacggagcagtgatgcaagcgacgtgacgggacgggcagggctgtcagtagcaggcagcactaaaggcgctgcagccgctgctgttggtgtcggcttgacttgggagagggtggggcttttcctccttgctcagataggcctgcgcgcatggagccgacagtgataggcgcacaaaaaaagaagtaatgtgatcagcaggatgattagttgtagattaatgtacacaattaattgctcgataaaattctaatgaatgtgaaatgcgtgattaacaataccaaagttcacatagatagcaatataatagcgttatacaaattcgagtagaacaacaggacagttgtttctcgtaccgagaacacacataaaataggctaacttgagaaagacatgagcaaggaatacaaatttattaaggatagaaagtgatgcaggactaattgttgtaaactttcaatcacgtcacgaacagctctcatccccgcggcactattccgtgcgtcataccaattgcgcagcagtggtgcctgtgggatgggcgggtacctgttgtacaaccggttctgtgtcatgaaatgggggtctgcactgtcgagcctgaagttgtggagagcaaaaacgcagtgtatgatcttcgtttgggtgtggcctagggaaaagaggtatctccctaagaatcctacactgactcttcataactccaaaagctctctcaactgaagtacgcagggaggagtgcatatagttgaatgtttcttccctcccttgcgattgaccagcaaattcattcaaatggtagcgtacatgcgggtacggtggcaagaaaccgcactggcaagcgtacccagaatccactagtagatatttacctagacagtgaacatgagaaatttcagatgaaaattgcatgagggagtaatatgatggtgttgtgtactaactggattaaaaaaaccgtcaacattggtacttaccccatggcagccttggaaaactatggggatagttccggatagcttctgtgagcacccgctggtcgtgcacagctccaagccatccggcatctgcaaatataacacgatcgtcccatccaattacaactaatacattccttgatgtgatatggtgacgattgcggtgcaaattagcttcttcaactgcaacatgaactgggatgtgggtcccgtctgcagctcctgcatccccagcaaaaggcaagaaattttcatcttgcgcaacacggttatgcactcttcgaaaactaggatccacaggcttgttgatatcagctgccatggagtaaactgcatggtcaacagacactctcctaccaaggtcaacagacatcatcagcgaagatcaaacatacgacaacgaaatcggttaagaatttcacttacctgctggcaggcagcttcaacgtcctcctctttggaggaggagccagactacctgtatcccgcgtaagatagcaaatcatgaccccattccggtatctttgaaaaggagtcaaagagcgaggacggtgcgctttacctcggagccggcagacttctgccgagaaccggcgggagcgctcgatctcgcccacggcttccgcttggtcccgctgccccctgcgatggcatgagcggatgagatcttggcgacctcatcagcgaccttgccctttagcgaggcggaggcctagtggtcaacaaggggaccgatgacatccgtcaatggcaagacctgcaagagttgaagtcactttggccctttaaaagaataaagatacgcggcgtcccggttctcgcttacattaatggcagcagctttctcggctgccgacttatcgcagagcggggctggcggctcttcagccgaagaggtgccactgatcaagacctccttgaccctctgcaccagcgtgtcgtcaagaagatctaaaataaatgaagatacaaggaaacaagattagatctcgtctacaagtttaacatcgaaagtgatgagatgaaccctgaggtcctctcggcactcaaggctacagtttggcccgatctttcggtgagttcagataactacgatttgggagaaacgttgatgatccgactacaaccgtacaagacgttgcgttgcgccttagcgatcgatacacctcttcgtgggttgttgatcttgccggtgcagatcaaccctattcctgcaagcaaatcgaagaaacaagcaagaacaagataaaagcaatctaatattgcaaataggaattgaatataaatgataagttggggtttcggggtttcgaatacaagcagacggacggtctagccgacacgtgcgcttcaaggaagtagcaatggctaaactttcatctaaacaaaacccaactaactctgaaggggttactagctatttaagggatggaggaggtcagaaaggcgttctccctttgtttggggcgcagccccccttgggccccacttgggccggggtcacaggcccataggcccattacagacaatgc

SEQ ID NO: 7753 - DNA, 8992 bp, Oryza sativa
  unsure (1)..(8992): unsure at all n locations
gggtatatgacatgatcaatggttgtatccgtgtaggcatggtcacatcatcctccctttcttcacgggaaaatgtcctcggttttaacatgggtaattcacatagcatatcctgacgcaacgcttcatatggcgcattctttactgtatatggcagcaacattgagcgatctcgtcgctccccttcttcagaaccaacctgcgtctttggacaaaagcaaaacaaacttgaagtaacattagtggtcctaacactactctccagtttgcattttcttggcacaacaacagagggttgcatatctgaacaaatgtaaactttgtgcaccaaataaatttctctatcactatatttgccaaagatgtgaaaaataacattacgaggacatggcaaatcagaatgagcaaatattttgtccttcaaacaattgagctcacaagaatcatcaaacagaatatagcccaatgtatttaaagaagattgcaattgaagttcatcattctcactggacgtgtgaataacatgcttaaattcagtacatggagaatcaagattaaaagtagcatgttcattcactagttgtggaatggatataagtgaagtgctatcgcacaactcttctttatcacaaggaacataatgtaaatcaacttgtgacaaaggcaattcagaagtaggttccactaaagtttgctctaggttagcatggaaagtggaaaagtgtaattcatcagaaacatactcaccttgagtaatttctgcaccatttaatttaccttttatcccctctttagataatgtaggtgcatcagccttctcctcattcgcgagtgatggaagtgacatctcaaacatatcgttcttctcattttggggactgttctgaacttcctgcaaaacatcagtgataggaggcacaagcatagcttgttgctctgttgggttctccaaaattttgcgctcaacattgcaagcaagcatgaacaattggcctatatgattatatgtcacattaacatgcccatcaaattttaaaatcatgaaagtactccctaacagttttgtcaccttgttttagatgttgaaatttctcaaggagagcacgtctatagtatgaaaacacaaatctttttctcaatagtattttgcattcatcccaagtttcaagcttatttcccacagtatgccatcaaaaagatgcagaaccggtacacttattactagcagccttaatcatttgagcattagaaaaatcatactcatcaaattgtttttctactgctagctcccaattaacgtatgcagcagaatcatactttccatcaaaagatggcaaaaatagactctactcttgcaagattatgatcatgtaccttatttgcgtcatgttggtcacttgccatgtgttgtcgaaggtgaaaatgtccacattgagcacgaacagctccaaactctttgtgtaaccctgccatagttagtagcaaacaagaaacatatacaagaatatatacgttcctatcaactactaggtagtggaagctcacaaatcacacacactcaagctttttatcgagctcttacaagttcttaccaatgcaaactagaatatggtgtccacaccgactcaaccaaacactcgatggagttggatgtatcgacactttggcacacatgttcacaatctgtatagctgcagtcaaatctgtggagctctgggtaggcttaaatatgtagcaagtatggcaaatggttaaatcagagaatgcaaagttgaataatcgttcaaagtcaagtatcgtgctggtcctaggctagaacgaactagagacgcgagcctagaaacaaacaataccacaagataacactagaataagctcaagcatcactttttttttgagaactactcaagcatcactttgatataagagaacaaaatcaaagataagagctctttttttccttttttttcttcttccttcctctctctttttttcctttcgttttcttttctttttttttgttgcgcctttttttttcttttttttcacctttctgcctttttttcccttttttattttttttcaaaaaccaactcaaggacccggatgcaagattacagggactcaaatgtaaatataaaaattacagggacttaaatgtaaaagtgcaaacccaaaattaaaaatacacaaaaatagaatgctctcgtcccataggttccgtttttgcaaacagaattctaatctgatactccaaaaaaaattttaccaagttgtatgggagatcacggtatagatgaacccatagaggagatactcggactcggcctggttgcggacccgcggtggtggtgggtgaggaaaggaaggatgcggccggatttgttggggaaaaatgggaaacttatttttagccgaaccaacctaactattttnnnnttccaatcaaacgcatacttccaaaactgattcgtcctctcgctcaggtcacaagcgcggccgaatcaactcgcttcacatacaaaccacaaactcgagcaaaaccttgatgcgactccaaaactaaccgacaaaaacttctaaaaactacaaaaatagaaccgtggcagcgaactgattccgacaaggggggaggggggcgacgactgtggtacaaaacgtgaccagaactcgaaactttaaacgaactagacgctaagaccagcaacatgacatgacgatgcaacacaaaattcaacaaagcaaaaactgaaaagaacagtgcaatggcacaatatggctaggtaaatgacacaattttttttttgtctggctattttctggttatggatagataaaaaaaactcaacgagctttcggttatggatagataaaaaaaactcaacgagcaagaaagctctgataccacctgatgagatgaaccctgaggtcctcttagcactcaaggctacagtttggcccgatctttcggtgagttcagataactacgatttgggagaaacgttgacgatctgactacaaccgtaaaagatgttgcgttgcgccttagcgatcgatacacctctccgtgggttgttgatcttgccagtgcagatcaaccctattcctgcaagcaaatcgaagaaacaagcaagaacaagataaaagcaatctgatattgccaagaggaattgaatacaaatgataagttggggtttcggggtttcgaatacaagcagacggacggtctagccgacacgcgcgctgcaaggaagtagcaatggctaaactttcatctaaacaaaacccaactaaccctgaaggggttactagctatttaagggatggaggaggtcagaagggcgtcctccctctgtttggggcgcagcccccccttgggccccacttgggccgaggtcccagacgaagttacaggtccataggcccattacagacaatgcagccccttgtttctgcaattgccgatgactcagatggaatttgacaatgaggttgatccgatggaaagaggattctgagagctttacatcaagtactcgtgtgaagcatctaggcccacgttgttaattttggtaattaatgacaagcgctaattgtggactaaccattgctattgagatgatattttaagttaggtccacgtcatgtgtgcgcatggatgactatcgatcgattaaaattgacggcgcaaaggaaagagaaagaagacggtaaaactagtgctttaatttagaattgatcgaggtgtagggcgatcaaatttgctagtttattttctagtttcgctgtactattaagaggggtaatgacctagcaaagagatgattaaattgccacattaggtcattgcattttcacttgtgctcacattttcatcacacacacaaatactcacctttgctttcactgagctcggcctgaccaggggcggtcaaaccggccacatagtggcggtctgaccggtgtgccctggccagtctgaccggcctcacaacggtggtctgatcggcccataaggacggtctgaccggcggcacatgcccggtcagaccggcccgctggaggtcgggatggtgctactcggggtggccgatacagagccgacggagccttattcggtcagaccgagtcgatggcggtctgaccgagccgaggccggtctgaccgcctgctcaacgccagtctgaccggccaggccgatggggccctctaacagcactacaatggctagttttctagccgtcgcagagtagcacggtctgaccagccacatacctccggttagaccggcagagcacaaagttgggggatttcacccccaacggctagttttggttggtgggagtataaatactccccctcaagcagcaaggggactctcttggcacccaattcaattgcatacaccccttgcacctctctcacacccacttgagctttgtgttcatccatctagtgtgttagagggttaattagccaagagtcaagtgcattgcttccatttgtagagctagtatggcacttgattgatcatctccacgccgggtcattgcttgttactcttggaggttgccgcctcctagacggcttgtggaggagttgcccggtgacctctccgagaagattgtggaggaggcccggcgccggtttatgagtggtttggagttcaccaccttcggagtgaaggaagaactaccttagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttctgaacctcggtgaaaaatctcttgtctccttgtctcatttgattgtcgcatttacatttgtgcaatttacatttctagagacaaacttgagatcatatcaccctaggattgctaaacattgacataggagtgtgatttactttcctagagatataattgagccactatcaccctaggtttgcaaaacataacctagttgcttagttagagttgaccctcaccaagcctagcaacttaggttagttttgattatgtgtcatttagttttaaatcgcctattcaaccccctctagtcgacatctcgatcctacaagtggtatcagagcttggtctctcttgattgggttttaccgcctagagagaagatgtcgaacgaggtgaaccatgtagggaaggctcccatgttcaatggcacaaactactccacttggaaaattaaaatgtctactcacctcaaagctatgagcttccatatttgaagtattgtggatgtaggctttgctatcaccggcacgcccttgactgagattgatcaccgcaacctccaactcaatgcccaagccatgaatgctttgttcaactctttgagccaaaaggagttcgatagagtgagcaaccttgagaaccgcatatgagatttggaacaagttggcggagatccatgaggtcacaagcgagtacaaggatgccaagcttcatttcctcaagatccaatatgagacattccccatgttgcctcataagagtgtgaatgacatgtatgggaggctcaatgtcattgtgaatgatctcaaggggcttggggcaaactacatgtcacaccctaaaaatcgttaatatataaattgttgtttaattggaattattagaaataattttaaaagccttgaaaagaagatctaattttaaataataaatcccaatataaaatggggccagataaaatttcattaaatactttgcttgattctatagttcctagagttttctgggatttatttgagccaaggaggtatttttaataaatggaattgcatttcatgaattatttaaattggaaaaggttttaaaagtctcttttggctttgggccgaaagtcggaccaaaaccctctctctctcctccttggcccaagtcggcccaagtcaagccgagccgcccgcgcgcgcgctcgctgccgctaacaggtggggcccacctgtcaggcctgtcgtctacctccggccggccgccgcccgaaccctagccgagctgcgccgccgtctccttccaaatccagccgcccctttccgtttctggtgaaattaatagaggggacatgatccctgggatcccctctatcttttctcttatggaatcgtcggctaatttcgtttggaaattcgtggattcgagttcgattcggatcgatctctctcctccgaaccctaatctttccttctcgtcgccggtcgccgtgggcctttgccgccaccttccaacccctataaaaggacccccaagcccgccgctacccgtcgccacccctgccttcgtctctcgtcgtccgtagcgccctagcccgtgagacctcacgccgccgtcgtcgccaccgctccagccgtgcgtcgccgtcgctccagtcgtcgctgtcgctcgggaaggccgccgtcgtggtcgccgtcgcgtcgccgtcctcgtccgcccctccatcgttgctgtagaccgccagagcaccgccgtcgtcgtcaagccgaaggtcgccgccgcttcttcctcgacgccgtcgccttccgttgatcttccgccgccgttttggtcaccggtgagttcgccgcgtcgctctctatgcgctggtgccctccgttcgtgccatcgcgccgtcgttcgccggcgagcttgcgcgcccgagccgccgccggtgatgacgtcatcgccgacgtcatcgttgccatccgtcgtagaccagtcgtagaccgttagatcttagccgtccgttgtggttaggatcgatctcggccgtccgttcccgtgaaccgtcgccgtgcacccggtccaccgcaaaccctagtcgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacattactattcatgcttgtttatgtgctgttttggtgtttttgctcttttctgtttagattccgacgtttccggagagttcattttcgcaggagaagaatttgaagagttccaaggccagcaaggcaagtcacacagatcccaaacaaccctttgagcatgttgatcccgtttaaagctatcatttttattcaactattgcatttattttcgaatgtcattgggtggaattaacctatggtttgttatagcccttttgttcttgattattttattccttgataccttgggttattataacttgactagttgggctttatatattggttcagctagatattagatacgattgcttagccatgcttagaaacatgagcacactattgggataacttataattcactattatttaatgatggcttgatgatagctcacgatggtcaatcgtgattggttaattaattaaattgccaactaaaacttgctaatggtgggttgtgagcacatggttttgatggtcgtgctcatgacaattaaggaccggttcacgaatttcggttgtgaaacattaaccgtgccaaccacaagccagcgtgggcaacggctttaccttttgtatagcatggttcattgcggggcaccagactgagaagtggcggagataagctcacgggggtcgctggggagtccatgccttgtttataagggggtgattatgatccaggaacggtgcgctgtggtggattgtgttgtgtgaggggtactatcacagctcctttctgaggtaccgtggtggtattgaggcgcatggtgacatgtcgtggggctgtgtcttatgggtacagtggtacatctctggccagagtaaaactattcgaatagccgtgcccgcggttatgggcgggtctaacaatgtctttcgtgattagtttcacatttcccatcataaaaaaagatgctataactggtaataatttgattagctcctggtttggaatggtacattcctggtttggagatagaactgtgcagccgggatggttgttcagaatggttgggcctatgcaacagggtatgttgtatagcgttggattaatattgtttaattattacttaactgttttattaaattctgaaatgttcattaaatgctgtttatgcaaatgaaaccctactatgccatcctttgttatcctgtgcacttgcatatttgctgcgtggcttgctgagtatctcatatactcaccttgcaatcattcatcagaggaggagttctacagtgatgctgatggtgtggaggattaggtgtagccctggtcaagctgcctgtggagtggagtcgtctgcgccgtttatcttttttttccgctgcttagatctttattgattgagaggaactatctacctctgtaatgacattttattcgcttattaattagagtaataattatactctattatcaatttgttattgtgtgcctcggctgatttctggacgagggttcacacacatgtaagcgtttggaattttggatagaaattccgggcgtgacaagttggtatcagagcctccttgaccctaggttatgccaaatggtcacccatagaagccctctaaaaatattgaaaaagtagaactgttctcctccctttctcttttaattaaaccaaactaatggcacatgcacttcataatctcttttagtggttctcattcaaaatttattccagtgttgttagtactatacatctattactgtactaatggctcatttactagcaaatgtttataacattgttttattttgctgcaataaaataaatttcgcatgttgattttataactttcttttatttcttttggaacctgttgttcaaaagtgcaaaatttgtgatcttgtttccaac

SEQ ID NO: 7754 - DNA, 4007 bp, Oryza sativa
tattgacggtcagatattatgatttaaggaccgtcaacagtaacctcattccttcgttccaacaaaatctaaagaactcacaactccaatgaggatcaaacttatcaccttgacaatattcttcatcctgatcaccttgataatatctatcatctcggcgatgtctaaaattctgaaattcctctgaacttgtttgtcatgtctcttctggtacttgttaatcaatctaatgctatcaatcatggcatacaccatatttacaggaaaaaggatgtccatcaatcttcatcgacctttttccatcatcaaacttgattcttccttgttcgatggcggattggatttgctgcctgaacaccttgcacccattagtatgatgagatcctgtattgtgccacttgcaaaacttcctcttcttcagctcttcagccgatggtagaacatgacctactagcaactggatttgcttttcttgcaacagtaaatcaaagattttgttggctttattgatatcaaagtcatattcctcttccttgtttatatacttaacccattgacacatagttgtcttcttgatcatggaccactctgccaaactgatctctaggtcttcctagttgtcttcttgatcttggaccacttagccaaactgatctctaagtctcctcctcagaatcataaacatatctatagacgtagttaaccttcttgaccttcttggcctcctgaaaacgttgctcatgagccgataccttctgagccagatgtgctaagctctcaaagtcttgtgatgaaaatttctctcttatcgacccaatcaatcactggaaagccaaatcgactagctgtgaatcggtgttgacggtcgttatcgatcagttgcgaccgtcaatataaccaaaatttaggagaactagtgatgcttgcaatgcatatatctgttaaaataataatattccactagtattaggtacagtaaccttttgcagagaatgacaataaagtggaggagaatcgacatcaactcagacgataaaccaatcggacagtgtcgagaaccagacttatgtatgaatgggccaagaactcagaaataacacaacacattgggccaaaattcacaagtctacgaaggaggactacgaaggaggccgctagccaaagatgggctgggttgagccaacccatggttcggggggttcggctgaacctcccgtggcgccgatggatgcaaggtttggatggacggctgggattgatccccaatgacggtaggagggtattaccgaccattccaaccgtcgcaaccgtcattacctacctataaaaggagctcctcttctcacttcactcacacacctcaagcaatagctctcccatttctctcaagtttagtttagtagtatctagctggtggaataggaatagagtagaaatcaggagtccggaagtcttcggaagagttcgggtatggctctagcagctttcctttcttcttttgtaagctttgtacttttattagaataatcttctatatacatttacggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttccggggcgtcagaccgcgagccgttgctccgcagaaaactctaccaacagagaaaccagccataccagcgccaccgatcttcaatactatggccagcaagactcttcgcgagttcgctgctccctctactgacaatgtggccattgggccgcaaatcaacataggagacatggatttcgacttgaagtccagccttatcacaatggcgcaggctagcccgttctgtggcaagcctaatgtggatgccaatgctcatctgcaacagttcctggagatctgtagcacgtacaccatcaagggcgtcagtcccgacgccatcaggctgcggctgtttccgttctcccttctcgggagagcgaagcagtggttttatgccatccgtgctgctgttaacacctgggacaaatgctcaccgggattcctctcgaaattcttcccgatgggtaaaaccaatgcccttcgtggaaggatttccaatttccagcagacaagggacgagtctattcccgaagcattagaacgactgcaggagtatgtggccgcttgtcctcatcatgggatggacgactggctgattgtcacgtcctgataaattcatcccgaaataaaattcattctctaaatggaataatagaattaattaaaattcgaaaagaaattggttaacactaaaatacgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaagaaaaacctaaaaataatcctccttcctcatttgggccaagtctggcccaaagtcctctctctctctctctctcggcccgcagccaaagtcctctcttcctccctctctttctctccctctccttctctccctccttctcttgggcctccccttccccctcggcctaggtcccttttcctcccctcccgcctaggccgcgtcccggcccaagccgccccacccagccgccccagcctcccgaggcgcccccctgacgcgcgccacatgcgcgccgcatgcgcccgcgtggggcccacgcgccggtcatcttcctcctcccggacggcctcctctctctcccgtgcaaccctagttcgttcctccccaaaatccacgccattcaaaccgggaattccaaaattgattagggggaattaattcccattccttcctcttcaattccccctaatttcccccttgattcgtgcccccaatcgtcgggaacgcccgcgccaaccccggccaccttccatggccgccgggcgcctattccgccgccggtccccgcctctcccgtggccagctccctctccccccctataaaatggaaccccctccgggcgttgtctcgttttagccccttcccgagattctccg

SEQ ID NO: 7755 - DNA, 1039 bp, Oryza sativa
tcatggttccactagtatgaatttaggtagatgcttcgctgattaattaggcaacattaggtggttttataactttagactttgggaattctcaaatcacttggatactatgaaatggttggcttatggtggaattggacatacccctctcttcctctttcaaaacccctaaaacatgttttctggtggggtattgtatgcatgccagttatgggaagtagcaccccggccaatataaggattaagctcgggcctctgttgcaaagcactaccgtactaaccacatgtctaatgggtaaggcttaactcggtgctcagtctagtcctgaacaataattgacaaaagttcgccgcgcaaataacgaagtgagtttttgccacgaacgcacgcaacacactccaatatatccaaaaatcttgttttggcgttttttgaactttttgattcctttcaaaaacatcgcaccctcgtgtgccaacattggcattaattgataaacgttcgccgcgcgaatcacgaagtgaatttttgctatcaacgcacccaatacactccaatatgtccaaaaatcatgttttggcactttttgaacttttcaaaagttcgccgcgcaaatcacgaagtgagtttttgccacgaacgcacccaatacactccaatacgtccaaaaatcatgttttggcgttttttgaactttttgattccggtcaaaaacatcgcacccttgtgtgccaatttttccattaattgacaaaagttcgccgcgcgaatcataaagtcggtttttgccacgaacgcacgcaacacacttcaatatgtccaaaaattttgttttggcgttttttgaactttttgattccggtcaaaaacatcgcaccctcgtgtgccaacattggcattaattgacaaaagttcgccgcgcgaatcacggagtgaatttttgctatgaacgcacccaatacactgcaatatgtccacaaatcatgttttggcgctttttgaacttttcaaaagttcgccgcgcgaatcacgaattga

SEQ ID NO: 7756 - DNA, 3088 bp, Oryza sativa
aaagtttaaaaaatgttaaaatatgatttttggatatattggagtgtgttgggtgcgtttgtggcaaaaaattacatcgtgatttacacggggaacttttgttaattaatgccaatgttggtatgcgagggtgtgatgtttttgattggaataaaaaagtttaaaaaatgttaaaatatgatttttggacatattggagtgtattgggtgcgttcgtggcaaaaagtcacatcgtgattcgcgcggcgaacttttgtcaattaatggcaatgttggcacacgagggtgcgatgttttttgaccggaatgaaaaagttcaaaaaacgccaaaacatgatttttggacatattggagtgtattgggtgcattcttggcaaaaactcacttcgtcattcgcgcggcgaacttttttcaattaatgccaatgttggcacacgagggtgcgatgtttttgaccggtatcaaaacgttcaaaaaaagccaaaacaaagtttttggacatattgaagtgtgttgcgtgcgttcgtggcaaaaactcacttcgtgatttgcgcggctatcttttgaaaagttcaaaaagcgccaaaacatgatttttggacatattggagtgtattgggagcgttcttggcaaaaattcacttcgtgattcgcgcggcgaacttttgtcaattaatgccaatgttggcacacgagggtgcgatgtttttgaccggaatgaaaaagttcaaaaagcaccaaaacaagatttttggaaatattggagtgtaatgggtccgttcgtggcaaaaactcacttcttgattcgcgcggtgaacttttgtcaattaatggcaacattggctcacgagggtgtgatgtttttgaccggaatcaaaaagttcaaaaaacgcctatacatgatttttggacatattgtagttattgggtgcgttcgtggcaaaaactcacttcgtgattcgcacggcaaacttttgtcaattaatgccaatgttggcacacgagagtgcgatgtttttgaccggcgcaaagttcgggatatcggcgtggacactcatctcgtgaacgatattcggcgtgtcgggcccgcccgtgagccgcgcgcgcacggggtgagtcgcgatgcacacttttgacaaatatgcaggcgtaagcacatggccgagccggcccaagagggagagggagggaaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggctagaaacgtatcgagcatgtttgatgctccgttggtgttggtgccctgacacaagcgatcctccaaacagatcaatttaattcccggctttcatgaacaaaaacgttgcatacatcaggaagggaaaaggaaccgagaacacaagcaaaaattattccccaaatccatgaatctatcacaacctaaaaatgaattttcccagctgcttgcaaattgattcgatcaatagaacgaactgtgaaaacctactgctttgcacgatgtcaggatgtggcgtggctgcatcgccagcttcatgcggatggtggatacagcgaagtgaagcaacagataaaggccgggaatcggaggggagcttcccggcgccgacgttggtggacgacgcggactgcagcgtgtcgaggccactgggagtcagcgccgtcgccgtgctacacctccccctgctacacgtttgccgtgccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaattgcattttaggatcgaataccatcctcaatctaatggcaaaaccaagaaggttaacctatgcttggagctctatttgcgttgctttgttcatgctatgccaactaagtggaattcatggttgtagcataattctgattcaatatctcatatcactcagttttgcttaagtctcctttcgaagatctttatgggtatccatctagtcagggtgtgt

SEQ ID NO: 7757 - DNA, 8563 bp, Oryza sativa
tatcatttcgttattttggtcctttccggggtgattgccaagatgggtaaggtagtttatcgcttacatattcctgaggacagcaccatccatccggttttccatgtatcccaactcaagtcaactaccgtttgctggtgctgaatttcgttgttactactgcttagcatcacgcgtggggagacgtgggtagatggagatcggcgtcaggaaggggagcgtgcaatcgcgatcaccttgggaggacttgaaagaccgatttctgttgttagttttacaaagaacccatttttttaattttaggaagtctattttagacgttctcttggagagatacatctcaaattctgtttagaaaaccaaaaaaatatttttacatctcaaattctatgtagaaaaccaaaaacaaaattttggaaattgatttttgggtatcacttggtgatgctctaagagagtcatcgtgtccaattttacagttaaggattacgaataagatctaatatatatttaagagtcaaattggaccttttcctttgaagaaccgtactactgcagaccatagttcgtttattcaggtactacatttcggaactagtataaataaaacctggcctactgctgattactgattttttatagtatatgttcaaaacagaaattgttatagttacttcttttcttttttaaaaaaaaagctgtgattcatacatgttcttcaatacatatgtgggtaaggatggtttgtctagattaatagtaaaaaagaaaaggctgtcacattagttgtaatggaatgcactcaaatccaatccagtgagttgctgatatgcctcagaatagcaaggctcatcattggtttgataacatttgcatagtcacacaagctgtactacgagaatatagtcgtgtgtatgccaacctgcgacattatagaaaaagcctgtcaacctgtttagtcagtatcagaagaaaaattaaccctacggaataaaatctttaagcatcctttctgctcaacattgagcctgatatctgaacatatgacatctgagtgtagccattgaaaactgaggcatccaatctcgctagaccaattcgttgaaacatgccaaaacgaccatcttcgatgataggatcagatgcacgggctgggtcatatcttgtttggtgggttaaggatggaccagcaactggaggtagctcccaatacaaatccaacacggattcaacaagtctgctgttctggaaatgctctttgtatgagatggctttgttgctatggttgaaattgtcacgcatataacctctaactccccaccatgcatcatcctttccacaaagctcatctgtttccacagctttctcccaaaaactctttcgtctcgaccttaatcttgcttcgtcactatcccaaaagcagctatgtccaccacctgggtagaaaaaatacatgaaaattagtttttcagtgtggagggctgcctttttcagttttattgaggaatttcaaaaaggaagattataatccagctgaagaatatggtgttgcaatgtagtgttaatagaggaaaatggaacaagatagcattataggaaaaatgaaggagacccactgattagcatatctttaaaaaaaaactgcaatctggaatatcaccgactaaacttctggtatacattgatattaaatgggttcagaaaatgaaacatgatgcctgatgaacaaattaatgaagttgtggtaatcggtatcattaccaagacatcacaagttaagagcttcaagttcctcatatcagtttattgaattgtagtcataaatgtttctttcctaaaacccaacataagtaaacaaatatatgtcaagctgccagcagattatagttgcatacaaacaattataggatatataacatatcatttctagttggtctagtatgctccatcggagtaaaatattaagctgagaaaaaacataaatttcgacaataattgtatttggaagaaaatctgcacatgtttggacatgtcgagttaaaaaagaacagaaaagttcttagtaacatattggaaaccttggtagacatagtgtttagatcatgataataacaaaaaatgtaaggttatcttatatcttagaaatacaacaaaaaaaagcacaaacaaaaacatgataataacacccagaattcataatcgcatgattagaaagaaataaaataatctcaatatgcccaaaatttactttttaaggaagtcagtataagagattgcagaagaaatataaagaaaataaggagaacattgaaaaaggaaaactgtgtcacattaagaacgttaaccattcaagaatgtcttatggtaacagaagacatcacctcatattataatgccttctaattcagaagataaacaaacctaactgcacttatgctaggaagacaagctaatggagctactccaaagtaatgtgacacagctggctcaacatctatatgcaacatctgatgtatcttgattattgaaaacttagaatccaaggacaaggtgacacacctctgatgtgttcctgatcgcagatctgtcttaaggagtaatgatcgcctgtaccagtgtcataattgtcctcaaatatgatatgtcggaatccaactattgaagcctgttttaacctacataaaacaagacacatcaaaataaatttaagtttcgaaaacttagagataagagtgcactatttattagagtgaatgcttagcatgtgtcatgctgacagttaagaatttgatcataagaacagttcaatacaaaaacactacaaatatggcaatacccaacagaaaatagtttgtccacagttcaagagaaaggttgaacaatgatgatctacagaaagactttacctcttcaactcactttggtgatcatcaaagaaaacaagcactctgctgagatcagaaatgccatgattcctcaatagcttcccccaatcaacacttccgaagtcaataaaatccttcccagcaagataagtgcagttcccatcaacatatgcaggccccttcttcagatatttctcagggtgtctgggtgagagtgatataatcttagtatttggcatggcctgacgcaaaacccatgtagagtgccccttgaatgcaccactctcaatcatcagatctggcttaagccagcgagccacaaaccaaaggccaaaactgtggtcaaagcccattccatacatgttgttcttgataggtcgtgtttcatatattggtacaaattcttccagtccacgaagtagatcctttgaagtccactccactatctttccagtttttgatctgcctttagtgaagaaaaaggacaatgatattccatacagtcaaaagtgatatttcaaacaaattaccccagtatagaggttcttgtgaaataataacaaaatataccccaagaaaaactcagcactacgtagagaaacataatcatgtctaccaacagctacaaacataaatataagtacactggtggcaactaagatggtcaattgttacaggacttcaagaaacagaataatagattgccaccgcaatgttcgcactcctatctagcagcagtcattgttcaagaaacagaataatagattgccatggccatgttctcattcgtatctagcagcagtggaacaatgaccgaggaacaaatctgaacaagtataaaccaacagagatcagttaggagcaaataactataataaatttgcacatataatgtggtcatcactcatcgaacaagctatcaagctattctgtcaaatacaattcaagatttcaggtgaatatgcattgcgctcacataaagctagcctacaacctatggtgttaggtgtctaagacactaacgatgaggaatatctgcatgagcagaatcattttcaaacagggaggagattagttgcgaaagggtgattacttcgcagaaaagaaccggatgtccggatctatctcacaagaatcaacagcggcgtgagggcttacaccagggtaccccgagggcgccgaagtcggaggccgcggccgcgtccgggagagcgagaaagcgcgcgtcgagccgcggcggcgggcagtcggcgcgggggcgggcgcggccgatgaggaaggcggtggcggcgacggcgaggaggaggaggaaggaggcagcggctcggtgggaagagtggaggcgggcgtaggcggcggccacgaacgcggggttcgcctttcggatcttggactcgtcgtcgtcgtcgccgacggaggtggcggaggatgcgccagcgtagggagaggaggaggaggaggcgccggcggcgcgggctgagagaccggtgtcgtgcatggaggcgggacgggagcagagagagatcggagtagtagaaagtggcggcggtggtagaccggtggtatttggagagagatcgagggaccgaccgttccacacgaagggagggggtggggggcgtgttagggaagatgtcaacatggggaggatcttgcttgcacgggccacgcaaatgttccagtagcttttttaacgcgtgaatgataaacatgatctctactattatagtattataaaaattgaagatgtttttgccgatagttttgatacgtcatccgtgtttgaatcgttttttaagttcattcgtttttgaaagtacagatccgtttttgagtcggtttttaatttggttcgttttcagaaatacagaatgagtcgtataaaaagaattttatcttagctaacttgcatgctaacttgagatgatcggaaccctaattacagctcatgattttataaaaggaatattcaagcgaattcctacagtaaatttcaccttagttaacccgcacaacaataatcttcacccgttgcaacgcaagggcatttttctagtaataagaaaaggagaaaatccaaaaagaaaaaaacaatggacaagcatcccaatgttaaaaaaaccattgatgaacccaacttcctataaatgctactatataatcatcttatttccaaaattttatcgttgttatgtttccattaattagtagccctccattaagtactatcaaaagaccattttaccctacgaattgttaaaagctcattaaattttttcttttttagtcaacttataaataataatttagtataaagaacaacctacaaattagtgtaagcttatggaaagagcaaaaattttaattgccttttagcaattcctatgggtaaaataattttttatagcacttaacggagggctgctaacgaaaatctaaatgaaatggtgcgtttgtatgatgacatttcttggattcgtatgtttatcgatggtgtttcatggatttctctaagaaaaaacatagagtagggatatgataagaataaacatgtaaaacattaggaagcctataaaggttcgcacgctggggcgtgccacgttggattttacttttgcagaaaagcccttcggtttgtgtgtaattcaatcgagtacccagtgaaaagttcctctgaggtgtcaattcacgaataggcccttacataagttagatattgcatgcgaaggagagaaaattcacgaattaggaccgcgctctaaaacgtggaagccgagggggtttctagcaaacgacgccctaacccacccaccataatcctagccgccgccgccgctcacactctctcctccctctcgtcttctcctctccctctccagctcccgccgccgccgcctcatgccgcctccgcctccccctccccctcgtgctagagggatgaagaacgtgttttattatcaattctgacgagttaaagtaattatttccatgcttttaacatatcaatgctcgtacttagtgtgatgtgtggtgcactaaggatgtcaataatctaagttggaaatttcaaaccagttgttttatttaccaataggccacactttacacactacttgctcattgagcagtagcttatatgttggtatgttagctgaggatctcatcgttaggctggtaaatatattctctagatttgcgtcgcttgaaatgtttttgtggacaaatgctggtatttttcttctgtgcaaaccttggggccaaaacgtatactccctggttctcattatatttattgatccctttccttgcatgtttgcaaaattagcggtctattaccttccgtgctgctgaaataatgttctcatggtttgttaaaaatggtgatagtgatagggaccatgatcgtgacagggagcaccgtgatagaagcaaaagaagataacaccgtgattatgaatattctcttgatcatgatctccccttggaccaagattctgaaaggtattgcttctaaatttctaacctaagcaattacttgcaactgcacaaaatatgggtgtttttttcctttattaaatctacttatttgattgactaatgttttcctgatgcatttatttatttttatcaattagtgaattttcccctatgcgtgggaattcatggtgatgcctaataattatgaaaattaggttgtatcctttctgataataagatttaaagttaatgatatgttcgatctatctgctgcatactacactctgttgtgttcctctcttatatcgagcatcttattattagttttagaacatcttaatataactgacaattaattgctatagcaatcatgctgacaaaatcaggttagtccataattatctctgagaatctgattaaagctgccagatgtttagcatatgaagaaattcaaattctaatgtccctggcattcattctcttttgatctttatattgttcatttttttaccttctgttttacaactggatagtgcagtgggtactatattggcattgctctcggtgtactggagcattgcaactagctgctaattatctgattgactcattaatgtgtgctcaatttttcagccactgtttcttagtagaagaattggaatgtatatgtttctgaaatgaactctcccaattaacaaatttagaggtgcatccccttttaagttggttcttttgtttccctatctattaggagggggagaaacctgaattaagagatgttagcgtgtaatttccccctgaaacgtatgttaatctaatttttgtctaaatttactaaatgaattaaacgcctggcctccattacctatcacttatttggaaaattctgcagtaccctagagtgaaatgcaagcattgtgttcatatggggtttgttggcatatttcaactaaatccaatttttaaatgctacagtgctacaagaggctagaaaacaacagttgcgctattgttggtgactgacatgaatccatcgccgctcaattttaacaaagttgcaaagaagtttctaagacaataggggcttttttttggcgctgcaggctcttgcatcacccattcatctgtcattacggtttttgatgcacactgcctaattagttgtttttattatacttggattatttttctgacagaacaaatcacttcagttcccctcctgccaatgaggagtgtatgcttatacagtgaaagtattatgaggtttcatcaaggtattgtaatttgtaaaaccaatacaaatgctatgctcaataattgttttgaaattgtaatttttgatgaatcttatgctcaaaagatgattaaaattatctccataatgctcaagagaatacagatggttgtttttgtacagaacttagattttattataagctgttgtctatcgacaatatccatcattttatcagtctatcgacaatagtaggacgagctcttcagtctaaataacagttatatgtttgctgatgcgcctcttataacttttgctgccatgacactagccccatgtctcttgctcttgatcttcctttatgagtcactccatctaatttgtgtttgcttcctgatatttttgtagatgcaacaacatgaagattgaaaaggctgctgcctgcaaggtgtttgaaatcactgcctctggaatttaaatgtgtgaaagtgattgaatagttctgaaaatttatccttgctttgctagaagattgaatgggcggctattggaggaagaagaagcatgctacaggggtaatgacaaaggtagcagggtccctcttttgtgctcatggcatgtcaatttatcctttctgttgatttcgtgtctagaccagaaattttttaattcctacttgaaatcatgctaaaatggtttggtatcatatccaagaccaagcttaaatcatcttgtatatggtttcatcctacatttgttgctatgaagagtcaacacaaatgttgatattttccaaaaatcaactgaagcgtcgactctaaaatcaagttctagaaaagagtaagaaggatgtgctccgtcaaataataggggaactgtaactatagaactagaagtcttaaggacactacactaaccctaaagtcactcgtcatcataagcaaagtgcaaatattgtctgtctgga

SEQ ID NO: 7758 - DNA, 1286 bp, Oryza sativa
ggtgctactcccgtcccatgccaatcaatatcattaggtacctaaaaaccaaattaaatacaagagtgagtaaaaatactcagcaagtacaatattgaactagtaaaacatacacaggtttaatgcaataagaaaaccaatatgaaatatttgtcttcctttaatttaaaaggaaggaggcaaaaagtagtagttccctcccgggcaggtgtgaatatcctcttagcattaccggtaagccgagcaagcgtgatcagcgcttctcaaggatcatgaatgaagatccaaattgcactcccatgactacgcatggtacttgaataatgtaaacaaaaacttccagaataatgaaacatgaataacgtcgtgaatttgaacatgaagtgaaatatgaatacgtaacataatactaaaatcacacaattgattataggaaggttcgaataataattggataaatgaaaccaaataaagtaacacagtttatctatcacacaagtccatcttgtacttgccttaactccttcaataatccgactcaactcctccaacattggaaccctccacacctgtggagcaaaactacgcataaaccactatatctaactaataatagttacaaggatatttactaaaatcgaaacccagttcatataaattattaccgatttgtattaaatagcctatagctgttccattactgttttatacgtaacgtacaaaccggctaatggaacctagcaaataatataacttcggacatctagacaaaggttgtctaccactttcatgctgagtcctgatttccagacccggtcagcagtactgtatatgttgtctcccaaaccgtttatcggaattgagtgaaaccagcggcgttagaaagatatcgacgatgactacaaactttatttatgacaactaacctgaatcacgatggtttaataccagatttgaaaatactattgttagcccataatcaacaactaataaaacactgaaccggcaatttaatcgattcccacgtgaaaatagtatttctatggactaagaggagctacactcgctgaggagaaatctaatttgaaatcaatctgagaatacccaaaaaatgcccaactattgcctctcacaccttgctccttaatttctcctgctttccctgcttcttgaaactcctgctctctgttcggtccagaagcacatccccagaccagcatcagcagtagcagcgaggaacgttaacagatacagccgtaacatggatacatatcagatagatggca

SEQ ID NO: 7759 - DNA, 1301 bp, Oryza sativa
ggggcaaaacaatcttccccccatcaatcgaattcgccctcgaattcgcccaaccaaactctagaacacggggtattacattcctccctcctacaatcgaattcgccctcgaattcgtccagttattcctcgaacaagtatggaaaggaactcataggtaggacttatataactcaccaggcgtgaataactctggctacttctcccgcatctatgtctcaagttcccatgtggcttctcgttcggtcttgtgcgtccaaagaaccttgacatatttgatagttctgtgcctcagcaccctctcagattcctccaatattcttagtgaacgggactcaaatgtcaaatcttggtcaatggtcaccggctctacggtaatatgatgttcagggtctctcaaatattttgtcaacatggaaatatggaacacatcatgtacacctttcatggactctggtaactcgaggcgatacgctaggattccagctatttccactatcgagaatggaccaatatacctacggctgagtttgcctttcgttccaaatctcacaacacctttggtaggagatacctttagaagtacttggtcacccacttcaaactctaattcccgtcttctgacatcagcgtagctcttctgcctactttgagctacgagcatgtgttttcgtatttctgctatccgttctgtggtttgttgaacccaatcgggttctaaaacagctctctcccctatggaatcccaacacaatggggatcgacactttcttccataaagtgtctcatagagtgccattcgaatgctagcatggtaaatgttgttgtaagcaaattctacaagcggcaaatgatcctcccaacatatcctctagagtttgaatagtccactcagattgaccatcagtataagggtgaaaaaccgtactgaatttcaattatcaaatgcctcttgcacagattcccagaacttagaagaaaatttaacatccctatcagaaacaatcgagcgaggcacaccatgtaacctcactacctcgcgtgtatagatcggtgccaagtcactcgcagaataagtggtgcggataggaatgaaatgtgccaccttactcagacgatctataaccacccagatggcgtcctttccttatgaagttgaggtagcccaaccacgaaatccatagcaatatcatcccaaggccatacaggaacttccaatgattgtaactttccagcaggactcttatgttcagcctttactcgctgacataccccacatgatggcacgtactttgccacat

SEQ ID NO: 7760 - DNA, 2406 bp, Oryza sativa
tcctttcttcttttgtaagctttgtacttttattaaagtaatggtctatatacatttacaatattgaaatactttccgagaatattagtacctactttacactatgttcatgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgcggatgagaggtggccgcttatggtgatagctcagtacgggtattcctccgcgccggtatataatcctaagttaatttcctggggagggtattcctccgtatttagccccggttgtatagtcatgacgggctgtcgtaagaaactcagcagtcaggggtggttactcgaagtaacaggagcgcatcggaaagagggtattagctagtatatcagttaacaagaatgtatgtgtactatgtatattagaagtataggaatagattatctgtctcttttctatccacttagcttagatgatttatcatgagaatgagtagttcatgcttgtgtgtcactctacgctttgattatcttaacccctgtttagaatacgattatcacaagtaatatataaattattagtcaagctctctctacatgatcttcccacgggataaaataaatacgatacccttagaatactctcgggtgaaatgctataatggtatatccatgcgcttgcggatgaactctgtaaccataatataccagaagtatttctgcgccattgctgggaattatatttttagtaatgtcgttaagaaataccaacaagcatttctggcaccgttgccggggaagattcataatagagataacttgaactaatactttttatttacctctgtataatcattttcctttgcaagctaaccttggttgttttcactatttgttgtggaaacagggtagtgaatgactggtttcaacctgtcggaaaactttaaagaaaatccagaagctttcttccggagtgtcaggccgcgagtcgttgctccgaagaaaagtttaccgatagaaaaactagcaataccagtgcccccgaccttcaagactatggctagcagaactcttcgtgagttcgctgctccctctgctgacaatgtggccactaggctgcaggtcaacataggagacgtggatttcgacttgaagtccagccttattacgatggcacagggtagcccgttctgtggaaagcctaatgaggatgcctatgcacatctgcaatagttcctggagatctgtagcacgtacaccatcaagggcgtcaatctcgatgccgtcaggctgagactgttcctgttctccctcctcgggagagcgaagcagtggttctacaccaaccgtgttgctgtcaacacctgggacaaatgctctacggcattcctctcaaaattcttcccgatgggcaaaatcaatgccctgcgtggacgaatttcaagtttccagcaaacaagggacgagtccattcctgaagcatgggaacgactgcaagagtatggttggaaagtataaagttctctgctcctgttgagtgcacttctctgattactcggatagcaaaagggctaggggtcattagcgaccaaattgcttttatctcagccgctcgtccgcgtattgataaagcttatctagtgcaagggcatattctgaaacgtggagtagatggatctttggtatactttttccccggttgtacaaatggaatcccgttgccaaatgcggggtatcatttgtacaactgccatgaactaaccattcccgtgcagaccatagaggaatctcgtgcaggtggaacatacagagagacgcgcaacatgacaaggaatgaacgagaaagttcatcatcctcgacacccgtgcagatgtatgaggcaggatgggcaccaactggggatgcacccggttggacccaagctccacgccatagcatcggagtctcaacttgggcaagcgccagtgaggatcggtggcatgcgcctcatgacatccaatggggggacaattaacctcccaggtcaagtggtgtgcctccatctccaagtgaatggcgctcgagttcttcccgttgggacttgagtgaaatcattaggagaatggacacccttgatatacagataggggaaatccagtacaacctcacggaacacgtagctcaaacacaagaatggcaacaatctgctgatgctcaattcgccaacatcaacgacatgatgcagcaatagcacgataaccttcaggtgtactttcgttttcaggggttcaatccttatcaaggacgctgagcgaaagccaagcttgggg

SEQ ID NO: 7761 - DNA, 3656 bp, Oryza sativa
cgctcccccccactgaggtaacttgtatcacattgcatatttctcttatcaaattacatatttgctttccaattgcatcttataaaaataaaaacaacataaaaatgtgcaaaatagaaaataccaaaaagataggataggtttgagtcatgctaggtaagacaagctagttctccttgttgaaatgatgaatagttgctctgttttatatctctgatatatgggttcttggtaagtgctctctcaaaggttaaatataagtagccaacaattatctgggaacctgaggtaaatgagctgcacttgctgatctgagtctaagttgttgcgagatatgagatagtaaatacgagttactatgatcctgatactagtttgacttgaattccggatattttgtttttaaaaatgataaatttgagagttcctcatttgatataaattcctaccagagccaaaaatatgccatcatgattaaaccatatacattttggttgcttgccattccattgaacattgtcaaactcttgtgacttgtatagatacttctcatgctctatgatcaagatcatacacccacatatatgaacatgctaaactaatacactaggagctaagcaatattccattccatttccatattaccaccaaaataaattctccatgctttcatatgcttttttctcctaaagagaaaagtccttttgaaaaaaaagaggagggaaaggcatggttatgaaaaaaaaaattcatgctccatcaagcttgatgtaacaccccagcccgtttgaagcctagtagtgtgtgtttggcccatgtggtgtttggcccatgtggcccagaagtggatgtgtagtggtggtttattaccaccttggaagtttaggtgggtgaggtcctgcttataagccttggtgctccaaccatggtatccctgggttaactcttttacacgaagcgaggacgaatgtgtaagtgggataccatgcgaacgtgggtccgctcaacgtgtagagcagactaatgcggattttggaggcagggtgttacagttggtattagagcgtaaacctccgctgtatgatgcatgtgctttgggccatggtctgcaccggagggggttctgggcctctgccatgtaaacggtgtgctgccggggcgttagcccttaagcgggggtgaatgtaacaccccagcccgtttgaagcctagtagtgtgtgtttggcccatgtggtgtttggcccatgtggcctagaagtgaatgtgtagtggtggtttagtaccaccttggaagtttaggtgggtgagggccggcttataagccttggtgctccaaccatggtatccccaggttaacccttttacacgaagcgaggacgaaagtgtaagtgggataccatgcgaacgtgggtccgctcaacatgtagagtggactaatgcgtattttggaggcagggtgttacacttgagcatgatgttgaaaagaaaaatgtagccatgccctctcctaagcaataaaagaaggatttttgggagaagaaagtaagcacaaaggagaagtgttttctttatttttcttcatgtaccatttccaccatacaccacacacacattttgcacgatcttgatcttgagtatgtttagtcatctgctttagtctaaatttttgacttagtaataaatgtgaatgcaagtatgccatgtttgatccctaccgagctccacatatcaaactctagagtaggaatcataaaggcaacatttggtgaggaattcatattgatacacttagagagattgagtgaatcaattgaagaacttggttttctttttcaaaatcatttgaaaacttccgaaagaagagttgaataaagattgggtgattggtactctaaattgctgttctttcttttaaccgcccaaggcaaggagaagcagtgtctcgtgggaatcaggggtaagggtaaccaccgtgccaaagattatttaatctcagagagagtacatataccttacacctgtatgtttgagatatgcagcatagtagcaactcctgatcaacaaccaagtctttgtttactttcgtccttcactcgggacgagcaaaggttaagcttggggggtgttgacggtcgttatcgatcagttgcgaccgtcaatattaccaaaatagaggagaactagtgatgcttgcaatgcatatattgttaaaataataatattccactagtattaggtacactaaccttttgtagagaatgacaataaagtggaggagaatcgacatcaactcagacgataaatcaatcggacggtgtcaagaaccagacttatgtatgaatgggtcaagaacttagaaataacacaacatattgggccaaaattcacaagtctacgaaggaggacaacaaaggaggccgccagtcgaagatgggctgggttgagccaacccatgtctcggggggtttggctgaacctcccgtggcgccgatggatgcagggtttggatggatggctgggattgatccccaatgacgggtggatggtattaccgaccattccaaccgtcgcaaccatcattacctacctataaaaggagctcctcttctcacttcactcacacacctcaaacaatagctctctcatttctctcaagtttagtttagtagtatctagctggtggaataggaagatagtagaaatcaggagtccggaagtcttcggaagagttcgggtatggctctagcagctttcctttcttcttttgtaagctttgtacttttattagaatactcttctatatacatttacggtattgaaatactttccgagaatacgagtacctactttacactatgttcatgttatactgaatatacggctagcttatctgggagatgctttggtgcgggtataatgtttgcttatgcaattactctatgtcatgacgatgatagtacgttttgtaccacagttgtcgctgccaccgtgtctctgttgttgtcaggacctacaaaaacggaatcggctcgctgccacggttctatttttgtagttttcagaagtttctgtcggttagttttggagttcttgagttgcatctggagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcgaatttttgtttggtgtcggtttcgagatctgtttggaaaaacggaaccggcataaattcagcattccattttttttttgtataattttaattttgggtttagacttttacatttgagtccctgtaaattttatatttatgtttgagtccctgtaatcttacattaaggtacttgagtcagtttttgttaaaaaaaatcaagaaaaaagtgagaaaaaaaaaggcagaaaggtgaaaaaaaaaagaaaacaaaaagccgcaccaaaaaaaaacag

SEQ ID NO: 7762 - DNA, 2345 bp, Oryza sativa
cacgtagtccatttaaaacaacctgtttcttccaatcaaaacaaggcaaactcgagataatttggttagcattaacattcctctctagcttgtatgttttatccacatgtacaagaggtttctaaatccgaacatatgtaaactctatgcaccaaatatattccaacatcattatattcaccaaagatatgaaaaatagcattagttggacatggcaaattagatttagcaaataatttctccttcaaattttcaagctcacaaaaatcatcaaaccgaacatacccaaagtatttaaagaagatagcaattcacattcctctatttcattagcaatgtgaacaacatgcttaaaatcaacacacaaagaaacaatagaaatagcatcttctttcaccagttgtggcatggatataagtgaagcattatcacacaactcttctttatcacaaggaacagcaagtaaatcaacttgtgataaaggcatctcagcaattggttccactaatggttgctcttctctagtatgaaaagtggacatgttcaattaattaacggcacagtcaccttgattaattgcagcaccattaagtttaccttttatgccacttcagataatgtaggtgcatcagtcttctcttctgtcttcgtgagcgatggagatggcatctcgatcatattgctcttctcctcatggtgaatgttctgagctccctgcaaaatgtcagtaataggaggcacaagcatagcttgtttctcccttgggttctttaaaatattgctctcaacactgcaagcaagcatgaacaagtggcctatatgattatatgtcacattaataagcctagcttgaatatcggaattaagccctctaaaaaatctagtcattgtgttctcattgctttcttttaaaccactaaaagtgatacaaattttaaagttatgaaagtactcctgcacggttttgtcaccttgttttagatgtgaccatggcaactacagataaaaccattgctcacatcatggaagaacaagatgatatcaagatcaagtcctccaagtgctggaatcagattcggccaactgctacgctgctgacttcaaacagccgccgaatcttcatacgacctccgttttcagcccatgagtacttaatggaaagcactcggagtcctctttccattggattcggcctcatcaccaaattccatccaagtcatccacaaatgaagaaacaaggtgctgcgtcacctgtcatgggcctatgggcttgtaactttgtttgggaccccggcccaagtggggcccatgtggggtgcgccccaaccaggtggaggacgacctagggtcctcccacctccttaaatagttaggtaccccttcagggtttctcgggttttgttagattaaagtttagccattgctacttgcttgcagcgcgtgtatcggctagactgtccgtctgcttgttcttcggaaccccaacttatcttgtgtattcattcttatttgcaatatcagattgcttttatcttgttcttgcatgttcttcgatttgcttgcaggaatatggttgatttgcaccggccagattaacaacccacagagaggtgtatcgatcgctaaggcgcaacacaatacgtctcgtacggttgtagtcggatcgtcaacgtttctcccaaatcgtagttatcacaactcaccgaaagatcgggccaacaacagcccttagggttcataatattggcacaagagggtgcgatgtttttgaccggaatcaaaaagttcaaaaagcgccaaaacatgatttctggacaaattggagtatattgggtgcgttcatagcaaaaactcacttcgtgattcgcgcagcaaacttttgtcaattaatgccaatattggcacacgagggtgcgatgtttttgaccggaatcaaaaagttcaaaaaaggccaaaacatgatttttgaacatattggagtgtattgggtgcgtacgtggcaaaaattcacttcgtgattcacgcggcaaacttttgccaattaatgccaatattggcacacgagggtgcgatgtttttgaccgtcaaaaagttcaaaaaatgccaaaacatgatttttggacatattcgagtgtattgggtgcgtacgtggcaaaaactcactacgtgattcgcgcggcaaacttttgtcaattaatgccaacattggcacacgagggtgcgatgtttttgaccggaatcaaaaagttcgaaaaaggccaaaacataatttctggacatattggagtatattgggtgcgttaatagccaaaactcacttcgtgattggcgcggccaacttttgt

SEQ ID NO: 7763 - DNA, 550 bp, Oryza sativa
gctcgaggataaaggcctgattagttaccaaaaactttttctcaaaaacatcgcatggaatctttggacacatgcatagagtattaaatataggtaaattaaaaaactagtaagtgctacagtaacccacatgtgctaatgacggattaattaggctcaaaattcatctcgcgggttccatgcgagttataaaattagtttttttatttgtgtccgaaaatctcttacgacatccggtcaaacgtctgacgtgacactcaaaaaaaattcttttcacgaactaaacaggcccaaagtaaacattctggcaacttttttatgtagatgctgtcttattttggtttttaaaaaaatgaactcatgtgcctatgtcgtcatctccacggcgaactggttcaagaagccgtccttgttccacgcactactagaaaaagcattcttctcgacgtgagggtcttattttcgcatgccgacatgacccttagagggaaatgaccacctacaaagatataaatcggagtgaaatttgctggccgcctgcgaaaataga

SEQ ID NO: 7764 - DNA, 711 bp, Oryza sativa
cgactgccgacggtaaggtgcgcgggcaggcgaccgggctggcgcggcaacggcgcagtcggcgcgtgcgtcgactggcgacggcttgcaacgcgtgggcgtggcggctgggatgggaaggggagggaggtgaggagatgagatagggttagagaggaagtgtgcttttttcttctattgggccaatgggcctgaaatggtgggtggtgggagggttcagtttgggcttcttttcagttttgaatgggtataagtatttttcctttttttcctatatatacatatggaatatatacttcatatatgtatttttgttcaaaaatcttgggtattcatttgaatacctattaattgaattgggcccgcccctgagattattgtgcaatcctcaaactccacatgcgtgatcgatgcatgatcaccaacgaacaaaatggaagtcaattagcaagaagaaaatctgtcagcgtcagtgcttacactctcaggaagacggtatccatggtcgattggaaccagggagaggccatggccttgttcgtctctgcaggtgaggatgttgccggcgtgcctgccggcgttggccagcctgatgtccaacacgcagatcccatctcgccgagcgctggcctcagcatcgtcgactccactccggggacaagggcaccaccgccggaggggggtggcgaccgcctcttcatcgagccgaga

SEQ ID NO: 7765 - DNA, 2925 bp, Oryza sativa
ggtttctccaccagtgaaacctcccaccgcggtccgccacaaccgtccacgtattccgctgccctcacagcccgtgggggatagcctcaccgacaagctctccccaccaccgcggatcaagttgtgcctatgggtggttgggggtgtcactaccacctgttcagtaagagctttttaggattggagaaatttaacggtgctcgacacaatgcctgaccgggacatggtctcctaaaacaccatgctcaccgctgcactgcatactcgtatcgaaatggctctttggcgatcagtcgtgcaactctgtagcgcttgatcagatctgccccaccattattggcccatgtgtttttgtccacttttggcgatgcgaggtgcctaagtcatttttgtggcgcggtgggctcggcccattttcaattaattttcgctcggttcagcccatcatgggcattggttgtgggaggcggagcaccccaaactgttaaaaaaaatgagtctgttgcattttgaacattttcatttttcctattcccatccatctctctatttttcccactttttttcctagagagagatttgaaaagaggcgtaaggcaggggtgtcgcctgttgggtgagagcttttttggattgcggaagtttaaccatacatgggagaaggaagaaagaggtaggaggttggcggctagaggaagaagacgatgatgagtagtcctcatgacatgtatgcaaaaaatgaaaaaaaaattaagaagcaatctctctccagtgacaaatttgtatgaatagataaggggcatatagagagttgtcaaatctaatagtgacaaatagttaaattacttcccaatagtaaatacgcacatttttttcctttaataagcatgatgcttccatttttgtttacttctcatcttggaaactcacgagatataattatatctctcttcttcagacgtcggcgtccacacaaacgtcccacacagttacgatgagtccaggttgccgtccatctaccaagcacagagaaaggaattcgaggtagcaaatcttcatattcctttccgcgtcttaagtttcaaaaaagcaaatcttgttaacaactggggcacttctatgtagccattccatcagcctggcttcgcactttgttccttggaagccatttatcccaatttccacgagatgtggtaacgagacgctgaggtaatcggcttgattaccagcaggatctgttggtttcgtctgctcctatacaattaaaaggagagaaaaaaaatccgagagttgttagcatatcaaaacttgtaatgtttaattttttttaatgaactgacaaactgtgctaatttcataatgtttgattgttgtaatgttaaattagcacatttgcagtgtgcagcaatgcaaattaaccctaacaaaagtttatcgaaatagacgtcgagatcaattcagtaagaggggacttaccacaagataagcgtcgttcatatcttagagagctccatcctggaaggcgtgcatgctagccacttgatctgttgcatgttttagagaagtttgatgagttatattttagttatacttcagttacatcctagttacaatatagttacaatgtaactacaatgtaactgcattgtaactacatcgtaactactatgtaactgaactgtaactacattatcatctctatataatttagatatagtgttacatatattattttaatatttatatacgagttacattatacttatatataaaattatattgtaattataaactgtcaacagtttataattggctcgttaaaaaactaggaggaagagcaagttttctccttaaaaaactgtcaacagttctctaggtagtccctttgtatgctcgtctacatcagaaaaagtctcgtcctcgggagaaaaaggatttaccgtcaaagatgtgacaagaggcaaatgtggtatgtcgttcatcatcatcacgtcatcaatcaccccttcctcttcctcctcgccttcctcatcggcatgagataccttacaagcaaggtggacatcgagggattcgacggcggggcatcgccggagaaggcgtccggagacatcaccgaagccgatgcggagcccatcagagctcaagtacagatttttgaggctccgcacgcacgacattatgtcgccgacgtcgagcctctccaaagtttcccagttgaaggatgatttcagctcctctagccccggcgccgacatcgtcagcgtggtgtggtggatgaagtagcattcaatgccaagaacacgaagctttggagtgttgagctccaccagggtcaggcccacgccgtcccagatcagggacagctccaggagctcgccggcgtcgagccgtagctccttcaacccgactatttcctccagggctagcttctggaggcgcgggcagcacgccgacgagaggaggcggccgagaaggtggacgtcgtcgagccggatttcgttaagtgaaagatccaccagagaatcgaacgccacggtggccgggagaggaagagttaggtaggtcagtgggccatggactccagcatcgtcgagctagggagctcgtccaggaccaaaccgtcggcgtcttcgtcgaagtcgtaggaccgtcgctgttcaggcagtggcagcaggttgggctggtcgagtttcagggcgaacgatctcaccccttgctgttccatggcgtaccgaatccacgcgttggcgtgtgcgccgtggacggccggcacggcccgggcgcagcagccctcgtgcagctcgatggagatcgtgagctgctcaacgccggcgcggcgcgtggcgtggacgcggttgacgaaggcgacgaaccgttcgacatcctcctgccgcttcacgtcgcctgatgggttaattagat

SEQ ID NO: 7766 - DNA, 15422 bp, Oryza sativa
taccggtgatccgtcgacgttgtctgtggttcgtcttctcttccccatgccaaccagaaggcaatgtagctgcacgggtatatacttttttctttacggatatatataatttttttatggaaactgatcggatatattacctttttttaatgggaactgatcggatatataacgtgatatttctatatacatccctcatgcgcgcgaataggtttccctcgcgtgtgaaatcgaatcccagtatagatgactataagacccgcctggcacggcccggcccagacacggctaggcacggtccaccagcaatcgggtcgtcacggcccgatcggcacttcgtgctaggccgtgccagctcatggtctgcacctccagcctaggcacgacccatcagctgtcaggccgtgcagtgccggcccgaaggaacgtgtggcccatcgtgccttcttaaaataaacctattttccatctcctctttgggctgtgacatatatatagctaaaataagtctattttccctctcttctctttgggctgacacgtatatagctaaaataaatctatttttcatctcattctttggaccgtgacatataatatgtctaattttactccctattgtttatgtgtcgggtccggcctgccgacccattgtgccatgctggcccagtcatgccggaccggcccaacgtgccggtggggaggcccatgcatggcccggcggtcatgggccgggctaaaatatcgtgccgtgggctgggccgtcggacatcggacattatggccatctataaatccaagtatagcacttacagcaactccagtgtatggacaaatcgatccgtgagacggaaaaatcgtgtgtaatatgtatctagagatgaaacacaacacaaacacagcacattaaaggcccaggaaacggtaaattgatgtggattcgaatttaaaaatagagtaaatttcacaaaactacacattttatggtccaagttgtagaaaaccacacacactttaacactataagtacatatattttattagtgtagttttacaaaaccacactatcaatgaatggattcacccgtgagatgacgtgtttgtttcaccaggacgaggatgtggcatcatattactagccatcgcacgaaattaataggatggcacgtcctcatcttagatggaacaaccacgtcatctcacgggtggatccattcattgatagtgtggttttgtgaaacactaccaaaatatatgtacttaagtgccaagtgtcaaaatatgtgtggttttctgcaacttggaccataaaacgtgtagttttgtgaaatttactcttaaaaatattgggctaatagctaagcccaataatatggggtaagggatttattggagttatttacggaagaaacaacaattcaagatgtgcgatattatgcgtataattaggaggatgccacatgttggacatctgataatttcacaaatatcgaatactcaacaccacacagccgtgcgcctgtagagcctacaggcatgcatacccatgcaggtgcatgtgctgttgtattcccctatctaccgagtagtgcattgttgcattccttgccgctgcttgagcgaggactgaaaagccgtctcgtagatgtactctacccatggaagccagcgtagccactggcagggacgatctctggtgaggcagcggagatacatggcgatgaccttgttcacggcttcggtctgtccgtcggagtggggatgaaatgccgacgtcatgtggagcttggcgccgatgagacgcataagctcaatccagaatagggaggtgaacacggggtccctatccgagaccatagactgcggcactccgtggaggcggacgatctcgccgaagaatgcttgggccacggactccgccgaatatgggtgcgccaagggtatgaagtggcaatacttgctgaagcggtcgaccaccgtgaggatgactgacttgccgcccacgtggggtagcgcctcgatgaagtcgagcctgatgtctgcccaaatggacatcggcactaggagtggaaagagtttcctagccgagtgaagatgttccgacttgtagcgctgacaagtgatgcatgcgcggacatggtcctggaccaccgtgcgcaggttgggtgagtggaagtcgcagcggagtcaatgaagagtccgctgcaccccctcatggccgtcgccgtgtaccgcggcaaggagctcttggagaagaggtgaggccggcgggatgtagaggtggccgtcgtatgtcaccatgccgtcggtcaacgcccatggggcggcgtgctggtgcaccatgaactcctccctgagtgccaacagcgtcggatcgatgtcttgggcttggcacagacggtcgatgaagtcgaaccgcggcccagagatggccagcagcatggtctcgtcggtgtcgtgtcgtgacagggcgtcggccattgtattgttgacaccggccttgtactccactgtgaaatcaaagccgagaagcttgccaacccaatgatgctgttggatggtggccaaacgttgatcgagcaaaaacttaagactgaagtggtcagttcttacgaggaaccggtgaccccataggtacggtctccattagcggatgacgaggatgaggccgatcaattcctgttcgtatgccgccaaggattgatgtcgcagggtgacggtgtggctaaagaatgccgtggggtggtggtcctggaggaggacagcaccgaagccataggtggaagcatcacactcgacaacgaatggcttggcgaagtggggcataacgagcaccggtgcggtcgtgatggctgtcttgagggtggtgaaggctgctcctgtctatccgactaggaaaacccttcctcgtgtagcagtgcggtgagtggtgctgtggtcgtgccgtagttctggacaaacttgcggtagtagcccgccaagccgaggaatcctcgtaccacacgcaccgatcgcggctgtggccagtcggagatggcttgaaccttgggcgggtccatggcgacgccctcggaggagaagatgttcccgagatagctgatagaggagacgccgaaagcacacttggaccacttgacaaagagacggtgctgctgtaggacttagaggacagtgcgtacatgacgtaggtgggctgcccatgagtcgctctatatgaggatgtcgtcgaagaaaatgaggacgaagagacgtaggaatgtccggaggacgtcgttcatgagtgcttggaatgtggtgggggtgttgcaaagcccgaacggcatgaccatgaactcgtagaggccgtcatgtgtgcggaacgcggtcttggtgacgtcggcagcattcatcctgacttggtggtatccggagcagaggtcgagcttcgtgaagaagcgggcaccgtgtaactcgtcgaccactggaatagggtatgcattcttgaccgtgatggcgttgagggcgcggtagtcgatgcaacatcgccacgacccgacatctttcttgatgaggagaaccggtgaggagaaagccaatgtgctgcaccgaatcaatccttgtgtcagcatagcggcacactgccgctccaactcatccttgtgggaagcggggtagcggtaagggcggacggccactggcgccaagcacgaacgaggttgatgtaggggtcccgtgatcgaggtggaggcatgcccattggtttggcgaagacggtggtgaattcctcgagcagggctcccatgatgtcgtggccggcaacgacttgcagcgatggggccgtcgagcctgcaacaccctgccaacatacacggtggtcgtgccgccaaaaagacatggatcgtgagtcgaaatcccacaagatctacccaagggacgccagccactgcgtgcccaggacgacatcgtagcccgccagcggcagcgcgaagaagttggcgtggaaggtttcggcgccgatggtgaaggccgtgtcgcggtacaacctcggacatggaacgcgttcaccgttggcgactgtgacctgcatcttgccgcgagggaggagcggaagcttggtgccgttggcagccaatgtggagatgaagttgtgggtggaacccgagtcgagcagcgcgaggagtgcggcgccgccaaggtcgatgcagacttgcatagtgtcgcagcaacggacgcccgcaatcgcgtggagcgacacctgtggctccgtctccccggtcccctcttgggcgctgtcgtcgtcgtggtcatcgtcaggcacggccaagtcaaggaggaagaggcgttggcagacacggttgtggccacgcgagaacctgtcgttgcagttgaagcacaagccgaggccacgccgttcctccatctcagcctgagataggcgcttgaccattcggccctcaacggtcaccgtggcagggtctgacactggtggttgaggaggcgccggcagggcgagttgctggggtggcgccggcagcaggccccgctagttttggcactggttcggaggccctggtacggcagctgcggcgcactggtcgcgcagctcgagcttgcgggcgatgctcatggtgaaggcgagcgtctgtggattatggatctcgacgtcgaggctgagcggtggttgaaggccggccatgaagatttgcatgcgttgttcctccgtgagtgtgcctgcgcgaggcaagagagactcgaacttgtcttggtactcgatgacggagtttgtgcgagaggattggaacataggggagggccaaaacggaggtggagcagctcggtgaagcgacaccatggaggagtgccttcgtcttgttggacttgaatgtaccacatttgcgtgccatcttccagggtttaggaggccatccaaaccttctcctcatccgcaatgcgctgctgatgaaagtatgattcacaacgattgatgaaggcgagaggatcggacttgctatcgtatttgggaaaatccatcttctgaaagcgaggaggccgatcgttgtggtggtcgcctgaggacttggatccggaaggtgcagcctgctggagcgaggtgacctaagtctggagcttgtcaacggtggccgtgagcaccttgatgagcgcggcgagctcggtggtggatggtttagccatggtggaagtgatggatggagtgggtgacgatggtggattggagtgggaggaggaacgcctggaacctgataccaagttgtcaagcgtgtcggtgccgaggatagccgggccgcggctacgcagtttgtagctcgactcggttgaggtgtcaggaaccttccctgcacacccaatggtggaagaagggagattaggaaaagttgattgatattgcttgcctttagcaaggctggatacatagtttatattggctcgtggccatcttaatacaaggaaatgtcattattcctcctaaattaactctttccttgtttgattctttccaaaggactattccttgattggtgttgcttgctatgcatgcggttgagcaccatccagcttgcttcagcgctggtagtaatgactccacatgacatacttttccacgcctcatccctgaacctctccatctctactctcctgtaacagaataggaaaacccaatctggcgatggctgtctgccgccggtgcccggcagtgctgttcctccgttcttccttgcacaccggtgggtcaattaacctcagtcgattcttcttgcagtttatttattgcgcattgaatcaatctaggtcagtagatcgccttctctccttaattttcagtcaatcaacaagttaggcaaactcaaaatccccaatagcttctctgtagtttggccccctattcccctccatttccagcagtttatcgccgccataagggctcgtttaatctgcaagagaaagggggttcagagaggattgagaggaaaaaattccacaccataataggtgtagaataaatccttccgaatcctctcggtccacttgtgagagagggattaaaagaaggtcttgttcggtttagaggggattgaagaggattggaggggattgagggggaataattccacaccataataggtatggaataaattccctccaatccctccctcatggggattaacccaacaaggcctaaaggggtagggttccactacctcccatttccacttttctgatttcttggttgaaactctcgatggtcgccggcaagtcctccttgggtcctcgtcttcgtgatcgcagttgttgctgcttgtagtgtgtccgatctgcgagtatcctggtagtgtgtaaacttgatttcatcaatgcacagctattgttattctgaagatccaccaagcataatctcaatgtataatttttaattcactaaattattctcattcctgattagtatattactgtttaacataacaaggcacatatgtagatggagatcgaagaattgcttgctacgaagtatgaacttgagtgctcaaagtatgaagtgaaactcactagctcttagcttctcttcccaatccttttctcaacccaactcccttctcttctcaaatctcactcacaaagatctaccacttagctaggggattagagagggggtatgtgacttcggatagatatgtttcaaactcaagaatagccatcactaatggaggggtggaggagtttatataccagagcccctgaaaactagtcgtttctggcaaagattccttttttggatgtgccgaaatgcatcaacagaaaacaatcttagttttgcagccattttcggaattttcgaaaatttttggtcttttcaaaatatttttggacattctgaaaaacaccagagagcaaaatggccataactttttgatcggaagtccattttttacgatcttagactttatggaaagctcactcagaggattacccaactcaaccaaaaagaaggtccaaaatcactcaaaggataggttaatgggtttctctcaaataggtcactttaagcaccgagacatacaaaaacacatcgacgttgcatacctcttaatagtatggcattctatcctcaaatataaataggaaaataattataccaataggaatgtcttcatgccatcttcctttatttgtcttaagggatgccaacaccaaaaccatttcatcatatattcttcaaagatcgatgtgggctccttgtagcttcaaatggcctcgcacagcccatcatgacgaagccgtcaatcacccttcgccagcggttttggtccttcagtgccaagccccttgcttcccctttaccgacacatggtccatggcgggcgagcatcacctgcctttcaccgtgtcgtcttgtccatggaccatagtctttgtgcaagcctatgaaattgagcgagtttggtctaatgtgtgctccaataattttttaattggaaaaatatgtaccagatatgaaatgatgtagggatttgatttgtttttgttttatctagtaggagcaaatttatttaggaaaaaatgggagttcctttagaaatcacgtggattagttttatagccttttggcgaaaggtactgttgaacatataaagacttaggctctgttctatttcttcaactccaatttcaacttcctcgttttccgttagcatgcttttcaaactgttaaatgatgctttttaaaaaaaaagtttctagaagttgatttaaaaaagcaaataaatccattttttaaatttataatagttaattaattaatcatgtgctaataaggtttctcattttgcgtgaatccaaaatttatctccatgttgagatctaacggggccttagggtccgtacctacttattggggtttttttttccttttggataggggcaaatgcaggaagcaaaatgagtgggggtcgacagtctacaacttagttagaataggttaatgtatacataaaaatgataggggcatttgcccccacgcgatgtagagggccaaggccccccactgagtatactctaatccgcacaagcatttagcccgattgtcatgaaaaattataccaaattgttgacgttcttccaccttttcccttatggcctggttaagatcctcaaaacaaatctggcattcaaaacttgtgacctcagatgagcactcagcaaggccatatatggtgtagttgtagccatttgctatgagatttttccttcatgtgacaaactttatagacaagttagttgccttacttgtcaaggcaaaaataagtaatagaacaatatagttatattatgggttctaaaaggaaaatgggtcgcaaagtattgctatcttgtctatatttttagaaatattgaaatgaatagtgtgacaagaaattctaagcccacacaagtcgtaaaagatggtagcttccatctttgaagctcaaactatttgcacgttccgtattgcatacataacacaactattgtctgtagtactactaatatcagcacgacaccatccaactgcttatatctcctcttttgtgctattggccatgatcattgcaaacaaatctaggatagatgagaccttaagtggcagtgtcattgataaaaattgcatgtttcgcttgtatatattgtctggtgtgtagtttttgccttcacaatgaatctaaagataattggataatcccgtgacatatccagataatagtagaaatcctagcataaccagtgcaatcgccatcatttcaggtggttgctacacaaatctaaaatcataattaaaagaaagttagttcgacttaaaataatgacaattacatttttcttttaaaatgacatgaagagggacaaactctttctaactattttttaggggagctctttcaattctaaattttgagagtatattctacagttggtcttatcatgaaatgtgtttccattttatttttaaatcaattagatcatggttcgactgatactctccatcataaagcaactcattgtatatggttgttagagaatgaaacctcctcacttggattgtgtcagtcccatttctcttttcaaatccccattttgctgcagccttttagaactttatgctaatctaacatatttgttatgatttgtacatttagaggatcatttgcttggctactttatatttctgttggagttattcactgggctcaatatatctattgcctctcaatgtctggtcatactagctaactctgtgctctatactacggttggacttggtgactttatcatttaatttgatcacgcttttcgaatttctaaatgatatgtttcgtaaataaaatatattatagttaatacttaattaatcatatgctaatcacccgtttcgatttctgttcctagaactacttaaacaaaaaggtattatgaaacaaagccattatttcaaggctcgtacttatggaataactgatacttttgaacagggcaaatgcgataagtaatagggggcatttttttttgcagctataatttcaaggttcagcttcctatttttttgtgcataacacaattaattcattccttcgagtttttcctctcattaacatttgtgttgtactgaaaatgcagattttgttcggttcgcatgcatgctcattgttgctgtggacagagttacatggaaaatggaatacacttactcacttggccagtagctacaagcaagttaatcgatgtttaattttttctatcctcaatcaggatgcattgattggtgataactaattataactagctagcttcagtagtcaccgtagaaagggttggcacttttacatgctaccatcccaataagtatatgctatggctctttgcatgttatacccatatgtgatcaagtacttctatcatgagcagtaacaggagtgttccttagctaaatcagtttttcaataatcattacgttcgttctcttttcagtatgtagtgtttctgaaagactatatataacttacaacttcctagcaaatatattaatcactgaaagttatttacaataatagacaaacatgcatcacaaattctaagccaaattgccacgtggctgttaaaataggtgccggtttttagtttaaagccggcacctatttattgggtcaaaaaaaattgcagtaaattcatcaacacaaccccaattccatataaacccaaattcatccctagagccccacattcatacagcacattcattcccattcccattcatcacaacaaataaaaacttactagccattcatcacaagttcataacatataaaaacctactagcttaagtcaaaattcgtaagtcaaaaaattcttatctttaaatcctaaacattggcatatataaactaactcaaaatgtgcctagtttaaaattcctaagtcaaaagattggtaagtctaaaatttttaagtccaaaaattcttaagtctaaggctgtgtccggcagcaagttttcccaactcctatctctcgtgttccatgcacacgtttttcaaacggttaaacgatacattttttttgtaaaaagtttctatacggaagtaacttaaagaagtcatattgatctatttttgaagaaaaaaatagttaatacttaagtaatcatgcgctaatagaccgctctattttccgtgcataggatacttgttcccaaccagtcctaacgaactcggcctaaattgtgaacattaatttgcacatatatccttaggtgagaaattcacaagtctaaaattcaaaagtccagacaattgtaagtgtaaattctagacatttgcatataattcacattcatatcctcgagtaaagagcaaatgagatattgctgagactcagcgcaccagtcaacttcagcctgagacgtgcccgtcaaaccacacgaaggcgatgaccagatgtgttacacatcccaggagacttgactaaatcgcttgagctctacaacatctcagaaattcacaagtcaaattcgtaagtccaaaaaattgtaagtgtaaattctagacatttgcttgtaagtgtaaattctagacatttgcatataattcgcattcataatgaatatttacctttaggcttcaatctttaaccaaacacaaaaaaaaaaagagcaaaacctcctcccctcctctagctgatcgggcaagaacgagaggtgccgctctcttcttgctcaatcagctcgagtggcatgggatggagtataagtactattgtcggaacaaaggtgtcggtttagacccaaaaccggcacctttgtcttcctaaccggcatctttgtgttgggcatgaaaagcactattggaacaaatgtaccggttctagaccaaaaaccggtacctttgtcttcccaaccggcatctttgtgtggagcataaaaagcactattggaacaaaaggtgccggttctagaccaaaaaccggcacctttgtcttgtcatagcgtgtcacgcccggaaattcactagtaatttccaaacttatttgtgcataaaactctcgtccaggaatcagccgaggtacacaaactgacaatttaatatacaaatccatcataataatatcgttacatacttataaaagaaatgaaaacaacagcggaattaacggtctagcgatggcttcagctccactcacacaggcagctcaactggggtataagccaaacgtcttattcttctggatcatttttcttcaactaaggttgattgattattgcaaggtgagcatatgacatactccgcaagccgcacagtaaatatgtgcacaaggataccaaaggatggcataatataggctcatttgcaaaagcagcatttagcaaaaatattgagaatgtaaaacaatagagtaattaatcaattttaatcaacattgaacagcacacccatgctgctcaggcccaaccattctgaacaaccatatccagttgtacagatctaactccaaaccaggagctaaacaaattattaccaattatagcatcaataattattgtgagaggtgtgagactaatcacgaaaaacattgctcaacccgcccatgaccgcgggcacggctattcgaatagttttactttggccagaggtgtaccattgtacccacaagatacagccccaaaacatgtcaccatgctctcagtaccaccacggtacctcgaaacggaattgtgacagtacccttcgcacaacaactcatcacagtgcaccattcctggatcataatcaccccctcaataaccagaggcatggactccccagcgacccccacggacttctcgccgcttctcagtctggtgccccgcaatgaatcatgctatacaaaaggtaaagccgttgcccacgctggcttgtggttggcacggttaatgtctcataacagtagctcgcgaaccggtccttaattgttatgagcacgaccttcaaaaccatgtgctcacaaccgccctttgccaagttttaattatcaattaattatcataacacgattaaccatcatgagctaccattaaatataaccataaataataatgtagtatgattcatcccattaatgagctaatgtttctaggcatggctaagcaattatatatatatatatatatatatatatatatatatatatatatatatatatatatatatatatatatatatatatatatatatatagcttttagctgaaccaaaccaatatataaggttcaagctaatcaatttattacccaaggtaacaaggaatagagtaatcaatgcgaattggccattacaaaggaatatgttcacagttgaaataaatacacagttgaaataaatagagaatttaaatataggatcaacatgctcaaaggaactgtgtttaggatctgtgtgacttgccttgcaataatcggtcttcaattagtcttcagaaccacttccgacgcactcgcgaacctttcgcaacgacggaaacaacaagctaacacgcaaaatgggaaaaaagactaataaaaaccaaataaacagtacataaaagtaaacaaacatgtagatcatgattttagataattttagatgaattccaattaaacctattaaagaaaatactattccaaattaattaaaccatttacaaatgatttataactgagagaaaagattaaaacaacctttgaaaaagattagattatatttggtagatgacatatagtaaaaagaaataatatgccattgaaaagagagaacggatagaagtctcaccgaaccaaagtgatcggagacgaagggatgatgacaacgttccagcagcaacacacggagatgacaacgctagaccaaccacggattagattatattggattaagaccctagggataaactacaccggtgaacgacataagagcggcggttgccggcgaaccacgacacaataatgcaaacagagggcaccgggaggtagaggaggcgacggcgattcttaccaacccttacgtgatgacggacagcgacggaagacggccggcgactctggacaacagcggcgacgaccaacggtgatgctccaacggaaacaaagggcacaggaaggaataggaggacacagcgaactcacctgtggtggcggcaacgagaaacagcgacgggagatggccggcgacaagctccaaaaggcgacgaggtactgtccacggtggcgacggcgtttcggcgaccttcggcgacaatggaagggtggccgggcttcacttcgcagctgcgaatccaatggacttcgggttgatggcgacgacgggcttcccggggtcttcggcgcaagggaaccagctgctgggcttgctcttgaccttgcggagccgagagatgtggtggcacaggagggcgtcggctgaggcggcggcaaacggcggctggagcggctgccggcggcggagagagaagacgaacgcggcgacggcgctacaagcgacggtggagagagggagaggtggcggccgaaagaggagagggaggggacactatttatagccacgggagagagagatcaggcttggaacgcaaagaatcgcgccgggaaaacctagggtttggtggagagataaactcgaaaacgaatccaaattcgcgtcgaattcaaagggataaagtcggatttttggtggaagagatagaggaggataagaggaatatttcccctcaactaattttaggaatgcacgagagataaggccggattcggaggagaaaaaccgagccaactcggtctcagtttggcagccaggggttgaagatgaacagtactagggacgtaaggtagactttctctgtgagcttcctttactaggccggattgaaggagggaccaaaaatggactttggaggagggatcaggccagccgaaaggaagggagaatgagccgaggactaaaggtgaacttttccagtttcagcctgaaaaggaaaaagggattttaattacttttccaattaaattaatcactgaaatgatctttgaattgttaaaaatacttccaatgctcaaataatttcaagaaaaatcctgaaaatacttggacacccaaagtacttaacaagattataataagaccatttaatgattaatttaatatgtggataattactgaaatgttctttatattattaaaattaggaattgagctccgaaaaatctgagaaaatttcagggagtataattaatcatggagaattaaataaaaattaaatcccgccatgatttatatttagaaaattttatttcctatatttaacttcacttgtaaattaatgaacatttaatataaattctaataataatttattaaataatttataaatcctaaaacgaaaatcaggatgtgacatagcagctagtgtgggagggagaatattaaaggtgccggtttttggtcgagaaccgacacctttgtcttgtcataccaagaaccggtacccttgtgtagggcccaccgtcgttcataaaagcactattgaaacaaaggtgccggttttgggttgagaaccggcacctatgtatggggcccgccaacggctagtgggggagggagaagattaaaggtgccggttttgggtctagaaccggcacatttctctgacataggttttagttgtcggttttatttaaaaaccggcacatatttggacataaaggtgtcggtgttttgtgtgccggcacctatagtggcgacatctatttgccttttttaagtagtgctcgggctagatgtgacatattctagtacaatgaatgttcaaatttgtagtactgtactagaatgtgtcacatccagtattacgttagtttttatggaacggaaggagtataccatatcattttatt

SEQ ID NO: 7767 - DNA, 32015 bp, Oryza sativa
caatagcatttcatggattatctctttgtttatcgtagtgtatttgggtttcatagagaaatgctgatcgtgctgatatatctagtttgctttagccccatcttgatgtaaatcatggattcgccactggttgctgatcctgcagtgtcaaagcagtcactatgacacgtctaatcgatccttagctgccatcagcatcagctgagctcaaatcaaaacgcacaatcgatgagctgcaagaactaggtatggcaagggggcgagacaggtgcgggtccaccctgctccccctgcgagtccacccggccccatcctactagaagagatgaacccgggcctcgtccctggcctctttgatgacccgcaccactggggcccgcacagcgtgcctcactcacaggcaataatagcgattggtgggagatgaagggtgcggtcggctcgcccccgttcacccacgggtgataattagggggctgtttggtttccaggacttatttcaagtacctgtcacatcggatatttggacactaatttggagtattaaacatacattaattataaaacccatttcataagcttagactaattcgcgagacgaatcttttgaatctaattacgccatgattttgacaatgtgatgctacagtaaagttttgataaatatggattaaataggcttaaaaaaatcgtctcgcggattagctctcatttatgaaattagttttttttattagtctatgtttaatactctaaattagcgtccaaacatccgatgtgacatgggctaaaaagttttagtcccaactgaacacccccttatcccccgatcccggcccttagggtgggtctccgaccccaacagggaaatttccgcctctagcaagaacttgacgtagccgatcgatgatctcatccaacatcgacgccttgatcatctacaagcaaaatcaaaccaaatcaagggcatgtttggatcttcagctccaactccatctcttctaaagttggaagtccaaacaaaaagttttagctccaacaataaaaaaaaatagagtggactaaagtgctctcacaaaataaactcaagaggtgaagcttgatttagaaagacttaatttttagagttagaactctatcaaacatgtcttaattgttcaggatcacataggttgacgtgacgtagattaaggtggtgtttggatccagggacttaactttagtctctctatttaaacactaatttaaagtattaaatatagactacttacaaaactaattacataaatgaaagctaatttatgagacaaaattttaaagcctaattaatccataattagagaatgtttactgtagcatcacataggctagtcatggattaattaggcttaatagattcgtctcgcgaattagtccaagattatggatgtattttattaatagtctacgtttaatatttataattagtgtccaaacatccgatgtgataggaacaaaagttttagtcccatctaaacagggtctaatttggtgagggttttgataacgaggctgaacccaacagtccactcgattcatgtgactttttttttaaaaaaaatgataattttattgccacaacacaaacacttcttccaggaggaatattaactccaaggttcacacaattctcactcacttccctgtggaccccactccactggtcccaagcctccccagcccacgggccataggtgacagccctacaccagaacagtgccatcccatccagcccagtgcctcctcaaaaggccaaaacagcaacggtaaggtccaaaacagaagcatcctttcccagtgctgagaagcagcagcagcaagccagcaccagcctgccactcctcccatcccatcccatcccatcccatcccatcccaatgccagtgaatgctgtcgccacgcgtcttcgcggcacccgatgctactctactgcctcccctcccgaacgttcgaataccccaacggctacctccactccaccaccctatttatatccgcctcccatggccgccacagcatcatctcctcctcctcgttcccctgtttccctcctctcgtgctctcgtgttctacttttgctagtcctcccaccctacttcgatggcgaaggtgttggctaccgtgctctgcgccgcgctggccttcgcggcggccgtggccgtggcgaacgccagggacctcgtggtcggcggcaacaacggcggcgggtggaaggtgccggcgcaacccgacgcgctcaacaggtgggccgaggccacccgcttccacatcggcgacaacctcggtgagtcaacaaagctcgattccttcctcagtgtttcttggattcctctgtttcttgatttgttctgatttcttctccttctctggttgggctggcgcagtgttcaagttcgacggcgcggcggacgcggtgctggaggtgacgcgggacgactacaaccactgcggcacggggagcccggtcgccacccacaagcccaccggcggcgccgccacggtgccgctgacgagctccgggtaccacttcttcgtcggcgccgcgccggggagctgcgacaagggcgagcgcgtcatcgtcctcgtcatgtcggagaagcacagccgccgcggccaggggttcttcgcgcccgtgccggcccccgcgcagtccccgctggccgccggcctcttccaggcccccgccccagcgccggcgactgggaacgccgggaggaccgcggcgagcggcgccgtgctcgttgccgccgccctcctcggcgcggcggtggccgggttctgagaagatggcgttcgcttggggctttaggaacttggggggaggatttggggattctttgattttgtctagatttggttgctgtatgagagctcaagaagaaagtgcttcttctgtctgtagaagaaggggcttttaactatttaccactcttacgagtggtgcttaacgatttgccactaagcccacgtgtcataaacacatgagggcccacatgtcattgacaaggtgtggtaaatcgttaattgacatgtcacaagagtggcaaatagttaaatttcccgtagaagaatgggggtaaatttataaattataaatgaatgatgaatctatctgatgaacctggttgcatcaagatctggttttagtctggtcttttatggttcagtggtttttcttcccgtcctgattaatcgccttacggtctcaaattacaacaaatcaaaatgaacaaggacgaagtgtgtagcaaaatcataacatatgtttagcaaaatccaagccaagcaacagtgtttccagcattttgtttaagctgttaggctgtttgcataacagccgcctgcatactcggacctccctcatctgatgcgtccagtccatttttggtcagttctgttcttgtcatgtccgaacaagacgagacgagccagcacacgcacgcacacgacgactcgcctcgctatgaaaaagttgcccatccagacaatgcacaggagtacagtacaggacgacaacaggctgggtttgaaatttcgaaacatatattataattttgcagcaggcagggttccaaactaaggctgtgtttagttcttttcaaagctgaaagttgtttgtatctaaacacagcccaagatttctgctgcaggtgggcgaaagaaccgatttcggattttttttacgaaatttttgaaattttgctgattttaaataaaattttgaccaaatacacaaaaaaattgcaaaaaaccgaaaatttcggacgagatgtgagcatttcggggggggggggggcaaaatttcggaaatttcgaaccgaaatttcaaaacctggctgcaggaagaactcgagacgtcatctcgttatttgtatgacacttagttatgaaaataattataacttcataaacatgtaaagttaaatttaattttttatatgttgcaacgaaaaaaataaatttaatgtgaatatatgttaactagttgtagttaatttgctactcttttatatgtgttttacttataaaagttaaattataacttgcatgcttttggagtggtatactacatgttaatacaatttcttaattgttttgaaattttttcataattattcgagtgatatacatgttccctctagagtttaaaatccactcttgagaattggtgtttttttttttttgcctggcgttttgtttgaagtggtttttattctactgcccctagtagtactgtaattggccattgtgagagtatggtcaagatgtctcttatgatcgaatgggtgtgatcaacttgatgacgtggagcaaccacagtgcaggagattagtaggtggggataacttgtataggtatatacttccttccaatagatggcttatatttaactccctaaaatataaaaataaaaaggtatgcctccctttacccgcaacttatcaagatcatatcatctagtgtcaacgcccttccgcttaccccttttctcggatggcattctcactcaagtgacggaaattgggagcgagaacgattcccaacttttggagagcgagagtgaagtagaatggagtactgatttttgagaggaagcgtagggaacagttgaagcagttttttcatcaaaaatcctgaaaaaaaataggatcggagacggagtagggtactgctagtgatgctctcagcaactttagtaatctaaagtttcaaaataagggattggttccactttagtactaacctaacacattggtctcagagcatcactaattctgcgttcgggaggtggagttaggaaagtgaaataaaaaaaactcaacctaaaagatatccaaaactctatcccaaaattttgtctccaagacaaccaaataaaacaattcagaaataagtggtaattttttttgctagcctttaatatgtggttctgagtgataccctaaaccctaagtaggagtactagatgtgctttacgaagttcggaatgtcaataggtgaatctcttcaatcattttttctattatcatgataggaacatatggtatgataaggcatcatggagttagcaatggcatcacccaagctagactcagagtgaatgttagcatgtgtttgattggaggaatggaataggtctagatggggagaacttttcagggtgtttagcttgaagataggtaagaagtcatgatctctagaatgaaatattctctctagatagggtgtgtttggttgggtggatgagactggataggagatggccgtccggttttttgtagtgtttgattggagggcagggtggatgaggcggcccagaatagggaatattccctcaatatgctggatgagtgcatcaggccgatttggctagatgaatccatccagttttggtctgggtgatgtgtcctattctgattggctgttgttggtttgattttctgttaagtaagctccaaatgattttttttctcctaaactgtttatctaatttatgatttgattacaccattatatttgttacaattaaatctttaaaacaagatctcgaatgattatattttgataaaaaaatatatatgacaaatgggtcccactaacttttggctttttccatccatgctatatccctccgaccaaacaagaaatcggatcgccatatccatacaaaccaaacaaaaaattagatcgctatatccaacaaaatatggatggccatatcctatccatgcatgaccgtgaaccaaacacagatggaccaatccaactaattttctctctcattgatgtatggaccacatccttccaacccttaaaaaagtaggatcattataacctttatgtcaagcacgtagatgtagatggaatcatccaatcccaaaaaaaatagaaataggacgaacctaatccatcaaacttcatccccaaactaaacacacacttaagtaattccaggcttttttccattcatgtttgcattttggaacaataaatctcatactagtaaattgtttatgttctatatgtagtttttctcgtagaaacagttgcttcttttccttcttaggcaaaatgccatccattttttcaatatatttgtaaatgattgtgtagtcgcatcatatgaacagacccatcgcttcaaaaaaaaatggtagaatattgtttattgcaataacatgatttttgggcaaactgatttagcatgatattttacctggctagcattgtatttcttcttaggccttaggcgttaggcttgttaggttaatactaaaggagtgattaaatggattaaccaaataggtattgaataaatcccatacaaattcctcttgattctcttgtggtcgggattaaccaaacaagatcttaaccaaatatatttgtacagcatacaaaattgcaacttgcaagaggacattccgtctcccacgttcaaggttttatacaggcaacaaacattagaacacctccaaccgtcttgccatcccactctctatcccaaataataagaacaccactccaacaagctctctattcgaattgcatgccatttctctagtcaaatctccaacgaaaaaatctactacctccgtcccaaaataagtgcagccatagatatccgtgtttagcgctttgaccatccgtcttatttgaaaaatttatgaaaaatattaaaaaaaaattagtcacacataaattactattcatgttttatcatctaataacaacaaaaatactaatcataatattttttcaaataagacgaacggtcaaacgttgaacatgaacagtgctaaaactacacttattttggaacggagggagtagtaacttttcctatcctggcaatccaaatggcctttcattggaatacccaccaccctaaacctagagaaaattaggattatgccataaaaaaatggtttcattggaataccatcagttcaatgggcttcgataaaatatcacattcatcttgggtttgtttgctacagtacaatctcggacagaaataccactagacttttttctcagcttcttcctcctcacccccaccgtctgtaacatcctgaaaattcactattttctaatattgcatcatgctgattcttatgttcttaataaccttttaaacctaggaaaatatatttagagagacttccaaatattaacttgcgtagaatctctctctattatttaaaatctttcgtggtttgtattctaaaattgattttattaaaccaaggtatttgctttgatttgattctgcaccttaaaccttcttttgcaaaattcctttttctcaatttaattaaaaacccttttatgaattatggtccaagaaaccttcccatattgcccttgaacctaaaccgtcgtaattccgattccgttggaattaattgttaacctatcctttgatcttaaacctatactttgatgttcgatctaaatatccaaattcctccttctgatctagccgccaatttaattcatgtggcttgatttcctcttcgtcacaagaacagtattattacaaatattgtgaataattgctcttgtgctaagaaaatagattttatcctcatgcaaatctcctattagccacaaaatatttctttaaacccataccacccatttgtggggataaaatcctatttattccctctctttatttttcctaccacatttccagaaatacagagccatattatttatggttcctatttaagtgcattaaacaaactcccactccaaaatattgcactcaaacaaattagaacatctttactttgaaattcatctccgcacataaatctctccgaattcaaatcctttctgaggcctagctatctaaattcccttcaaacacaaatacttctctaaatccaatttattcaaaccttagactttcttccttttaagattgggccgaattcccctttttactcctctcattcatgcagcccaagtcggcccagcctcagctcagccgcctcctctctcctcccttccttctgtgggcgccgccgtccgccatggcagcgcgtgcgcgccgccgccaccgccgccgttgtcttgccgtcgccgccaaggaatcgccaccaacattagccgccacctcacttgtcacgaccggaattaacccaacgatcattccatacgtgcgtgtattattccttgtcccaggaggcaaggtacaccaaaagttgatacaattcagagtttaacaagcggaagcgtaaatagttaatttattacatgggcgacgaaggcccagcacacacgaagataaacggaaaacagcggaagactagggcaacgaccacaggcacttgacggcaggcacgagctagacaccaaagtcttcatcctccaggaactcctcttttgggttagggaaaaattgagcaagattgagtacaaccaccgtactcagtaagacacacccacaaatgcagaataaatgcaaaggagtacaagggagttataataaaggggttagggtttgcagtaaacaacatttacaagacttttagttgcttagggccattttgtaaagacgatcctagagctacacagtgttattaatcaaggccgtgaacccgcacgaacctgccttaacccaaggcctacgatgattcagaccgaactggcaacctgacctgggtcccagctcgtcccaagccaacctaggccaaccattccatattttagttgttaagcaagttttaagaagtaaaccactaacttgggtacattgttaggcttgcccataaccgagggcgcggctattcgaatagattatactctgatcagaggtgtacatctttacccacaagacacatctttctcacgtgtaaccacgtagcacataccaccacggcatacggacgaaagatgtgacatagttcccaacctatcctagccataaacaagagtaccgacccaaccctggctacgaccgggattcccgagacaggtaaccaaggttgagcccctagcagtaggacaccggccctgtgccatgacatctcgactaccgggcgacagctcgtgtggccttcatttgccctagagatatccatcgagccccgactttgtccatctccatccgtgtacttttgcccatgaccagactgagccacaaactacgccttacccactagacatgtggaagtacagtagtactttgcaacagaggcctgaagaccggtccttatagtggccgaggtgctactatcaaaaccatgcacctcgagcctagcctaaaaccattttgagggttttgaatagagagggaggtgtgtgtccatttccacataatcaaaccattccataacgtccaaatgatatgagcattcccaaagtctaaggttataaaacgacctaatgttgtctaattaatcagcgaagcagctagctaaattcatactagtggaaccatgaatagggtacccactagttggggttttgtttatcctagggtgaacaaggtaataataacaatagcaatattaataaggtcataacaaaggtaaataggcatggctaaataaaatagtgataacgcgggaatttaaataaagcgataatgcagtaatttaaaccaaaataattttataaactgggattcaatatgttcaaggatgatgtgacttgccttgctcgctttcccaaacgtcggcttcaacctccacatagaaaaaggctttgttcaaggatgatgtgatcttccaaagctgctgcatctacacgaccaacggaaagaaaaaggcttttactctaataaactcgatataacaagcagaaacaaagcacaaaaatatgttcttgatttcttaaggaaaaattacagacttgaacggtccaattctgagttcaaacggccaagatatgaccatttgaagtttatatgctcttaatgtgaatatttacgaatttcttcatttaaattttaattaaaaatagggtttattgcgtcagccgagaagagggggcgtgcggaccgggtccacgggagtggtgggccctacgcggcagcccctcggtcgacggtggaccgggtgcacccgtggctcaccagccggcgccgtgggccccacgcgtcagccgcacccgagggcacgggcggctgacggccgagccccacgtggtggccacacggcgcgcccggaggcggccacgtcgttgcggctggcgttaggcggcgcccgcgcccctatggtcgccggcgccggccataggcgcggcggagcggcggccgagagaggggaagggaagggggaaagaggcggcggtccacggctcaccccagggcgacgacggcgacggaggaggcggccggagcagagggaggcggtggtgcggctcgggtcgacggggtcggcggagttccggcggtcagggaccgaaacggaggggtggacgaggtcggtggcagtgcggcgaagccggaggagacgacgccgaggtgggaagcggtccggggcgacgacggcggcggacccgagctcggcggtgacgccggagagagagagcgatggcgcgagctcgattccggcgggaagaaagtgcggcgagtggcagaaacggacgagggaggtgcggggagggtttatatagggttgggagtgagagagggcggccggcggggaaggaaaccggcgcgggggtcccggtcggcatcaatggcgccggtgagatttgcgggagcaaatccggccgtttgaacgcgggagagaggggaaaatgggggaaaagggagagggaatcacggggaacatttccccccacttaatggcacgcgggaacggtcgggggcagcgggatttgcggcggcggcggcgctagacgcgggcggagggagcggcgggagcggcgggaggagggggatgacgggtgggccccacccgtcaacgagggcggcgggcgggcccgcctgtcagcggcgcgcacgcggggagggagggaaggccgagtgggacgcggggagaggagaaagagggagatggagttgggccgaattcggcccaagagagaggggagagggttttagggttttctttttataaaaccttttcaactttgtttatttcttgataattattatatgtgctctaaaaattccactaaaatttatttacacattgtaggcttttaggaaatataaaaaaaaaatcctccaagccttatttgacttttaactttgcacattttaatttttggaggctttcactaggattttaattattctagacataatttaaaggatatattttagggtcgttttgggacgtgacaaacctaccccctcttaaacggaatctcgaccccgagatttggaagaacatgcaaagaggttgggatgggctgccttcagctcgtcttcgcgctcccaagtagcttcttcctcggcgtggttgctccactggaccttgcataaacggataacccaattcctggtcctacgctccattgtgtccagaatcttcaccggcttctccacgtaggtcaagtcttcgcgaacctcaatctgctctgaatcggcttgctcggatagcactcgaagacatttcttgagctgcgacacgtggaacacatcgtgcacattgcccaaggatgcgggcagctccaactggtaagcaacttctccgcgtcgagtgatgatgcagaaaggccccacatacctaggtgcgagcttcccttttgtctgaaatctgtgcactccccataatggcgtgacccgaagatacacaaaatcgtccactgcgaattccagatcgcggcgtcggttatctgcataacttttctgctgagactgtgccacctttaggttatcctaaatggttctgactttagcttcaacatctctcagaatatcaatcccgaacacttggctttccccaacttggtcccacaacagtggagtccggcatttgcgtccatacaacgcttcatagggtgccagttgtatgctggtttggtagctgttattgtaggagaactcggcataagggagactcttatcccaggtcttcccaaaatctagaacacaggcacggagcatgacttccaggacctgattcagacgctcggtctgtccatctgtctgcgggtgataagcagtgctgaaattcaatcgggtggccagctcttcttggagcttcttccagaagtgagaggtgaattggcttcccctatcggatacaattttcttaggattgccatggagactcacgatcctagcgaagtaaagttcagctaatttgttccctccataggtggtcttcacagctaatttgttccctccataggtggtcttcacaggaatgaaccgagccaccttggttagtcgatccacgactacccatatagaatcatatccgccttgggtttttggaagtctggtgatgaaatccatcccaatttcatcccatttccattctggtacctgtaaaggttggaggagtccggccggtcgttggtgctctgctttgacacgctgacacacatcacaaagggccacgaactcggcgatttcccgcttcatactaacccaccaatatttctctttcaagtctaagtacatcttcgtactgccagggtggatggaataaggactttcatgagcttcctgaagtatcaactttttaagttccttgtcgtccgtaacgcatacacgatttccgttcaataaggttccgtgttcatcttccgtgaagccagcggctttaccctgcttcattttcttgaggatcccatgcatatccggatcattcttctgagcctcgcgtatttgatcaagcaaggtgggttttgcttctagtgcagccaagaatccatggctaacgacacttaggttcagggcttccaactgttgattaaattccggtggaatgccacggacgcaaagagtactgcaatggccttttcgactcagcgcgtcagcgaccacgttggccttaccagggtgatagtggattcccacatcatagtctttgatgagctctaaccatcttctttgccgaaaattcagttccgactgggtgaagatgtatttcaaactcttataatcggtgtatatttggcagcgatttccaatgagataatgccgccagattttcagagcatggaccatagcggccacctccaaatcatgggtaggatagttgccttcatggggtcgtagctggcgtgaagcataagctaccacatgaccttcttgcattaacacacaccccaaaccttggcacgaagcgtcacagtacaccaggaaatccttgcgagtatctgataagattaacactgacgaggaaaccaacttttctttgagagtttgaaatgctctctcacactgcggactccacacaaattttttttccttcttcagcaactacgtcatgggcctggcaattttggagaaattctcgatgaatctccgatagtaccctgccaaacccaagaaactgcggacctgggtgaccgtcttgggttgcttccaatcggtgacggctgttactgtttcaggatccacagcaactcctttaacagatatcacatgccctaagaacttgacttcggacaaccagaattcacacttgctgagcttggcatacaactgatgttcccagagctttcccaacaccagacggagatgctgatgatggtcttcctctgactgtgagtacaccaatatgtcgtcaataaagaccacaacgaacttatccaggtattccatgaacaccttgttcattaaattcatgaagaaggcaggagcgttggtcagaccgaacgacatcaccgtgaattcatacagtccgtaccgcgtggtgaatgcggtcttagggatatcttcttcacggatacacaactggtgatatccggaacgaagatcaatcttggaaaagacagtggcacctttaagctgatcgaatagatcatcgatccggggaagagggtacttgttttttatagacttcattgagagctcggtagtcaacgcacatcctctttgtcttgtctttcttttctacaaaaatcacgggagcaccccagggggaagtgctcggctgtatatatcccttctctttcaactcttccaactgcttcttgacttcagccaattcatttgctgccatacggtagggtcgcttgtacaggggagtggttcctggagcaagatctatcctgaactcaatctcccgcttgggcggcatgccgggtagctcttccggaaatacatcaccaaactcactgacaacgggtatttctgacagtcctagttgatgaagtactgagctgccggtgggagtcgggtgcgcaaagaaaacaaccggttgatcaggcttccggtacacggtgacagtacgccttgcacaatccactactccttggaattgggtcaaccaattcatcccgaggatcacatccaaatccttggtgtctagaaggatcagatccgagggaaaaggaattccctggatctctataggtacggccgggctataatactttgctgtcatagctcctccaggggtggtgatgagcagtgagttcctaagcctttctaaccccagctgatttctccccacgaattgcacagatataaacgagtgggaagctccagagtcaaacaaaatggtagcggggatggaatgaatgaagaacgtaccgatgatgacatctggagttgtctgcacatcctctgcagtaacatggttcacacgaccccgagtggcatcctttccaccattgttggggcggggaggcgcttggccttcctaacgcctcggctttgggaatttatccgcgaagtgcccaggctctaaacagttgaagcacaaacgcggctgaccttgaacatccctgcgtccatgactaggctgcacggccggtgcagggggacggggtgcacggttcccttgctgattctgctgttgctgcggctgtggaacgcgtaccacaaattgaggtcatggcactgggcgaggttgttgctgctgttgttgtgaggaggatccccctggatagggattggtgtagcggatcctttggttagccccctgttgattacggaaattcgccaagcgacgtttgtgtgactccagttccttgtgcttggcctccaggcggatgctcttgtccactacgagctggaaatcagggtaatccccggagaccagacgcacagaaagttcagggtccattcctactagaaacttctcctgcttttcttcatcttcacgaacatcctccagggcgtaccaggccaggttattgaactcatgcaaatactccataacagagcggttgccttgcttcaactcccgaaattccctcttcttaagggccatgactccagctggcacatgggtcctttggaaagcggcggtgaagcgggcccaggtgattggctgtccttctggctgcatagcctggaagtggtcccaccatagtgatgcgggcccttgcagctgatgggttgcgaagataactttttcctcatcattgcactggacggtgtccaactttttcccaacggcatgcaaccagtccaaggcatcaacggggttattggagctagagaaggtaggcgggcggatgtggaggaactcggcaagcttggagtgctgtgggggtggtggtggtggtggtggaacattgtgttgcggcggagtctggatgtggtggaggaaagcagccatcatgttggcctgctgagcgaggatttgggtgaggatggggttggtatcgggtggcggtggtggtggcggagggggaggtggaggtgggctgccatggttgttgtggttgctgccttcggggtgactgccctcaccggtagcagcgcttctcctggttgtcaccatctgaagattccacacagaaccagcaaacagaaagagctgacgattaaaactaaccacccacgactaccataattcttgaattaatttctgctattaaattggttcattaaggttgaagttgcttatgcaaataaaataaagacaggctccgacacaattataccacacaccggtataaccatgccccacacgactctgcaagaaaacaaacaaaaagaacacacgcgcgtgcctactagctgctcgtctacttctgcgacgggccagggcggaaggtgagcaacaacacatcctccgtgctgccaacgccagaggctccctcctcctaaggaaccaagggcgcgggctcgacgcaaggagtctccacgaagcaggtccacgccaagaactgacgaacaagctcaggcctagaggtactcttgcgggcggtgatcttctggctgcggcaaacgcggcggcgcttggggcgacagatctccccctgagcaatcttgagctgacacagctgcgcctccacggcgtccaagtccttcagctgcaaattctcctaacgtagctccaggatcttcatgttgtcctcgaccaacccacggcgcaccatatgatggaagttgatgcggcccgtgtcgtacgcctccaccatgcgtgccaggtgcatgatagtagcgtcatcctccgagctagcgttccggccgtcggcgaccgaaacggaggggtggacgaggtcggcgatggtgcggcaaagccggaggagacgacgccgaggtggcatgggaagcggtccggggcgacgacggcggcggatcggagctcggcggcgacgacggagagagagagcgacggcgcgagctcgattctggcggggagaaatggcggcgagtggcggaaacggacgagggaggtgcggtgagggtttatatagggttgggagtgagagagggcggccggcgaggaaggaaaccggcgcgggggtccctatcggcatcaatggcgccggcgagatttgcgggagcaaatccggccgtttgaacatgggagagagatgagaaaatggagggaaagggagagggaatcacggggaacatttccccccacttaatggcacgcgggaacggtcgggggcggcaggatttgcggcggcggcggcgctaggcgcgggcggagggagcggcgggagcagtgggaggagggggatgatgggtgggccccacccgtcagcgagggtggcggacgagcccgcctgtcagcggcgcacacgtagggagggagggaggccgagtgggccgcggggagagaagagagagggagagggagttgggccgaattcagacctagagagaggggagagggttatagggttttctttttataaaatcttttcaactttgtttatttcttcataattattatttgtgctctgaaaattccactaaaatttatttacacattttaggcttttaggaaatataaaaaaatcctcccagccttatttgacttttaactttacacattttaatttttgatagatttgactaggattttaattattctagacataatttataatttaaaggatatattttagggtacttctgggacgtgacatcacttcactggcgtcatccgcgagcaaaaccgtcatcgtcgaccaatagttggacagggccggcgccttgttcttcttccccacgccgccatcgccatgcccttcttcccctcctcctctgcgaaccgacatccgccgcctaaaaatagccggcaaagccccttcttttcccccacaactgagcttcgagctcttcttctctctctctcctccccatgccggccatcggctgatctccctcgttggagcattgccgaccaagccctcgcgccaataccttcgcctcgacgaggcaaacccattccctaaccttccccttcctttctccttccgatattagccaccaccgttacctcccataccggccggagctaagtccttgccatcgccgttccggcctcctctctcactccccctgccggccaccaccctccccggatgcgtgacactcgggaacacgttccaccgccgacgtcgtcgcctcccggtcaccggagcaccggcaccctgtctctccccctctctgtgttgctcgcgctggagaagacaagaaacggaggaggaagaagaagaagaagaagaaaaaggagagagaggacacctgacaggtgggccccagtacagtactatttcgcaattttcatatttaattcaaatcctattctctagaagcccatatctcctgaaccgtagatccgattctagtgaaactaggacctaaattcatctaaattcaaaccctacattttgatacccaatttgctattttataattttatttgaatttattcaaatattgtttgaccttatgcttgcattttcaaatactttcttttatcccaaattactctttagccactaaaaagccgtcggctagaactttacgtcttccatgggggtgttcgcggtctactgggcccgatgtcgaaccgttggttgtaaagcccaacagaaccaaacctaaggtcgaagtgctgctcctggcaccctacgcctcgatgcgtataacggtcggagcttcaccattaaatttttgaggaaaatttaaaactttttgaaagctaaagcatttaagagcataatagttgaacttagagtttgaatcctgtatataaaattaaaacataaagatttgttgggattagattagagctaatccaaaattagattttataatatatcgagttaacaaaacacaattcaaataaattggtttaaccatgaaatagaaatttaactcttttggttttgcatttcaacctaagcaaaatatttgagctaaatgaaaacaaatggaaatataagttttaatcataagaaaaaacctaaatggaaataaatatacttggttgtatgtgcattttattattttaggtttgtttttggatgttcttggtgcgtctcataataggtttcatatgcatgtcgtttctaaagaaaattcctaaaaataaattatgcaacaacaaattgcatctatattctcataaatactacacaacatcttgagtctatattaattttagtttcaaattaataaatatcacatcaaatgtttctcaaataattcgaacaactcatctagaaatttggaaaacagcatatcatttagcctactttgcaccttcaccaaaatttaaccataacttatctagctaaaccatttggtcagaatgttaactatagtgtactctaccacctggtgcaatggcttaattaaattcgaaattaaaccacctgaaatgagagccacaagttgcttaaacaatatttagactgcagtcaacatagtaatttagacctctttactaaattaccatagtaactcaaaaagtaatttaatcttggaacttggcacattgaaccatcaaatcattgtctaccttgcagcaaccttgtctccctaaaattctaatttaaaaggaagagaggagtagggaaataaactacatgttctaggcctcttcttctacatctctcttacatatggggccaagccattgtgggacccatgtgtcatcctcaccacggtgttgacagtgaaatttggtaagcccaaagtcatcatcggcttagagtcactattggctacggcatctcggaatcagccgatgggagttatcaagtcgccaatagtcggattcctgctatattcggttaaggaaattgatctactaaaggaaacttatctagaagagaccgagttcaaagagaatacggcatggcaagttatctattaattaagaatagtttgttagtttccttttatctttagaaaagtgtatttagtgtcctataaggactttatcttttccttttatctttaggaaagtttctttcttgtccgacaatgacttgtatcaacccatgggtataaatatgtacacccggggtctatgtaatctatcttcacggtcaatacaattcggcgcatcgccaccctttttacttctacttttgtttttacattccggcggaacttggcactcgacgcggggctgcatcgtcttcgatctccagcgaagggataagtccaatgttccgtcggtctaggcaattgtatcatctacgtcggcgtcgttcaaggctgcatcagtacattcgacctcttagattgctctggtttggatgatatatttgcctacccatttatcatatgtctctgttaatctagtcttagcatatcaatttagctttatcggctgcttctcgttttagggtttctgccggtatcggctaaatcgcgttgctagattagattagcttagacatctactaccctgaaaatcagtcaacggcttgattgtctagatattgtgtttcttttcatacttagtgctgcatcagttaagtttgacctactaagtcatgcttagaaccgtaatctctagcatgctttttgactgccaataagggtttcatcagggtttcagccggtgagttatctggacgttgcatcggctcataaggattgcatatacatataagttggatttagccgatgacaacaaaggtttcactgtttaatctaatctcgtggatttcatgacatcggaccaccagccgatgtgtgctttaaccttcggatcaatgcttattctattatatcaatactagccgattggtttatactggactatattattgttatattttattatcagtagccgattgtctatatatcattatttactaaagtgttagaatctacattggacgtatagccgattgcttaaaccctatcgctatcggctggtatcagcatcggctattatcggctaccggctggaactactccatcggcttgtcagccgatcggctattttatctgttgtttacatatcttgtcagttgcaggatcaaactgactggcacgcccgcatctcatcaagatttggacctgcacaggagctaagcagatctcccaggccgatgtgttcgattttttcgtcaacacagattggcatgaacaattcttcctcatggccgagaaacaaccaccaccactatctccagctagcccaggctctgttaaggaaaagatgctgaaattaggatcgactgacgtcaatgaaggaaacgtcgtgccgatcgatccagaaaaattcacacctgagcagaagaaagagtttgaagcaatgttgcagcaagcatgggatcagttcttgaactcattcatgcagacccgcaaggggacacttgttcagaagtacaaaataaaagtggttgctgatgatcctgggaccagttcttctaaggatggagatgggaaacaagctctagacgactcggctcagccgagtaacaaaggtgctaccgacgtctctctaggaaatcaaggcgacaattctcaaggagtccatggaatgcaaggtgatggtgcccaagggttgcaaggaggaaatcttaatcagaatagtgatgcggcataagattttttcagtaatttccaagaccgggttgactacgctgtgcatcatgctttgatcaatcaatctagggtgttagtcaataccttatcaaacatgatgaagtcaatagccgatggttcaatagctgagcatcaggctgcaggcccagtttatttgcaaggtgtcttcccaaattatcggtctttgatcaccgatgtccagccatctattcaggcggttccctccgttgcaccaacaactcagccaacgacgccgacatcaactcccctacctgctccatcagcgatggcgccaggccagccggtgaaccctcggttgttaatgagagagcatccacagcatagtgggcaggttgcgaatcggctgacccaagattaggttgctgccacgtttctgccacgtcaacctgttgttgatccaatacagcagcagccgattcagcagacacccccaactcagcaggttgtacaaccaatccagcaacaggtcatgcaaccagttcagcaaacaccaccaaggcagcagcctctacagccgattcagcagacgctgttaagacagcaaatcgttcagttgatccagcaccaaggttcaataagcgcatcggccgggtttgcaacgcctggtggtcagcccgtacaacaatttttaaatcaagttgtccaagaacacttggttcaccacgtacagccggatggcacagtaatgcctcaagttgttcctgagcacttggtacgtaatatccagccgaaccttcataattaccaagggggtaacttgaattatcaatatcagcctccttccccgcaagcccaatatcagccagggggattggctcaacctcagtttgcgtctcaatacggtcagttcgagcccatgcagcaacaaggggcagctcagcaacggtcgtgggccgatgtgattgctgacgtaatgagggaacagtttgggcttaaaccaaaagagactagaagcttgtatcggcagccttaccctgagtggtttgagagagttcctcttcccaatcggttcaaagttccggacttctccaaatttttgggacaagatggtgtgtcaacttatgagcacattagccgattcttagctcagtgtggtgaagcatcggctgtagacactctgaaggttaggttattccgattatctttgtctgaatcgacttttacttggttttcctctttgccgtatggatcgatcaatagttgggccgatttggagaagcaattccacagctatttttacagtggggttcatgagatgaaattatctgacttgacagcgtttaagcagcggcatgatgaacctgtgcacgagtatattcagagattcaaggagatgaggaacaaatacttcagcttgagtttaactgatgcccagttagccgatctggcctttcaaggtatgattgctccgattagggagaaattctcgtctgaagactttgatagcttgtcacatctgatacagaaggtgtcacacccagaaattcactagtaatttccgaacttatttgtgcattaaatccttgtccaggaatcagccgaggtacacaaactgacaatttaatatacagattcatcaacgttacatacttacaaaagaaaagagaaaacagcagcggaattacggtctagcgaagctccggctccactcccacaggcagctaaactggggtataagccaaacgtcttctccttcgcaacttgtcttcaactgaggtttgattgtttattgcaaggtgaacatatgacatactcagcaagccacacagcaagtatgcaagtgcacaaggataccaaagaatggcataatatatggctcatttgcaaaagcagcatttatcaaacatttgagaattgtaaaacagtagagtaattaatcatcaatattaatcaacactgaacagcacacccatgctgcacaggcccaaccatcctgaacaaccatacccggctgtacagatctatctccaaaccaggaatgtgccattccaaaccaggagctaatcaaattattaccaattatagcatcatttattacggtgagaagtgtgagactaatcacgaaagacattgttagacccgcccataaccacgggcatggctattcgaatagttttactctagctagaggtgtaccactgtacccacaagacacagccccacaacatgtcaccatgcggctcaatgccaccacggtacctcggaaaggagctgtgacagtacccctcgcataacacaatccaccacagtgcaccgttcctggatcataatcacccccttatagacaaggcatggactccccagcgacccccgtgggcttatctccgccacttttcagtttggtgccccgcaatgaaccatgctatacaaaaggtaaagccgttgcccacgctgacttgtggttggcatggttaatgtttcacaaccgaaactcatgaaccggtccttaattgtcatgagcacgaccatcaaaaccatgtgctcacaacccaccattatcaagttttagttggcacattaattaattaaccaatcacaattagccatcgtgagctacaattaaatatccatcattaagtgatagcggaacattagttatcccaatcatgtgctaatgtttgtaagcatggctaagcaattatatctaatatctagctgaaccaatatataagtccaattagtcaaattgtcacccaaggtatcaaagaatagagtaagcaatgcaaagtggtcataacaaaggaataggttcacaccacccggtgacattcgaaaataaatgcacaattgaaataaatagagaatttaaatataggatcaacatgctcaaagaaattatgtttgggatctgtgtgacttgccttgcaatattcggtcttcaataaatcttctggaatacttccgacgcactcgcgaaccttcgcaacgacggaaacgacaagctaacacgcaaaacgaagaaaaagactaagaaactccaaataaatagtacatataaagtaaagaaacatgtagatcatgattttagatgaattatgagacttgaacggcctcattctaatttcatatgaattagttacaaattttacaagatttaattccaattaaacctattaaagaaaatactattctaaattaattaaacaatttagaaatgatttataactgagataaagattaaaacaacctctggaaaaagattagatcatatttggtagatgacatatattaaaaagaaataatatgccactgaaaagagagaacggatttatattgattttggacggctgagattaatcttgatcgagagttgaccaagatcggatggcttagattgatctggcaagcgggcctcacgagataccgactcaacgagtcaattctacgtgacacgggatcacccaaatgatcaaccgaaactggcgaacggaaccggctgctctgaacggctctaaactaaaggatgactccacacggacgaacgaacgaaacatgggggacacctcgttcgaacgaacgagcgaacgactcaacaacggttgcgactaaaccggtgagctagacacgattcacggtaaagccccggtacggcaaacgataggccggtaggaattaagggatgcaccaacggctaaacaacttggctaccgagcaacggctaaagcggcggctaggttaaagcggcacacagctgcgacatggcggtactagggtgacttggctcagctaggcggcggcgactcggcggaggcacgcggctagggttaggatgacggcacagcgacgacgacacacaacgacggcagactgtggctatggtagtgggacggcagcgacttggcatgcacgagcagcagcagcatggctgtagcagggagcggcacagcgacggctaggtggctagcgcagtggcgacgctagggcagcagctaagcgtggcacggtggcggctactcgatgacaaaaacgagagattaaaaactaaaccgagggaacacggatagaagtctcaccgaaccaaagcgatcggagagagagatgactacggtgatccggcggcaacacatggagacgacgacgatgctagacaaacaacggattagattgaattaagaccctagagataaagtacaccggtgaatggcataggagcggcggttgccggcgaaccacggtacaataatgcaaatggagggcaacgggagaaagaggaggcaacagcgatgcttaccaatacttacgcagcgatgaacggcgaaggagatggccggcgacgactttccggcgatcttcggcggatgacagatggcggacgggcttctcctcgcagctgcgaatcaaatggagacgacggcgaccgaaggtgacgacggacgacgacgaacggcgcggctggaggcacggcggcgacggcggcgctccggttcacgatgacggccaatctccggttggatttggcgcaaaagaaccagcggccgggatagagctcgactttgcggagccgcgggaggtggtggcgctgatcggcgacggccgaggcgacggcgcacggcggctggaacggctatcggcggcggagagagaaggagctcgcggggagggcgattccgacgacggcggaagatgagacatgaggggataggtagaggacgactagggggtcatttatataggcacgggagctcgggtccgagcccaaatcgacgggaaatctcgggaaagtctagggttctcgccggagtaaggaaagattgaaccgcgaaattggaaaggatttccatagaaacttttggggatttcttggggaaaaggaagaggagattgagaggattccattgccgcaactaatttggaaaaaggagcaacgaggtggccggattggtgggaggaggcggcacggctgcacaggcttgggacggctcggtctctgtctggaggttgaagatagagtactgtagcgccagggaagtcaaacagacttctctgcgggctgagaggagagaatggaatgggctgaattcggcccaagactaggaagaggattattattacttttcaaaataaattaaccaatgagatgatctttcaattgttaaaaatacttccaatgctcaaataattccaagaaaaatcttgaacatacttgaacactcagagtatttattaaaattgaaaccagctcatttaatgattaatttaatatgtgaataattactgaaatgttctttgtattattaaaattaggaattgagctccgaaaaatcttagaaaatttcagagagtataattaatcatggagaacttaatacaaattaaatctatccatgctttatatttaggaaattttatttcccacatttaacttcacttgtaaattaatgaacatttaatataaattatattaataatttattaaataatttataaatcctaaaacggaaattcaggctgtgatagaaggtaaccttgcatgagcatagatctgcagaagttaggaaaagctctaagaaggttaatcatgtttgtctgtacatgtatgggtcggatgatgatgaggacgattctgaaatagctgcagccgaatagatgaggagtaaaaaggtcataccatgtcaatgggtaaaaagttctggaaaagaggagaagtatgactttgatatgactaaagctgacaagatctttgatctactactccgagagaagcaaattcaacttcctgctggtcatataatcccatcggctgacaatacctaggcaatcaagccgttgactgattttcagggtggtagatgtccaaaccagagcaatccaagaggtcgaatgtactgatgcagtcttgaacgacgctgacgtagatgagacaattgcctaggccgatggaacattggacttaccccttcgccggagatcgaacatcgatgcagccccgcgtcaggtgccaagtcccgccggatgataaaataaagtagaaaaggtaaaaggtggcaatgcaccgaattgtattgatcgtgaagatagattatatagaccccgggtgtacatatttatacccatgggttgatacaagtccttatcggacaagaaagaaactaacctaaagataaaaggaaaacataaagtccttatcggacactaaacacacttttctaaagataaaaggaaactaacaaactattcctaattaatagataaactgccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgcctttgtcgattaccaattttcactgttaacacacggtcaacccatcatcttcacacctctcaattaatttatatttcatttctcaaaaggtgagaggagagttaaaaatacaattctcacctaccttaccacacatataaacctagagtatatctacatgggcccatttgtcacccatgtaccagccatctactcatgtgatcactcatttataatctatatatacttcatcaaagagagagagagtgggggagaaagagagttagagtccaagtttcaccgaagaactcaccatacctcccatttcttctgggaaacatctatatggggccactagacagccactcatactaggttaactgaagtacaagctgaatctcagccctaaactcgatcctctctccaaaaatcgtgtcaaagccatatcatgccacctatctctccattgccagcacaacatccattctttgattaaccacttcaccagataactcatcccactttcctcatcatgttccaaggaagaacttagagaaaactccctcggaatttccgagaacacccacttgttcatccttcccgaaggtgtttgatccgctgtatgtcttctctggtgagcttcgccacaatctaatcataagaacgtgatctatagatcctttccatggatcaaacacattccgtcgagctcgtcggcgtcctcggtgtccagagcgccgccgtcggtcgcttcgccgttcccgatgatccggtgcatctccgacctagccgctgcgccatgagcgtcgccaaggttctaggataaggcctgcgaagggaatcgcgctgaagagcagccaacaaggagatcctctctttcttcctcaagtccggccgccggccaacgtcgtccgttcctcgctctcgggtgagcttcggcgcagttcctcgttcgtgtagcatccttagattgtcgttgagccgttccacttctcttcttggcagtccggagtctggaagggggtcgacgccgttgccatgccgtttcttgccgtcgccggagcatccttcacgccgtcgtcgccattcaagcgttaccggcgcatgtccaacccacagtaagcttccagcaaccccgtagaggcacatgcatacactcattcacaccgagctcgacatgcacatgcatgccgaagctcaccgccgctcgcgctgccaccatcgctgacaccgaccaccgcagccagcgaaaccaccaccattagcttcgccatgttccactctgcattttctattctggtcgcatcgtgaaatctgccaccgttcaccgccggctacgctgtgaagccgctgctgtcgccgctgctctgtcctcctcctctcaggctagctgacatgtgggtccagttggattaggcactaaggactttcattactgaatgtttagatctggtaaggttgtaacttcaaataaccttacaatgacatgtggacccaagaacatgcatgtaaatagattaaaactcaagaactcttaatgaagattcaattaaaacgtgctagggacctcgggacctattactagaacctctaggaatctttctgcaaaatatctctcactgaccagtgggccctatgtgtttaaaatctggaaaaatataaggaaaatgccttagtgaatatctaatcaacagaaaaataggttaaattgtaaattgcatataaaattcattttagctccaatctggatgaaataaatttctgtagaatcaccagttatgaaccttaatatggaaacataaaacttggcacttgcagtagaataaatagctctaataattcacataagaaataatgaacatagagcaatctccaacttagaaaattcatataaaattcatcttaacttaatttggagtgaaccaagctccagtattctcacaaaaccatgttcttaatttacatgaactaaaacttgatactttctgtattaaaataatcaccaactatttaattggtaaaataactagtatagtgtaatctagaaactataaaacccataagtgatttattttaactccaaatgagatgaactaaaatttgttagtttgataaaagcatatacatttgttctgtagataaatctgtagaagaaaccatatccaaaaacatcactcaaatttgaataatgaattaaaattaaaagatggtatagaaacttctagaattcatataaaatttaataccagtctaaaggaagagatctcaaagtttgttaggttataagaaccatgaccttagtttttataaaataaaatatgacactttcagtacccaaaacttgtctaaaatttgaaatagttaacaactactataataaatcacttagcttgtaaaattcatagtaaaatcatcccaactctacaaaaatgtgaaaccaattttgttgaacacctgagaacatccccttcactgcagcaagccaacaattcataaatcatagacctaaaatgcacctaagaactattagagcttaattaatctagtgctagtattacatcttgaaaatttataactctctaatgcaaagtgataaaatataaattctttcatctaaattcatcttagaccagtacctaaccacactagtaaactcatgcattttagagcattttagatttttacatgttttggcatttatcgttaccgttatttcttttagacggtgaattcgttaccggtgaggtgattggtcttatagctgatctcaagaaggtcttatatcaaccaaggcaagtgttgcccttcctttgaacacattgaatcccatgttttcgggctaaatgttttgattgtaaaagttgcatgcgtaattcgaactatcgaaactggattgtagatatgaccaaaaaaaaaaaaaatttgcatgaacccttttgaaaatcactcccttgctgttttgaaccttaggaataattagagtacttttattgtgctcatatagctaagttaagcttttataaaatgctaatgcttagccttgcttagtaataaataaaaacatggctatggaatcacttattatactatttggaaaacctttttatgtgatatgggcagcgatgtgttcgctggatatttgtgaaataaaatgagatgaaatgtgatttttagacttgagcggcatgtggtatgcatatggtggtagttgcatactgatagggggagtattcgcccgagtcgattaaggaccgaacatatcacccattatgtttaccgtacatccacatgtgctagtatgggatggcctaagctgattaatctatttaggactagccttgcattctggtaggccggtgtgtatgagttagtcgataattctgagaattttgtcgataacttagaggaactacccatgagtgtgtgtttgtgatgatcataggatgatacattccctatgtgtgtgtgtgtgttccgtgaggggtgtactgatccacctcacggcatgggcgtctaagtctgtccaatacaacggtattgtgccacgtggtgggttcccgtcgtgtccgccaccacggcattaagtttaaggcgtgggcccgccacttaacggttctagacatatttccaagtatacctaagatggaggaacacgtatcgtgctggtgcaaggctagattctaagtagtgtaaaggcttcgttatgacctctagaccgcactcaacgtatagagtgtggtggtgcatcgcgagcacaaaacaaactagagtgttgttcatatcttgtgggtaaagctgtacaaactctacagagttctaaaaactaatcgattagccgtgctcatggtcatgagcgacatgatgatgtgctatgggtataattttgtgatttctaaatgcttttgaaactaaaggaaaaagtacgaattacccccccgaactattgcggtcgtccgaattacccccctgaaccacaaaaccggacattcttcacccccaactatgcaaaccggacgaattacccccctcgacctaatcagtggtggttttgggctacatggcgtacgcgtggcagtccagtcagcaatttatttattaaaaaataggtgggccccacctgtcatactcttattgcacttttcccctctcccttatctctttcactattcctctctctcttctctcactctctgtctcacgc

SEQ ID NO: 7768 - DNA, 9158 bp, Oryza sativa
cgccgtgacaatgacgacggcggggccgatggagagctgcagcttcatcgtaatcgcgtgttggcgtgttgctcgtgggaggaggagacggtggtcgtggtggtcgtggagttggacgagaacgcggcggccaacggtgccgtggtggacgccgggaggagctgctgctcaggcggcggcggcggcagatgatgatgatgatgccgcagcgctgcgtgacggatgaccggcagcgtcgtcaccacgggcacggcctcgccgcgcacccgtccagagttacacgcatcctgttgctctatgaagctctccaccctgcaaccacacacacacaaccacccccaaaccaaaccaccgccattagcgcacactaaccataccacttaaccatcatctcatcaccaaacacaacaaaaacacggcgatcgattcgaagattgatcgatcatctgtacatgtagatcgatcgaacacgacacacactgaccaatcgtgagagcatgagacaaccagaaaaaacccatgggacaacctcggctcgtctcctccgccgccggctaacctgcttcaccgccgactcccctcgccgctggcaccacaccccgccgccgctagccaccccccgcctgctgttgtgcgcgtgcgcgtgagagagtgagagaagagagagaggaagagtgagagagaggagagagagagggggaaaagtgcaataggagtatgacaggtgggtcccagtatttttcaataaataaattgctgactggacttccacgcgtacgccacgtagaccaaaaccaccgtggattaggtcgaggggagtaattcgtccggtttgcatagttaggggtgaagaatgtccggttttgtggttcaggggggtaatttggacggccgcgatagtttggggggggcggtaattcgtactttttctgaaactaaatgatttgagttgatgataagattgatatatgtgatatgattgccttacttcccgttgtgttgtaagggaatgatgtctatctatttatgttgatatcatgccatgattaatatgcttcacaatttgctaaaatgttttgcttaaattacgttgcaaatggtttgtgaactaaaatttgctttatgctgaaaattgagactacaaatagcctttcctttgacatagagctttcatgtatgtaggtttgatagtgctctgccatgttttgtctaatttatgttttgcaggaataggcttagtttaatttgagtgatgcgggtttcgactgcttcttctaggatgtgaacttaatggggtaaacccctagtcggtgtgcttgaggattgggtagtcaagcttccgctgttctctgatatagttatatttggccggtcggcctatgtatctatttattagttgtaatctgagttttatttgctttagatgtatcttgctatgtatattcatacttaagatgaaagtgtgaatctagtgcacttcctgggaactagattcacatgagtatgagttaggaatatttgagatgttgtagctctttagccatttttgtcaagtctcctgaatgtgtaacacatatggtcgccgccttcgagtggtttgacgggcacatctcaggctgaagttgactggcaggctaaaggcccagcaatgtctccaatattcctctctcgaggcgtcggatgtttcattatgattgctcgatgacttgaattattcactttatctcccaattataatagaaggtccggagagcctacgacagcatggtatcagagcaaataccgactataggagcccctttaagttggtcgtttagaattgattcttaaaaaaattattttgagggctttgctctcagctacaaattatttgcgaaaatcatatttaaccttatatcttatccctctctggatattatttccctatgtctcatgttttgatttctaaaactccttatcttgttccataggaccgaaaccttttgaaagcttatatttctgtaaaaatgagtttgaaaacgcttattaatcgcaatagatcagtaccaaagtgttttgaaaagttttaaaatctatttgcaaaattctcctatgtattagaacggttttgcaaaaatctcgggttttggaatggcatatagagtgtaggttttgaagttgattaaataaattaaaatttgatagacatgttaggttgtatcacataaacatgttacttctgtaccatggtgaaatttgatgggttttttatgctcttctatcccagcatttcaaaatttcgttatgaccttgaatgggtagatttggggtaggatggaattgttgtgttatgaccactagattgaatgcttagatggaccacccaaaaatcttatagcctctgaatcttgttggtttcatgttatgatggaatggttaatttatcaaacttaaaacatgctatagaaattcaaatgcattagttgcacgtgttctgaaatttatagccagcaactttcacgaaattttgtagcccaaaccataagtgataagcatgccatcttttagcagtagttagtgtactaccatatgaagcatcatgaattttggtagaatttttgaacctctgcatcaaggtgtaaaaattcatatagtctgcatagtcaggttctgaaatctgtaggttgcatacttaacaattttatatctcctaaaccataaatgataaaatgaaaacctttggtcagtaacttgtattcttgtcaggaaagtttcatgatttttcgtgggatttttacacctgtagattaagagataaaaattcaacaaccatagataataacctgttccagaactgcatcatctgtcttcttctttttgaataaaataaagtacttgtccaaaaatcacaattccttcccagaacatagaaaactttgtaagcaacctgaatataaattttatttgaatttacaagccttctaggttggtcattaacttctattttcagcagattgacacctaggacagacctgaaaccacctagcttgttcatcttccataccacaatcctgcttgctaaaacttttaaattttaaggggggtagtatgataggttagcttcaatcatgcaagaatttagagacctcgaaccatctctaatatcaaactcaataaccataacagtcataggaatatctttcaatcttgctgtcctaaaactaaaaatgcatgaacttgatttaggaaagctaaaatttgatccctagtaacttaaatctagagctctatcgcagccgtgttcatttctgtgtatttgaatcattcctcgatgcaccatgtcgaaaatgatacatccaaccaaacatcatcatccttaggcttatttctaaaacttgttacagtttgatccaaaattctaaaaactttgagaaacctttgacatttgttaatgaaatcgaccaaagcaaaataatttttgaacactcccacagattgcactcccatatagcatcatctacacacatagatctgacatatctcatccacacacatagatctgacatatctcaaataactagatccatatatatatttctacagagacactagaaaggataccctcatctcaatcgggcggtaagccccatctcaatcgggcacagcgtccgtcacaggctagaagtcactgatgtgaagagttatctcaatcaggcaaacggccgtcacgaatgaatatatcttaatcggaccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgagcctaaactatagcccgtcacagatgactgatgacctcaatcgggcctaaaatagagcccgtcacagatgactactgacctcaatcgggcctaaactagagctcgtcacagatgactactgacctcaatcgggcctaaaatagagcccgccacagatgacctcatctcaatcgggcatttagttatggcccgtcacagatgactataatccacaaaaaaaataaattttgttttttggctagcctcaggcctttgctagccatacccgctgcaaaaatgacagaaacaaacacagatatctaatatccccagctccccagcatcacccattcatatacatatgcattcacatacacagacatcaacatatttcacgcaaccacacattcacagccatctcatatttcacatccattcacatatttcacatccattcaaatatttatcatatttcacctgcaaaaccgagttaattagatcaaatatttatttagcaagttttaacataaacatatgaaatatatacataaatataagcatcacagttacatcatcacaattgcataataagtgttcatcattgcctaaacatagaagttcaacattgttcatcattttagtttaagcctaaacattcctttggggttaactatttcatggaggatgaagctggctatctcctcgtgaacctcccaaagctggtaggcagagacttggttattgtgccctacattgtcataattccagattagttgattgatcatatataagtactaaaatgtagttagtctatcataattgagaccaccgacctcaaactcagccaaggtcttcaccttttctctatacagaaggcgcatgttgtggcacacatggaatccgcactggtcacctatttgttgcttcaccgggaagtcttttttgtggatgagggtgtcatgtcctatcttcctgaggcctcctctttgcacgtattgggcccacgcttcatctatcgctagttgaattggggtcaaatcatatgcgttcttatcaattctggagttcaggtagtgacatgtactccacttaggtgttatgaccagaaggatccaatgggcactgcggcattaatatagtgaaagttaattaagtactcaaggaatgtgtcatgactattgattataggtgcacataatgtactccttgtctcggcgggaccataaggtgtcatagatgtagttgaccattccttgacggtcattctggagatttgtgacaatgaccacttgtggatcaaggaaggcaatttccggtgcatgcttctgacaccattgccaacttaacctacacacaggataaacgatcttgtaagaaagttaaaccgattgttattaccagattgagttgggcgacaatacttacaaggagtagcacttaagaggcttgtgtccaccgctcggagcctgtagaggtcgaaaagatccttgaagttgaccatgatataatttgttggaccaaggaatggctttccatcgtgctctccaaggatatcggtggctttattcggcttcctggcgttagatttctccatgtagtataagtgaaggtccttgcaagcggtgcccattgcggcaagcacgtcatctccaaccaatggcatgcctagtcggaactcctgtggagcgacatatttcttcttgacctctttgcccttagtctcttcctggcccttgcccagatctagcttccttggagctagaagcgaggcctgcacctttcctccccttcctctcctctttgcttcgggtttatcgagagtaattctctgaggggaagagtgtgccttcctgctcttcttcatcggtgggggttcatgaattgccttgctgtcggcctccgttcggtcctccccaaaatccgtgtcgtactgcaactgcacatcgtaagattgtgcatgacgatcttgagcaggaggggctgaaggagcaggggtgggtctctttggtagacgaccgcctggtgcagtgtttggcctcgctgtaaccctgatctcaatgaggtccttgggccattggatgaaggtaccacgggcatttcctagtgagaggacctcgtcgttcggtggatacttcagagggaacagctcgtatttgggcttcaccgagtcgacttgaacttttgcacagtcggccctgagttgcgctccatgcactcttgtctttggggtcggcttgtacgcaagtccctcggctgctagaaccgtgaaggtcggcatcaccctaactatgagggtgcagctcgttggttcctgcgatagattaatcaatttttttagaatattacatataatatggattcgttaagtctttcatgtattgagtaagttcacttttaccattatgtggtcgacggtgctgtcgaccgatgttggattttccgccaactcagttgatgcgcaactgctgcgtttttgggtgggacttcctaactcttcgtgcgccgcagcagcggtggcctgggggttctgttgctcttctcggatctcttgcctaatcttggtcctcattgactcgagcttttcgtcgaattcagatgtcagctcagctcttatcgacgcccggatattggcttcaagccatgcatctttctccgccttgttggaagtccgcttcttgtactgccacgcgtagtatggaaatccatacttccagggaacagaagacccaacgcctcgtgtccgtccacggtgttccttgttgcccaacactttcgtgaggaggtcgtcctcgcgtctttgagagcaggcctcttgcgagggttgttgctcggcaaccaactccttctgcattacaatttagtggggttaaataaactgcacgatgggaaacaatgcaaacatctagtttgactagatacttactatagcttcgtacactcgttgatcttctgcatttggcatgaagattgtgccatcatcattcttctggtacctggccctggcccagttcctagcccgagggtgtgggatatcaccaaacacgagtggcgtgttcgattcctccgcttcttcatcctcacgcggccattccttttccttaccggcatatccggcggtgccaagccggtgtggatgctggttcctggtctggagcaagtgatatgcctcgcttctagctctggactcgggggtcgacttcttcgcatggaattccacccagacctgttccatgatccaagaaaatttctctcttggatctggattcgtcgggttgtagacgaactcgccgactagcttagtcttgaagttcttccaagcattgcccataaccttgaaagcagcccgcctaagacggtcctcatgctccgcaggataatcgaagctctccttaaacgttagccaagcaatgtccttctctgcggccggcacgagcttgatgtcatcttgcagaatactgaatttttgcctccctatgaccccgcagatagacctaaatcggctccatattttccttggagatgtcgacaaccctacggcatccaccgctattatgcggaaccgttccttagggattttgtttcctgtcctaggagtacgtgcccttgaggacccactagttgtcgtcgacattggttcgccttgctgagacatcgtctactttttttcaaaataacaaaaatacacaattgagtgctacaatctattacaatgaattgaatgtcacttataaaaataaatgaaacatataaataaacaaaattgcgcatctcacagtaataaaacgaaccacatttcatctatttactaaattcattaatgcaccacgtataaataaacgaaattgcacatctcacagtaataaaattaaccacatttcacaataatttcattaatgcaccacatttcatcccaaacataaataaaccacattttatcccaacataaaaaaaccacatttcatcccaacataaataaaccacatttcatcccaacatgaaccacattgcatataaataaagttaaatgaaatacatttcatcaatcactacaatcatctatcacaaaattcataaatgcaccacatttcatcccaacatcgacatgtctcactcacagttcaatcacatatcatccacatccacatttcaatgacatgtcattcacagttagcagaggacggcgcgatggagtactcacctgaggatggccggtggggctcggtggcggcggagccgggctcggtggacggcgtcgccggtcggtggaggcggcgtcgggctcggtggaggcagcggtctcggtggcggcggcggcgggctcggcaaaggaggagttcgcggcggcggcggtgggctcggtggagggcggcgccggtcggtggagacgccggtcgggtggcgtcgggctcggtgggggtcggcgacgtgcgtcggtgaggacgcgggcggcgacgatgaggaaggccaacaccggtctggtcggtgtagaggctcggtagtggcggcggcgggctcggtgggggtcgtcggtgaggaggcgccggtggtccgaatggagggccgaggaggctcggtggtggcggacgcgggctcagcgagggaggcggcggccttggcctcggcgtcggtggcaacggcggcaggttcggcgagggaggacgacggcggtggcggcgggctcggtggcgacggcggcaggcttggcgagggaggacgacggcggcgctagggttctaagtaggcaggaaagtgtagcgggacttagaaaaattttcgatccgatctgagaaaccctagttatagtagagtgatgagtcatctcaatcgggctttacggtagggcccgtcacagatgactcatcggtgacgggctccatactaatgcccgattgagatgacattcaggcccgtcacggatgactcatctgtgacgggccctaagataatgcccgatagagatagattaatctctatcgggctttaactaaggcccgtcaccgatgactatttttccatttttccattcaagtctttatatttgtgagtacaaaaatatagctgctgtataataattcattttgttagtcataatacatttttggatagtaaatgatttcaaatcgaaatatggtcaacaacaaaattgtagaggttatcaagatctacaacttttattttggtcatttgtctatataactttgtttccaacagcttgaaattgattttgacaatataataaatctaaatagcatttgtaaatactaaatgatttcaaatg

SEQ ID NO: 7769 - DNA, 8089 bp, Oryza sativa
agggcccgtcacagatgagtcacccgtcaccgatgagtcatctgtgacgggccctaccgcaaagcccgattgaaatagattaatctctatcggctgtaaactaaggcccatcaccgatgactcattttccatcttttatttgttgtgagtgcaaaatatatagctgatgtgtaataattcattttattagctataatacattttcggatagtaaatgatttcaaatggaaatatggtcaacaacaaagttgtagagcctttcaagatctactagttttattttcgtcatttttctatataatttttttccaacagcttgaaattgattttgacaatatgacaaatctaattaacagcatttgtaaatactaaatggtttcaaattgtaatatggtcaacaacaaagttgatcctctaatcaggatctacaccttttattttggtcatttgtaataaaacaaaattagccatattaatgactacacatatcaagtctttgcaataaaacaaaatacttcattcattacaatagataagtacaaatccatcggtcacaaggttatgccttccgtatgatgtgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaacggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctggaatgcatttatacggatgccgctgttttgcactgtgcttttgtcatcttgtttgacggtgtaaaatgtgtatccatttatatcgtatccttgccatgtgtctacggtccaagacggtcccattcccaacaactgtaatgtctcatttgggacatccgtggacattgtcacacgattcatgaaccattcgttgaaccgagaattatgttctttgttaatccatgcatcagatcgccccaagttctcatctcggattttcgctaagtgctcctcaaagtatgggccaacttctgccatatgttggagcacagcgtaatgaacctgcgcgtacgacgcttcatcgggcctaattcttttccttccgattgtgccaacacctgacaaccttccctcgtgacgaaacacaggaactccgataggatcggcatcggacatgtaattgacacagaactcaatagcctcctcggtcgtgtaaccttcaatgatgctctcctcgggtttagctctgttacgaacgtatgacttcagaactcccatgtacctttcaaacagccacatttcccttagaaaagctgggccacatagttttgtttgcttcaccagatgaacagggagatgaaccattatatcaatgaaagacagtgggaaaaaatatccaggtgacagagggtattcacaatatcaatctgcagcccatcttgatcttctggatctataaccttctatccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccaatggaactttaatatccttcaagcatgataacattgcgatcttctcatccttccacagtgtgtggcaggctggagggaggtacactttacctgtctctgcatctcgtatgggctggagttcactgcgaatattcatgtcctatagatcaaggggcgcgttcaacccatcctttgtcttcccgggaatattcaacatcaggctaaccaaactctcacacacattcttttctaaatgcatgagatcaatgcaatgacggacatcaagatctttccagtaaggtagccgccaaaatatggattttttcttccacataccattctcctttgtcttgctacgttttcttttcttcccaaactcattgcttttgtccttgaccatattgtggacctcatcaccggacaaatctttgggagcaggctgaagttctctcttaccgttaaaaattttcttctttcttctaaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctctagatcgtcgataacaggctccaggaatacatcgatatcattgccgggttgcctcggaccttggattaacaagcacaacataatatatttctgtttaaagcataaccatggcgggaggttatagttcgcaataagaactggccaagtgctgtgagtactactcatgtcaccgaaaggattcatgccatccgtacatagacatatcctcatgtttctagggtcggcagcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggatctctaaccccagtggacacagaacctgctttgcttcgtatgtcgtctcgggcaatgtgttctcaactggaagcatagccttcaaaattcctaaaagatctgtgaaactcttgtctgtccatccactacttgccttcagcttcattaggtccaaggtaactgacaacttagtgtgttttgctttgcatctagcgtacagaggcgtctcggaatcactgaccaacctgctgaacttcattccatctctctcattctgggctgggtcctcaacgtcacgtaacatgtcttgcagcagatcgtgatccacatcaaccatttcacccccaatggagaaggtataaacatgtcatgctcatcttcatcttcctgattatgcgcaccacttctgtctgctgctgctccacttcctcattcttgctctccatgcttcacccaacatgtatagccctccatgaatcctcgttgtatcagatgaccgtgtacgtcctctccgctatcaaacatattctcttgcaatctgcacatggacaacacctgtaatcactgtttcttcttatccgatcctcctccgcggcgttcataaaatttattatgccctttctgtactccgtagaatgacgtttcaaattttttgcatacatccaacttcgatcaattgctacaaaataaaaaaaaacgaattagaggcacatattataagatcagtattgcaaaagtaagatgtgatgaaattgctcaattaatgattaatattactcacttgattgatccattttgatcacttttgggaatttaatttctgttttccttggaaaaatgacaaaaaatcgccccctacagcctcccaccaaaatagtgaacagtggcatacagttacactaggtggtgagggggtatttatacttgcaacaaatatctgtaatggccctacaacaatcaaccgtgacgggcatacaagtaatctctatcgggccttcataaaagcccgtcaaaaaagagtgtcatctgtaacgggcactaaacttatctcaatcgggcctctagttggagcccgtcacagatgaccctcatctgtgacgggtttcttttagggcccgattgagatatggaacccttatctcaattgggcctcaactatagcccatcacagataagtgtcatccgtgacgggctttagttttatgccgatataccatggttgtgcgaccatatctcaatcgggcgaaacttcagcccgattgagattacttccttctgacggcccgcaaattccagtcttgttatgggccgtcacagatggaaggatctgtcggttataaccgtccctgtcctgtcttcggtgattattctcatgatctcggtttttgtcgttgttgtgtcggtcattatgaggcgactgtctcgatcttcattgggggtattccctcggccgtcgtctctttctcaccgcgagggagagcaatgatggtgttgtcggtgcatagtaccgtcctcacgacgagaaggggagtgatggctgttgatggtcgttatcgatcagtttcgaccgtcaatattaccaaaatagagtagaactagtaatgcttgcaatgcataactatgtaagaataacaatattccactagtattaggtttactaaccttttgcagagaataaccataaagtagaggagaatcgatatcaactcaaacgataaatcagtcggacgatgtcaagaatcagacttatgtatgaatgggccaagaactcagaaatgacacgatcaattgggccaaaattcacaagtttgcagagaagaataatagaggaggccgccagccaaaccatgggatggttgggccagccccaggttcagccgaacctccctcatcgctgctggatgcagggtttcttctggacagtgtggattagctccaaatgatggttggagggtagttccgaccattccaaccgtcacaaccgtcattgggaggctatataaacccctcaccttctcacttcactcacaaacctcaagcaagagctctctcatttctctcaagtttagttcagtagtatctagctggtggaataggaatagagtagaaatcaggagtccggaagtcttcggaagagtttgggtatggctctagtggcttttctcttctcttttgtaagctttgtacttttattagaatactcttctgtatacatttatggtattgaaatactttccgagtatatgaatgcctactttacattatattcatgttatactgaatatacggctagcttaactgggagatgctttggtgcgggtataatgtttgcttatgcaattactctatgtcatgacgatgatattagagtagtatctggtagtttagacgtggtgtctagattacgggatatcattatttggggttatatgctgcggttgagaggtgggccgctgatgatgacagctcagtatggatattcctccaggcctatatagaatcctaagttaattctctagggagggtatggttgtatggtcatgatgggctgtcgtaaggaagtcgtcagtcaggggtggcttctcaaagtaccaggagggcatcggatagagggtattatctagtatatcggttaactagaatatatgtatactatatatattagaagtataggaatagattatctttctcttttctttccacttagcttagataatatattatgagaatgagtggctaatgcttgtgtgtcactctacccttagattatcttaacccctgcttaataatataattatcacaagtagcatataaattattagtcaagttctctctacatgatcttcccacgggataaaataaatacgatacccttggaatactctcgggtgaaatgctacaatggtatatctgtgcgcttgcggataaactctgtagccataatataccaggagtatttctgcgccattgctgggaattatatttctagtaatgtcgttaagaaataccaacaagcatttctggcaccgttgccggggaagattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgattgctaccgtttcctcaacggagtaggaaaccgtcagttgacgaacaattcgctcgttttgttgaagtaattcagaaaatccacatcaatgtgctgctgttggacgctatggaagtgccaacatatgcccgttatctcaaggacatactcaacaacaagagaccgctcctaacaacggaggtggttaagctgacagagcaatgcagcaacgtcatactccacaagctcccggagaagaagaaggatccgaggtgtcctacaatcacctgctcgatcggggcacaacagttcgaccaggtcttgcacgatcttggagccagtgtcagcatcataccaaaggacgtctttgacaagctcaacttcacggtgttggcatcgacaccgatgcgcctacaactggctgactcatcagtccggtacccggcagggatagcgaagatgtgccagt

SEQ ID NO: 7770 - DNA, 41590 bp, Oryza sativa
  unsure (1)..(41590): unsure at all n locations
aacaatgctccatggtcagaataaagtacggggcgaacccacagaaaattcaagtggtcgaagtggagccacccaagacggatagcctggtgaagttcatgcaaaatttcctggataaggaaacaacgatgcccatgaaccgttattggaggacgccggtaaaaccaaccataccggccaagaagcaagagcagccgactcagaggaagacgtcttccgcacctaagacaaggaaggtgtggaaggaaaagccaaagacgcctgctccatcacctccggagacggatggaaaatccacgaactgaatcagaagaaggtacaatcttgcacgtcggactttaaatgacgtgacctttgtcaacaggtacattggtatgtatccgcatatttattttcaacaatttaattcttgcatcaacacatgtttgaatttcaaaattgtatttatgatttttgaattttgaggaaattcttcagatgaatttttcagagaaagccaaaataaagttttcaacgaaaatttactgttccacgatcacattgaccgttggaatccaacggtcgaaagtggggctggttgagcccactaggggtggttcggccgaaccggccaggcaacgattacgtgccacttttggcagggtaactgctagtgggtcccacatgtcatttatgaccgttgtgggtaccctataaaagccagccgaccgagagaggaaattcaaccccatttcaacacattttcatttcctcttcaaaatttgctctcaagttcattgaagctttgatagtttccctcaaattcaaacactaattgcatatatacaagttgctttggtgaaactaaccggcaggtgaaactcttgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggaagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcaaagatttgttgtggtagatgagcctggttctcgtttgcttcctttgcaatttctgtgcactttgaaagaaatagaagatgtaatttcctttcgctttttccataaggagtatacacttacatggaaaggcttaagcacacatcttggttttcacgattcctgtaaaatcgatcttcagaaaggaatttctgggttcgagaaaaataggttttgggaagatatttctggtgctctaatttgcaagaaacctaggacgaatgatatccataatgctacacttaggctcatgcataaatggattgctatgactttgttttctagaggtgatcttagacccattaggggggatgaattgattatgatgtttgccatggttagaaagatcaaaattgctcctgtgaaataaacacaataatggcaacaatttgctgatgctcagttcgcaaacttcaacaacataatgcagcaacagcacgatgaccttcaagcgtacttccgcttccaggggttcaatccttaccaaggaccctgagcgaaagctaagcttggggggggagacatctctctcccactgaggtaacttgtatcacattgcatatttccctttccaattgcatatttctttccaattgcatcttataaaacttgaaaataacataaaaatttgcaaaatagaaaaataccaaaaagataggataggtttgagtcatgctaggtaagacaagatagttctctttgttgaaatgatgaatagttgctctggtttatatctcttatatatgggttcatagtaagcgctctctcaaaaggttaaatataagtagccaacaattatctgaaaacctgaggtaaatgagctgcacttgctgatctgagtctaagttgttgtaagatatgagatggtaaataagagttgctatgatcctgatactagtttggcttgaattccggatgttctgcttttcaaaatgataaaattgagagtttctcatttgataaaaattcctaccaaagccaaaaatgtgccatcatgattaaaccatatacattttggttgcttgccattccattggactttgtcaaactcttgagacttgtgtagatacttctcatgctctatgatcaaaatcatacacccgtatttatgcacttgctaaactcctacactgggagttaagcaatattccattccatttccatattgccaccaaaataaattctccatgctttcatgtgctttcttctcgtaaaaagaaaagttttttccaaaaaaaaaagaaaaaaagagaaagagggaaaggcatggttatgaaaaataataataatcaagttatgctctcacaagcttgagcatgatgttaaaaaaatgtagccatgccctctcctaatcaataaaagaaggatttttgggagaagaaagtaagcaataaggagaagcaatttctttattttttctcatgtaccactttcatcatataccacacacacattgcacgatcttgaacttgagtttgtttagtcatctgctttagtctaagtttttgacttagtaataaatgtgaatgcaagtgttctatgtttgatccctaccgagctccacatatcaaaccttagagtagaaatcaaaaaagggcaaaatggtgaggaatccaaaattgatacacttggagagactgtgaatcatatgaggaacttggctttctttttcaaaatcatttgaaaacttccggaataagagttgaataaatattgggtgattagtgctctaattattgttctgtctttcaaccgcccaaggcaaggagaagtagtgtctcgtgggaatcaggggtaaggataagccatcgtgccaaagattatttaatccgagagagagtacatataccttacacatgtatctttgagatatgcagcctagtagcaactcctgatcaataaccaagtctttgtttcctttcgtccttcactcgggatgagcaaaggttcaagcttaggggttttgttgacggtcgttatcgatcagtttcgaccgtcaatattaccaaaatagaggataactagtgatgcttgcaatgcataactatgttagaataacaatatttcactagtattaggtttactaaccttttgcagagaatacccataaagtggaggagaatcgacgtcaactcaaacgataaatcagtcggacgatgtcgagaatcagacttatgtatgaatgggccaagaactcagaaatgacatgatcaattgggccaaaattcacaagtctgcagagaagaataacagaggaggccgccatccaaaccatgggctggttgggccggtcccaggttcggccgaacctccctcatcgccgctggatgaagggtttcttctggacggtgtgtattagctccaataacagttggagggtatttccgaccattccaaccgtcacaaccgtcattgggaggctatataaacccctcaccttctcacttcactcacaaacctcaagcaagagctctctcatttctctcaagtttagtttagtagtatctagctagtggaataggaatagagtagaaatcaggagtacggaagtcttcggaagagtttgggtatggctctagtagcttttctcttctcttttgtaagctttgtacttttattagaatactcttctatatacatttatggtattgaaatattttccgagtatatgaatgcctattttacattatattcatgttatactgaatatatggctagcttatctcggagatgctttggtgcgggtataatgtttgcttatgcaattactctatgtcatgacgatgatattagagtagtatctggtagtttaaacgtggtgtctagattacgggatatcattatttgggattatatgctgcggatgagaggtgggccgttgatggtgatagctcagtacgggtattcctccgcacctgtttataatcctaagttaattccctagggagggtattcgtctgtatttagccccggttgtatggtcatgacgggctgttgtaaggaactcggcagtcaagggtggcttctcgaagtatcaggagatcatcgaatagagggtattagctagtatatcggttaactagaatgtatatatactatgtatattagaagtataggaatagattatctttctcttttctttccacttagcttagataatatattatgagaataagtagctaatgcttgtatgtcactctacccttagattatcttaacccctgcttagaatatgattatcacaagtaatatataaattattagttaagttctctctacatgatctttccacgtgataaaataaatacgatacccttggaatactctcgagtgaaatgctacaatggtatatccgtgcacttgcggataaactctgtaaccataatataccaggagtatttctgcgccattgctgggaattatatttctagtaatgtcgttaagaaataccaacaatggcgacgacggtcgttgttgttacaatccctcctgcttcgccgacgtcagttcagatgttcgcgaagattgccatcttcacggcgtggcggtgtaggatctcgttcttctcgaggtgagcggtcgccggaggtatgtcttctgatgaggtcttctccatccacgtcctcggtaggtcgctcttcgttcctgctgcttcggcaaatgcgacattgaggttcgtcacggtctcccgcagtcgctctgcccactggatggcgtctgggtttgttgctggatcaaaaggactttccatcaatatcgcgtctagattccgaaactggtgagcgggcgttctcgctgctacagacacacttgtctcagtattatcgaccacgtttacatgagatcatgagatctagatatgtggatcggacagtaagtggctcccgttggtgaagtacgttgaatccctcgttcccaatacgcgtagagttcagcttgcacgtgaagtatcaccggatagtcctcaagagtatgcttggttgtcttatgcatagaacaccaagatctcagtcttagggtggtcatccttgtcggctttgatctttcacatggggggtaaatttcagccgcctgaggattcctcccgggtgttggggccgtcgatgttccgttctccacctgagtgggaggaattatcggcggggtgtcgtttctctcaatcattgccgtatctatctcgttcccgatgataattgggccagccgagattggcgtaacggtatagactggaaagtcaatggacctgacttgagtccacaccagcggtgtcgaggtagaagctccttgatcgacgctggtgatggcactactgtcgggaagtgttgaagtcatactggtagatccttgagcaccaagtccctctacctggcacgccactgtcgacgagggatactcgcggatcggatgagttgagtattgaggtacgttggaacgagggtctacgtagtacgacatcaaacaggcaaaagaaaaggattatactggttcaggctccctatcaggtaatatccctagtccagtttatatgagattgatgatgatgagaacagattacaaagggagtagtcgaaacagacggtaccgatgagatcgtagtcgaaggattcgatgagatctcccggcgactgggctccgtgcactccagcttcggaaactttggtgggtgtgttagcaatgagattcgatgcccttcacctccccttaggggtcccttttatactgtggattaccttgaccccaagtaagtcttggagatatgtaaattggcacgatatagcagagattctaccccctccgagtaggactccggtaatttcttaactcgtagaaatatttttcataatttgagatagattcctaacggcgtatacagaaacgatccgtgcgcgtgaaggtatacctcatcggtatatttcataagtcataggatagaaggtatgccttatccgtaaccctgacagcatgcctgttgtaaccgcatggcggcttagcatagcaagagggagcggctgccggcggcgcccggctgtgtgttgttgtaactccgataggctgtaatatgctggaacagggaggagcacctgtaatcagtgccctggagatgtaggcctcagctgaactccgttatcaaatatcatgcctcgatattgtcatgatgtctggatcttctatggtatttcttccacgtttggttctcagtgtgctatcgtggctggttttataccagcatagctgtttagattggagtagatgcgaatgttgttggagaaacatctagtttttcctttccttgggcagagtgcctcctgtactgaatgattgcgaagttgcttgagatgaacattcccacagaagcatggtgagaaatggagagtattgtttaagggttaatttgatttatgccaatacaaatatggcatattagaaaaataccgttgcaattcacgttatcggttaggtgtcactgaaaatttctaaaagtagtagggtgtccgtgcgttgctacggggaattttgttgatcacgggaaaaaaaaatctggcaatccaactacaagtcatagttgttctaagattaatttgaaagcaagatatatatgttattattacataagcgtagtgcaacctttttagcgcataaaacaatcttatggtatttattaaattataaaaaaccaatatagatagaagataactatgaaaatttgatgatgtcatacaaataaagcacaaacaaaaaatctaaaacatcaagcatttctaaatatggtattttcggttaggtgtcactgaaaatttctaaaattaaaaccatgccactcccattactatttccgtcctcctctctcatgtcgacatcctcaccgtcacagcccgcccccaacgccaccgctgcggctgaccttgcgcgcctccaccggccattggcgcctcgcccgctgcgtacaggcggggtccgttggcggtcgccgcccttgttccattccccaccctcgaagtgcgacgacggcgacagcgtccgcaccaccaccatgccacaaaactcgccggcggtgagcgttcattgtgcggtgtggaatgcggcgcgcagtgagtaccagagcatgagatcagcgacggccgggatgtggcagaagtggctgccgacgaggcgcccggattcgtcactactaaaaaaagtgtttctccaggcgacccaatcacatttttcgcaggggccaaaccatccgcatgcacctcaacgcctacgaaaatagttgattttcataggcgtgcaacaggtccacctgcgaaaatagcttcaagcgctaaaaaaaaatgggcagccaccgccgtttccggcggtcgcttcccgtttccaatccatttcccacccattccctatccaatccagtgaatccacattcaatagagaaatcaccagttcatccaaaatcaccgaatcaattctagcaaagaaaacaaataaaatcattcctaaaatcacggccgccaccctgccgtcgtccgccgccgccgcacggccacgccgcaccgtagtccgcgccgacgctgcacggccgcgccccgctccccttcggccaaatgtgggagggaggggccaggagccgctatcgcggcctcaacccccctcaccgccgtggctgggagccgcgccgcctcgaccctcctcgccgctgccgccaccgcctcaaccctcctcgccgccgtcgccatgtctgccctccccccgcccccctccggccagatctaggaggaaggggccgggagccatgccgcctcgaccctcctcaccgcagccatcgcccgccgccgcctccagccggcggccggggagaggaggagaggtgaggggaggggagaggccggtgaggtgtggagaggtgtggaggggaggagaggtgtgagtcttagaaaaaacctagctcgcaagtctatttatattcaagtctattttcgcaggcggacagcaaatttcactccgatttatatttttgtaggtggtcatttcgctctaagggtcatgtccgcatgcgaaaataagaccctcacgtcgagaaaaatgctttttctagtagtgcgtggaacaaggacggcttcttgaaccagttcgccgtggagatgacgacataggcacatgagtaactgtatatagttcctggccagagagtcgccgacgaatgccttggaccggccgctgacgacgtgcaggaacatcgctctggatctcatcgcaactccacgacgaacgcctgcccgcgcgcctcaccgtcaccggtcgcgctgcccagcccgctagccgcctgcgcgcgccggcgcgcgcctcgccgtcgccggacgcccgaatgcccggtcggcggtcgcggccgcggcgtcgcctcgccggccgcccacaggccacagccggctcgctggctgctcggctcgccgatcgccgactccggacctcgcgcctggccggcgcggcagcgccccgcgcccgacggccgcctgcgcgcctcgcggctttcggcctcccatcctcgagcaacatcacagcaaccgagcattcgagcaactgcaacggtgagtcgccgagtcggtgaactgaagtgtattgattattttagcttcatagtttatgaatgactatctagattactagattaggatttaggaaccaccgaacctgtgctgctttgctagtttgctcaattgctctttgatattgttgtttgtaggtttgaaacatgaagagaaaaaaagggtcccatggttaatttaaagagtttttttagaaaaagttgctaaaaaaaagaaatcaataaccaactggttctttgctcgcggtttgtcaataagacgggacaaccagttgaacggtttcttggtcttggttttgtatgctcaataaattaacgcattcaatttatggtcaattctattcatttataactttatgaaaacatgtttatacctttacatattatacaactattagaccttgggtttgaaaattttctctctctcttacaatttcgaatacccaagttgaaaaacctgggcccgatctcgtcgcaactccggttcgtgtagttcggcgcatcgccatcgtcggcgggggcggcaggcacccactgccgtggaagatgtcgcagtctccacttacgagctgcccacgagccaaacaaggtagagccctacaaggagtacaattggaagcctgcgggtgcgcagtccatcaaaagattcaaaaccatggccatagcagccgcaacatccctcggcccatgtcatagcctcaaagagacaaatacgtgcgcatcaggaataagttcactttgtgaccctcaggagtgatcgaaatctaatccgtgaccctaaaccacaaaaccggatatctcgacccccaaactcttaaaaccaatacaaatttactccctcggcggttttgtagagcggtttcactgacgtggtgcctacgttgcgatattgaccgagtcttcgttccacgtggcattgacgtggcacttacgtggcattagaattaaaaaatatgcgtgggacctgtttgtcattcacacaaaaagaaatgtgggcccactaacatgtggggcccatatgtcagtcctcccttcttcctcctccctctctcccttctctctcgttctctcccttcttccccttcggcaggcggcggggcatgggccacggtgtggtggcggcggcggtgggctggagctgatacgggttctggagcagggagctcatcctcccggtcgacggcgacggcgatgatgtagacaagggagcggatgaggctgggtagtcggtgccgcgatggggctgaggctgaggctgcggggggagctcgtccggcgggtctatggccgtggatctcggctcgatgaagaggcggtcgccacccccctctggcggtggtgccacggtccccggagtggagtcgacgatgctgaggccagcgctcggcgagatgggatctgcgtgttggacatcaggttggccaacgccggcaggtacgccggcaacatcctcacctgcagagacaaacaaggccatggcctctccctggttccaatcgaccatggatactgtcttcctgagagtgtaagcactgacgctgacagattttcttctagctaattgacttccattttgttcgttggtgatcatgcatcgatcacgcatgtgcagtttgaggattgcatattcgagtggttctactagccgcagtgtcgggagccattcagcgaggagacggtggagtacataaggtcactggacgccgaggaggacatcgccattctgaggttccatggctgggagatgccagccaagtgcgagcgcgtcctgcgcgtcaccaccatgctgctcaagaaaggcgtggacacgggcctcgccgcgttcgacgtggggagcatcgtgtgcagggatggggccaggcagtcccgggagtggaggagtcgacgatggcgaggccagcactcggcgagatggggtcagcgtcgtggaggaagtcgaccggcgggggttgtccttggcatcgtcgatggcccacgacggaggcggaggttgaaggcagcggcccacgcactagcctcgctcgccggccaacacggaggagccagtgtcgtccttgttcgcgnncgcgttgtcgcttcggcctttgcaaattgaagaggggaggaagaaagaaaaaagatgagttaatgcgccccacaaatttttgtgtgtgaatgacaaacgggtcccacacatattttttaattctcatgccacgtaagtgccacgtcaacgccacatggaacaaagactcggtcaatatcgccatgtaggagccacatcagtgaaaccgtcctccaaaaccgctgagggagtcaaattgcactggttttagaagtttgggggtcgagatatccggttttgtggtttaggatcacaaattagatttcaatcacttttgagggtcacaaagtgaacttatttctgcgcatcaaccagcgcgagtgcgtgactgcgagagcccaagcagatcgcgaacgctctcatcaactagggccacatcgtgcagccaatgcccaccaagccctacgcctgccttaacatcttcacgacctagtgaagctgatttgcttcattcacttcgccttatttgcttcacttgattatctgtttgcttctgatttgctggtgcacatcgcttgattcacttctccccttcggcctcaccctcatgcaaggttgtcatatcatgatccatattctagtttcttacgatattatgatcctgtcaaattgtaacgataccgatcccgtctagtaccctatctttcatagtgtctcgatcctattgtttactttcacatgatcgtatgaaatcttaggtgctatcctgattctatggtgtctacgatcctataaattattatttaaaataaggtggattgataataatatgaataaatatgctcaagtttacaataaaaaccaattaaatttatcaaaatcattattatatgctttaatttatataatgtattattatattttatataaaaatacgtaatttctaaaatattatagtatctcgatcatcctatggtagtatcttataatactataatactacaaatcgaaaaattatcctacggctccattcgcttcttctgtaaatgaagattaaaagcgggtacgtaaaacaaggaaaccattaacatgtaattaattaagttttagttattacaaacttgagaaatggatttatctaatattttaaagcaacttctatatatataaagttttcgtataaaatatattgtttagcagtttgaaaaacgtgccaacgaaaaacgaggaaagatatgaatctttcattttaatgaaagttagaacggggcctatatctaaatactgattatcttgcccttacgtagctaaacgagcctagctcgttatgttggcacgagccaaccggagctggctcggctctactctactcgtttttgtttgagcgggaaagccgaaagaaacccgcgaagccaaaattccccaccgccgccgcggcggaaacaactccgatcttggacaccgacaccgcaccccgacggaaatccacgcggagaacggaaatcgcctccccccctcccctcctctttgatcctctctaagcacgactgcattgcacgaggttggttgttgcgagttctggcggcggggcgctgcccgcgtagtcggggcggctcgtgcagtcgcagttgagcggggcgagggcactggccgctggggcgagcaggaggcggctggcaacgggcggcgacgcgctgcgcctgtgcggatctggcgcgtggaagcaggcggtcggtggtgaggcaggaggttggggggagggcgtggcaggaggcgcgcttctccgcagagctggtctgctctctgctgcatgcattcttttgttgtattgttgaatttcaatgagattttattggatttatgagaaattgagccctatgtttcagagttttgatagatttgcaattggggaagaaaacaaaattggttatttgttttacaagcaattctagtaatactcacccaattgatgagggaacaaatcaaccaaatgtcattagctactttgagcccattccccttttttttggtcctggattcgtgcatttactgctgcttttcatcaatgtgcaacctatttatacagtgtagctgcttatgccaaagggtgacagaaatcaagaataagcaatagtattctgtttgcttggtgcaatgcctggttattacgacatcgatgatatcctgatggaggaggaggtaattttatgattgttttatcgtcttctggtgtgcttgcacaaatatgatctaaatgtgtttctactcttactgcagcctatttcggtagtttttcaagtgagtgcaaatggtgttggactactagatcctggcgctgaaagaaacagtgtaagtgacttttgcacctatggtttagtgctatggtgtaacttcctagggcacctactgacctttcttcctccatccctattgttctagaaggaagttggtttggaatctatgcagtagttaattgagtttatctgagatgagtgttatatgaccattggattttatttattaaaactgctttggaatgctaggtgtactcttgttggcttgtatgacacattttctagtaaacacaatctggtggtggatgcttttttagtttgtcttgtaaacaccttcacatcatttcttgctttggttggaaacaaaagtgagagatttgctccagttaaacattgtatcttctttatctccaggttgaaaagggtgctaaggtggaccttccattttggcttgcacatgggctgctgtctctggaacaagcagtttcaataaatgtacctccttgcttcacccagaagtaggtttcatcataacttgtttttcattgttgtatacagagaatcttagctagaattcatgtttcaacagatttacatgaaagtacttcttgtcaacttactgtagaggtcttcttcagtaattgcaaatgcctggtagtttcaatatttcctagaaaagttgtcctaagatcataacaacattgctacagaacccggaaggagatccaagctgatgcagcctgtgttgatttgaggattcgttgcccttacttctatgagctaggatgcaagatagtccctttgtaagttctgaaacgatttcaatctcatgcacttttaggatatagttctggcttactacctgcatccgctttttacttgatgccctagaatctgtgctgtcaacaattctaaagtttgaccaccggtaaaagaaagcagagatattatttacctttgtgttaaaaatcttactgaattattagttcatattaaaatgtttctatgtgatatttgatagaatagccacttcattgctttacaaaattttgtccacaaatgaccttattaacatacgctataatacttttcttttacaatgactaagtaattctttcggcgtacaacatacatttttctttgtgcatgtttgtttcaatattataaatgcttttgagtccattgaagatagattctttcatactttcataagacaagttcattttaaacccttgaactttgcaaaatttctacttaactccaacaaaaaaaatagatatgtttatctgattatctccagacttcaaacaatagagcaagggtggttttggaggttgttttgccattatggacaccaacttccatgccataacatcttggaaataccacattggtaattatcacttcaaataagatcgaaaatacaccaacactcactttatttcagtaatgtctctccttttaatcaacctatctatctttttgctcccctctcttttatccaaacaaattgcttggtttcacagaaaacaatcataagcaatagtgagttgctcctctccatattatggctgcagccttgctgatgtcaggcagcggttgtgaaagtgctgcttgatgaacatgacgttgctcaaaacatagctactgtgtgttaataataaaatatatctctgattccaagttggatttgatattggtagatcatccgaaattaaagaaaccaccttcaattgaaactctagtgagaagtataaacaaaaaatgtggaggcagtggtaagagaagaggttggtcggccatgccttgccacttcttggtatctagtcttgctgttcttgttttgcacaattgttattttccatctagtgatttcaggttgtttaacctaatcttcagcttcagtatgttaacaaaccattatgtacagatgatcatgaatcatataaattgctgtgtttgctacagataatattgtatcatacatgttcgatataaatgaatgtgtctgttttattaacacacccttcgtattttgttaaagcaaacacttgatacatttccacagttctatttgtaaaattagcatatatatatatatatatatatatataagctctattatacacccctcccttagaataactattctacaccccctcccacctcccatccgtccccacctcctcccctcccatcgctcctctctccctcccgcgcccccttccttcccgcactcctctcccccagtgccccctctccctcccgcgccccctctccctcccgtcgtgcccctctccctcccatcgcttctccctccgattccccctccttttttttttctctccctcctctcttttttagaaaaattaaaaataaattggtgaattcaagacttgaacccatgatctcatggttcatgacaagcagttctaaccaaatcatcgtatgatgatttgtgaacaaatcagttatgtacctataacaatcataccttgttactatgattcggcagtaacattatcccagaagctgcaaaaatgtataggttgttactgcacttttggcagtaacaatatgacgaaatttgcagtaacagagaacatgcatagtaacagtggccctatagtagtaatttttttagatctagagtattttaaatctcaatatttagagagtactaacgtacacgtcatgtcttatttttctaacccatttgcatcatggcgttcgtaaaaaaaaagtgcttaaccaaactagaaccatcataactattttttaacgttgttactgcgaaaagcagtggtgttactacatattggccatcgtgttactacgctgttccagtgagacaaggactaaaaaagaggtaaatctcaatctttagagagcaatatctctcacatcatatcttgtatttccaatccgtttgcaccatgaagttcataaaaaaacgcttaacgaaacaagatccatcatggctactttttgacgttgttactgcgataatgtgatcttgttactgcacgatgaccgtcctgttactgcacgattcctgcaagacgagagcagcaaagtggtgggcgggtttgaccggcgggaggacgctttgaccgaggtgggaggggggttttgggccatagggagggtgggggaggtgggtttggcccatgggagggggggtgtagaatagattcactatatgtatatataataaataaataaataatcttttgtgctaaatttgtatttagaaggtcgaacaagaaaagctaacaatatgtggaagtactgtcgaagggcaatttgtaaagctgatgtagaggtggagtggtagattcgccaccactaccaccattgcctttttaaaaaagcattatggatattggtaagatttagtttgaatattttgcagattttagttatctccgtaaaccaactgtgataggtttgagtttaggatttgtatgtgatacatgaaaataatcagtagatttgtcctgagaagtactttcagaatattagtcttgttaggtttaacaaatatatattacaataaaaattagctttcaaagctgtattttgaaggctctacaaatgctgaaaatgacttgtgacttgcctgtttgcttggcaagtttagggttttcagtggcaaaaaggttcccccagaaaagtttaccttttgctttatattttgtatcaaactatgtaatgtttggctttctattaaaagccggatcactcagtgatctgctttctaaaaaaaaattgtgttgctgacttgaatagtagtagagtagctgtgatagatgagggcttcgactaggcctattagaggaacagggagtgcagagagacatgtagataattgatctattcttgcctttggaatgcaggagattatggcctgaggatcccttgcaaagtacctaatggagcactgcatgcaactcaaagatattagatagatatttgaatacaactcaataatcaactactagatgatctaatgctgctcttaatgctgttgttgctgcttcactgctcatcgttggccatggcctgcaaccacggcattgtgatgttagcataccctaacttggtgcttcacaatcaacttccctttgtgattgacaattttattaaggcatgcttttgtttcttttattttttttctcaatttcattctatgaatattaaaagaagctcttaatttttcggaatgtgattgatcattcttttgctgacaatatgttcagatactcgaacaaagtcccttgctgtttcctctatttgtcagccaaacattcattataaatttcagcagtcctgacaaatgatctctgtgccaccaagacaccagttcaacttacacagaacagagtacatgagaactgtagttgtgctaaggatatcctctaaactttatgagcataagaacatattatattatagatataataattaaaagaaggtaatggtggtgatggcactgtggcggttgcgaatttgccaccccacctatagaatgtctttttatgaccccttcaacatgtctttttatgaatttgccaccccacttattgtagatcttgagcatgtttatttctccttatttgccttacaaagaaaaataaaattcagtatgggaagttccaaaatggccgaactgtcacatatagatggacttgtttggtgcaaaaatcatttgtatatttgggcaatattagactttttttttttaaaaaaaaaagggtagcaagtgtatttggttgttctgcagaacatttgaaggattgccttgtcagatgctccagtgtgttttgccttcagttttactggccaatagaacagtcatggaactactcatttggtctctcgctttagtgttgggtgtgagcaactggattaacatttggagctaccagtctaccacttatacatgatttgttcatgctcaccgttagtcatcctctcgggattcagcttttcctaatggttacggtattttcataataaaggtgcaatgaggacagagaacgaagtccacaatgaatttggagatgcacttctagagagggagtccactgctgttgtcactattttcttgcagtctgtcaagaagagttaagaatctgatgatgaagttatttatctagtgatctgtgggattattagatgtttggatgctgatatcttactaaattggtgtactttgcacatgcagaggtgtataatgatttattcgtttgcatggttgtgtaaacagggtgaacgacaggagcattggactgttcttgcgctatgcattcactagtaggtacaaggagatactaagcaagtcacacagctcttccatgatgacagtgcccaagtttgttccgcgccttacaaaagaagaagctcaaggtaaatacttctcccaactctgattttactcatcatcctgcatttcttccattaccattccaagctcccaactattatcacttcaagtaaccctttttttttctgtcgcgaagtgttcgaatctgctagggactcgatgaccgctttcaagaagtggcgcgctggcggtgtgaggctgcagaaagcgtccattcttggtaggaaaaggaagacaaaactgcctgatggaccttctgcaccttgaaccatgttttaggttcttctgtatggaaaatcgtacttgagctgatgtatgtatacttcattaatatgtcgctgtaagagaagaccaaaagtgaaacaattccgttcggagatcacacgtttgtgcattctaatctggtggctggccaaccaacacagcctcttgaacaaagggcagttagttattatattccttccttttggaatcaccgaaacgcgtaatacatattttaactgcatattgatgtgtgcgcgccttctgtgcaagtgaagagaagtttgtggtcttaaagtcattagggcaatagcagtgcttccttgatatttaccgttcttcgtacgccgcctaaatcaagaacgtattaaactacatactccacgatgcaagttacttgtagtgggttccaccaataccaatatttcacttttcatctcccctctcctctttttctttccccaccggtagaggaaaccgaggccggagaaaacaaggcattggggctgagtggtggcagctggcgaggcggtccaagcggtgacaacatcgggcggcccaagcggcgaccgagctagctgcggatcgagctcgctggctttgaattgatatcggccttgacctcgtgctcctttgcctctccgtcgcttccctcttcgtccccttctcttctcctctgccgtgcctccccctcctcctctggctgccacgccttcccacttcctcctttggccaccacgacagaatggggtggacggggcgaggtggcgcttgaggtggcggatcgaagcagctcaacgagaggagcaattgaggtcgtgctcgcgaccggcggcggtgatgagcgaggcggtggcgcgtggcccaagaggtgccgaggggggctccacctcgtcggggccggaaaccacggacgatggcgccaccaagctgtggatcaagcttgctggtagaggagacacggcacgcgaagagaaagctcctctccctctccctcctcctatcttcctcactaccggcgacctctcctccttccccaacgacagcagcggcgcttctcccctccccttctgcgtcgctacgtccccgtcgccaacatctgcccagccgctgtgtcgccattaccgtcgccggcctttctccgatcctctctctcccttcccggaggggcgcgggacaaaagattgtgggcccaaagctgcaaatctgatcatgaacctgtagcttattttggctccctattagggcatccacaatgtgcaaaaaaaaaaaaaaagtggatagtaagaagtcctattacctggttcaccattgtgggagtagctagtaaaatgggtagtagtatcatccggtagtagtgctactaccaggcaataaggaataaacaaatattaagactctctcatctctcattccctctcttcttcaaccacccattctcttaaatgtggggcccagcttactacctttacattgtgtgaactaaaataattactacttggttttgtaggttaatcggggcgttacataggtcccacccttgctacctaacttgatgcccttattggaggggaatctccgagctgaccgatgaaggctgaatgacaacttagtgtaatgtgaatgaccttactatgcgtcacataattttatgccgggctctgccagaacaacatgcatgtgagaaaggcccaatttcgagcctcacccttctttttaataaattttaataaggatatgcatgctgattttgttgggggatactatgcaaaatagtcaaaaacaatttctttttggcagtagactagactggatggcacggtagcagtggtagatatcctaagactttcccacagtggtctagctacagccttgataccgaagtgtcttcttcggcgaccctggttgtactttcccctctccacactgacccaactggcgacaccatgctatataaccaaatgaatcctctcctcgactcctccgtcccataccggcacagcatgcaggacacacagtgacgtcggtttgttgccacatgcgtgatgcagcggcggaggcagcgcgcgaggcagagagtcacgggagagagagagagatcagagagaggggaggaggaagaaacgaacgaaacgacgagaggaagaagacgacagcgttgagccaccagcaccgtatcctcgacagaacagaatggcgctgtttgtactgtactgttgctttctttcatctctccacccgtttcttccgatctctgcatccacctccactgcgctatgagtgctagtagccatcggtggtgccaccgccggtaaaacgtcgactagctagggggctgattgctacctcagagtgctctgagagcatgtcgaacctcacattcagaaccgtaccttggaatttgataccccgaaacggaacacaatttgagaccctacaagaatgccaagaaaaaaaagataaattagccgtggggctctgtaagaagcactacaacagaaaacgtttattggtgccagttgggaacccctataagtgttagatttcccaaccggcattgataagctgtttgaaaaaaaaaaagccggctcggctcggctcaatttgagccgatgcctcaaaagcaccaaaattaaatccaaaaatctaagaaaaaaatagacaaattcatataagagaatcaacaagttcatagaatgagaaatattcatgataagttaacattataggaccaaatattcatcaacaagtttattaaaaaaccaaatcaaagaatacaccaatcacagtggagaacttctaccgccaccgctgctcactggagaggaaggggaggctgctgcaaccacacacgaaaggaagggaggccgccgacgctcgttctgctgctgagggtaggcaaggtcgtggggaggcgatggaggcgcatcccccccttcgaggcgccgctctgcttgccaccgtcacgttgccgcaaaggagagcaagggaggctgccgccaccaaggagtcctggagagagagagagagatggagaggtggagaggtggaaagataagaggataagggagaggtggagaggacatgtccctctatcatcggtgcgcgtgaaaaatctcgtgaaaggctaggtcggcttggctccttcgaggtgttgtttttttaaaaaaccgacatctataatacttaaaatgttagtttattcaaaaaaccggcagcaatatttggtacctactttttaataaacatatacttatatggtgatgaggatacaactagctcggatataaccatgactaccttatgtattagtcaactaaaggtgcatatgttctatattagatttacttgttatatatttgaacaaacgttgctacacaatgagttttgtgtgttttcgtttgtagaggtacttgcttgggtgaaagaaaagagaccgagcataaagaatgcatgaatgattgaagaagttgattagggaccaaaccaagactttctccaagtcttctttcatctcaccacgtcacttttggtccatagaagacgagagataaagttccacacgttttggattcagattcagacctcctgacagcaccaacttcaaacggacctagccgctgatctagaaggaatttcggcgcccatgagtatttgttggaaagcttatggagtctactttcatatggttttggtcccacatcaaaattcctactgagctaccgggaatctgcaaaacaagccgcgtacctcatccagtccgaatctgatttgtgttttgggccttataattgtgtcgtggacttaggccaagggggtgtgcgccctaaggcaaccctaggacgtccctaatcatttttattcagtagccgtcatcgtttagagtcgggttttgcttagattattctgtcaagaacagtttcgccggtagatcggtttgtggaaccctaaattcgagtgcttaatcattcatatgcaatttggatgcaatctatcttgttcttgcttgtgttcttcgattcgcatgtagggattagccttctcggcgaggtcaattgggtttcggcacgattgataaccagaggagacgtggtgctgtgattgcggggctcagtagcgtgtttgttcagaagccggatcgagttgtgtctcgactccgtccaaatcgactgtttatcagtacctatcggaagatcgggacctaacacccttatcaataggatcaaatgtgtcggtcgtgttatgaggggtgggaaggggttgtaacttgtaagtgcctgttttagatgaattaacacctctagtgttgtttctttttttcctttcaatagtagcaaagattcttttaagtgaaggctgagaaaaaaaatatgtcatgatatagtgttttctttttattaaacggataaataaaatcgctgttgcccagaacacacgtttatattattgtcatgagctagctctttgtgttagcaatggttaccatcgaacgctttctggagcagaagaaaacaagtttgttatagccagatcagcataagagtaagagtgaaactttttgaatatcaaaagagtgatctttaaatacacatagacatagactaaaatataaaataattggggctctttttttttcgcgttgtaacgttactcactttacaccccctcaacactttttttttgagtttaatagtatagcaaactattaattagctttaaaatttgacacatcatttacagccaatcgaatagtctattcatacaatagttatatataaatatatactacaccattaataatatgtaccccgcttttcttttctcttcttccctctctctttcatatgtgctcgtagttagcttatactcttatattgtatttgctgatcttatctcctccacagatacttacagctgccttatagtctactacctccatccaaaaatgttgcaagattcattatcctaggataatgtcagtgaaatggtaaccggggtacccattatccggcaaaaggagcattatcaaataaataacatgatcaagatatctttagaaaataaaaaggtaaccttaaggtgacgtagctaggggcccattctgtagggtctcgagcccacctaagatttcatatatatgattctctttggctgagaaggaatactgtgtatatgagctaaaactctgagtataaaagtatcttggggcttaacttggatcccaagcataccccaaatataccttaagaatatagcctaaggtatgcatccctattccgggccccaggctcaccctagcccttataggttctatggtccttggcaagaggggcatagaaacttgtaaaacctatatcttaagaaaacgagctaaggtctgccttgagcccggcctagtcctaggccccgagctagccttagtccgcacaagtcacgcattactcgagaagtagaagtgatgatacttaccaaacatgaaggcgtaaactgaggtttgccttaggcccggccttgctccgagccctgggcttgccttggtccttgtctggctcgcctccctctgcctagaagggcgtcaaaacgtacaacacgcataatcttgagatattcttccatcaatgacactttcaagaagttcattcaagaataatcaaaattctttaaatgcgggaggacgcgatctcaaaaactgctaggaagttgagcgtgttccacagccagctgtgaggcagcacgccctgccataaatgaaacaggtttatgggggatccccggccagtctggagttgaaaggacgtagacaagacggcaacgttgagtcattttggacggtggtgcttaggacacgcgttgcacatgccccgcgtcacctgatttagccaaacagacagagaagcaaccgtggcgctgtcttgggcaggtcgggcctcatcgggcccaccacgctccacgtggtgagcacactggcagaggcccaactgtctcacacggagcccggggtaatatgatagtaagatttgaagagtttcttgaagattgcattaaggaatcagccggcaacgacaagatggctgatgagacaagactaagagtagatttgtaataatgtgagccctcttggagtataaaaggaaggggaccaaatacggatgaatggttggattcttttagactttgtagtctagaaagacctcctttgtacttagctggtctatagaagacaacaaacaccaacacaagagtaggatattacacctctggatggcttgaacctgtataaattcctgcctccctctcctcgcagggtggccgggcccatcacgatcacagttacccagcacctctagccgactaaccccctggtcagatcttcactctcggagaggggtctccacttcccgctgtccgaagtaccaccccctcgatggatagatcacatcccattttaggttgcaacattttaggatggaggttactgtactcttatactactaattatttccgtcactttattatccctgccctaatatgctccacggaaaaactgcctgtctatgcaaaggagacgagatggccagatgggagcaaacgatggattgtttttccagatcaaactctgattttggggtacgtgcacgtcggacgagaaagtgagcaaaggcaacagtggggagagcaggtggatcgaggtggccatgcgtgatcgccatgatcgagccagcagtaggtccagtggtagctaggattggagagtacatgccctccgggcgttggtgtagcttgtcagcctttgttggcctcggcgtgtccccttctcgtcaggcaaattattaggggatcccgtcgatagccccccaccagcggccatcgatgcattttgtactagttcctgctttagggctgcatattcaaaccttaagttttccttcactcattgcttagcctgatctccgtacgtaacagaggaaattttcttgcggcatggaagtcctggaaagcacaagcaccggtggcatgctctatcatgtttcaaattcttgtgtctataaacactggagtaaattttatataactataaatattttcacaaaactatagattaaaggtatattttatacaaaatttctcatagaattacaaatttaagatgaagtgtcaaaaaaataaaaattaagtagtaaatatatcacaaaaatatagatttactgtcaatttaatcacaaaactacactctaacataacggtagtgctagagatttaaactatagaatatgtagttttatgataacttcaatattatatatatatagtttcgtgatacttagccttaaatctgttgttctgtaataaatttatcgctaaatctttagttttgtgatagtttgataaaactacacattgttttgagaaatttactctaaatattatgcttttgaagaaattagaggcagatggaatcaacagtttggttgtagcttttcatgactaaaaaaaaaggggaacgccattagtgtattaccattataagtttaaaatattgatttatttaatttgttttagaaacttttatttgaaaaaaaatgctatttaatttagcagtttaggaagcgtcataatgaaaagggtgaatgaaaagaactcagcctaagctcaaggacgttttcgataggaatagttttgcttattaagccgttcacggtgtggggacgtggcgcgttccttcactgcgccacgtcggaaaaacgcccgcgtgtcggtgcgagtcgtgtcccaccagagcgacttgtccccatggagggaagcgcgtttcttcgcctccgcgagtccgcacgggcggggaaagcgcgtcgcccatgcgctgtggagggcgtgccttcgtcgcgccgtgcccccgcgtcgtgcaatccaaccggaggaggagaatgggaagggagcggccaaatccgaccagaggagaaggcccatatggaccgcagctgaggagctcggcgccgccgcaaccctcactccatgctcgtctcgaccgccggcgccatagccctcgtcgggctcgcctcaaccatcggcgcatgcaaccctcgttgggtcgccgccgtcggggaagcctgaggaggccgtcgccgctccacgtcgcgacgaccccgccgatgctccatcgggggagctccttgacgccggcagagctcgtcgtcgtcttcttcctctacgcgccggtcgtgagtgggagagccagcaccggtggagggagaagggggacgccggccaatctcgcgatggatttgggggagaaaccgcgcaccgcccacaccatcgctgccgacgctgtcaactccgctatgagcttcttgcccgcaccggtgaggaggcgtcgatgccgccagatctgccccgagctcgtcgccatccacgccgccattgaggcttgttgccgggagctcgccgaacacacctagcctccatctgcgccaccgggagctcgccggccactccgtcacgcagccattgaagcgcgcctcagggatctccgcgaacgccaacggtagaaggaggagaggagagttgccggcggttgggctaggaggagaggacgccggtggagggaggaggggagagccagcgccgggcatgacatttgtgggggtggtggggtgaggccgtgagggagggggatttggtgagacaacactagttggtgcttgcactgtgaagaaaatgtcttagaagctcttcatcttaggtgccaccatgtggtatctcatagttggtgcttatacagcgagtgcccttgccaggtcattaccacatcaatcaaccccacccgtgaaagcctggtccaccatgcaaagcgaagcccgtacatgtacagggcggcacgcggggtggtggccagcgcaacagccgtcgtcgggtgatctccctctcccggagcccatatgcgcggccggccacagccgcagccgcaagagcgagagcgagcgagcgagactcgcgcgcgacgcgagatggcgtacgagatctctcctggagaggacaccgacgacgcagcggcagcgcagcgcgcgggcagggcagcggcgtacgtacgtgacaccggagcgagcggggtgggtcggcatatgccgtacgtacgtgctccacggcgaacgaacggagaacgcgacgaacgggattattcacggggcgtcgctgtcggggtgggcggggcctgctttgctttgcctgtgtccactttattcattcattcccctgtgaaaacctgcgcctcggctatcgtggattcgtggtcgctgccggtgccagtcggtccgtggcgtttccacactcggagtccatagatcagtcaatcgattctttctgtgtttgggagagagggactatgctgtgtttagtttgcactgaagtttgaaagtttggttgtaattgatacgatgtgataaaaagttatgtgtatatgaaaggtttgatgtgatggaaaattggaagtttgaaaaaaaactttggaacaaacacccgcttgtaattttttcttcttttttatacgagggacaccggatacacagtcaaacaaacacacacgatcgattctggtgtagtatactagtagtatgtcgtgtagatcggcatcaagaacgtgcatatggacgggatatcggtactgtcacatgccgataacgtagtgccgcagctcgtctctgagattgtggtctggctgggcagaatcgattttaagctgacgttaaaccttaacatcgatgtctctcttacctcctccttatctctcccttccttgttggcaagactaaggctgtgttcagctctatgaattaagaactaatctcccacatatgcaaaacaaaacgatttattagctactcccttcgtccccaaatacaaaggattttgatattttgctttcattgtttcaccattcgtcttatttaaaaaatttagaaattattatttattctatttgtgacttactttattatccaaagtactttaagcacaacttttagttttttatatttgtataaatttttttgaataagacgagtggtcaaacgttacacgaaaatagtaaatatcccaaatagtaaatatcccttatattagaggacggagagagtatttgtttgaaaatggattaatatgattattgaaaagagctttcctagattttttttttagaaaaacacaatgtttagcaatttgagaagtgcacacgaaaaacaagggagtagaggttgagagaaacacagccaaggcccagttctttttatcaacttcaaacttcaactttcgttttccgttagcacgctctttaaattgttaaatgttgtgttttttttttaaaaaaaactttttaggtaaaagttgtttaaaaaaatcaaataaatatattttataattttataataattaatacttaattaatcatgagctttttcgttttgcgtgcaccgaaaatatcactactatcaatttacagaacgaaccggtcctaaggattgttatacatgcggatcaatctacatcatcattgtctacatccccacctacaactaagtgcaaatttgtcacatttttgtctgctcctatttattttgttgcttttaagcatttaagggcacatgagtttttttatctctatatttttctaccccatatttatcgttttggataaggatacagtcttaaaaaaactttaattactattttttattataatataaatataaataaatatatgattttattaaaaatactttttaagattaatctatgcatatgatctccttaattctaagacaaatattttaggaattattcataatgaaatatattaaagtttgatatcgacctggttcaaaacaataagtattatcaacctagaaaatcattgaatggtataataaatatcagattaatacattctcatgtccaaaagacaccctcattcacccagtggtacttttacaacttttactgccatactttttttaccgtaaaaaagtgaggaggctcccatggtatattgaaaatggacatttagagggttttttacaagaaaatatggtagaaccagttcgtaagaaatatagcaaatgtaatgtagttgttgtcttaaaaagaatattaatttaacttgtgcacagcacactccgaattattttgcatttcaactaaattccttactgtcggctgaacattcatagtctaacttgcatgatgacaagcagggtagggttgtaggttgtgtggaccaagttgtaaaggtgagggttcacggagccttgctgaggatgagtgacgagtgtaacatccatgacaaaaggaatgaagttacaacgtgaggaaatgttgacatgagtgacataaggctcactattaaaactacacgtgatttgaatttcacattttgccaatccattctagtaactgaccatggcttgtgaaaacttttttttaagtgaaagcggcaaaagatttgccgaatatattagaagatcagaatatataagatacataagtgcgattgcaaatttagcccaaatacgacaactcaaaagggatgtgaaaacttttaagtaaaaggtactctttatttgaggaagaagtttgaatcaccatatgaatttattgcaacggtctgaattacctctttaaattataaaaccagacattctatactttgaactttctaaaccggataaataattaccctaataactcaatttgaagcggttttgattctacctagcatacacatgatagtccagtcagccaaaaaaataatagaaataagtgggctcgacctatcaatgctacatcttatactcccctcttctccattcttccacatcctccttccccttccatctatcaaacaaagacacacacacacactctctctctctctcccctcaacatgagcatgatttggcggctaacgttctccattacttggtgaaggataatagagaggaagacagtgacggcctccatgagatggcagaggaagacaacatcctgcaaagctccgacctccacttgtttccacaccttggcatcatttggggtaactgtagcgatggcagcagcgtccctaggcataggaggcggaacatgacctcctcaactccaccttcaccatgagtacatcatcctctttggcacacatgccaggcggctattgcatgcggagttcgacggaaatcagtgtgagaggagctagttgagagaaggtagtgagaccggtggatcttggtcacaccaaccgacaagagggggaggcaatggcagtcccatcttgacaaaccttatcttgctcccaacctcaccgttctctccttggcaaacaacttcttctttggcgagcttgcaatggagagatcctagggaggggggtaagagagggattgacttgagagggggcgaggagggacaaaaagggatggcaggtggacctatggatttattctatttttatggtgaccggattacaacgttgtcgccacgtgtgtcagctcatgttaaaaccgcacaaatagtgcttaggggttattcgtccagtttgagacgttcagggtgtaaaatgtctggttatgtcattcatggaataattcggactatcgccttaagttcagaggtaatttggaccttttcctttattaaaacagttgactaaaaaatgattaaaattttctttataaaatatacgtatactttggcaaaactaacaaaagaactacaaattaaaacttgtgtaccacagcactgcaaactggaggccaaatttactacaaaactacgtatttaagctcttttgaattataggaaaaacatattcagtagtggctttatgacaaaactacaaatcttaaagcttatcttatcacaaactatagaagttatggattttaagcctatattagaataacaatgtttggatgaagcacataaaatctatagttccatgataaattatatgctaaatatgtggtttaatgatttataaatttaaaatatgtaggttttagatgaaacacataaaatatgtggtttaataatttgatcaaaatatctgtagttcacggaatttaaattgaccaatactaacatctaagaaatgagtttcccatcttcaatttgcagctatgtgagcagtccccgcctactatacgagcctacccagtgcccctcaatcagctggtcggctggtcgcacacaccacgttccttctcccacctccgccatgccttcccgccttctccagcaactgccgcctccgccgccgcctcctcccctcaaccgccgccaccatcacctcctcctcgccgcctccgccgccgccgccacagccacagcgctgctgctgctcctgctcctgctgctcgtcgcgctctacctccggagccgccgcgcccgccgccgcagccccacgctgccgttctcgccgccgccggcccccgcgcgcccgctccgccgctactcccgccgcgcgctccgccgcgccaccggcgggttccacccgtcccgcctcctcgggcgcggcgccgcctccccggtgtacctcgccaccttccccgacgccgtcgcttcgcccgaccgtggaaagaccgatgcctcggttccccccggcaaacggaaggccttgccaaacccccttttcccctttcgggcccgggttttccggggcccattttgggtccccccccccccgggaaaaggaggttttctcccgggccccccgcggctcgtctccctgctcgggtactccggccccggcggcggcgctgacgaccgcccgctccttctcgtcttcgaatacctgccgcacggctcgctccaggccgcgctgttcggcgacgcccgcgacgggaggttcctcgactggccccggcggctcgccgtcatccgcgacgtggcgcgcgcgctcgcgttcctccacgccgaatgccagccgccggtcgtgcacggcgacctcaagcccagcaacgtgctcctcgatgccgacttccgcgccaagctcgccgacttcggcctcgcgcgcttcaagacccccgacgccatcgccgcctccggcgctggcgcggatgacttcatgagccaagaactcggcgaggccggggaactcttctccaccgcctgtgccgccgccgccggcggcggcgtcaaggcggacgcgaaggacgagtccggcccggccgccgcgtgggggaaggagtggtggtggaagcaggacggcagcggcgagctcgactcccgggactacgtcgccgagtggatcggcagccaaatctgtccggccagaaacccggactgggccgacgacaacgacggtgacgccaacgataacaacaagaactcaccctccggcacggacgagcacgccgtggcagcctcgccggaggacaagaaggacgccgactgcaacggcaatgctggcggcggcggcgacaagaaaccagaggcgaccaagatgagggagtggtggaaggaggagttcttcgaggagatgagcaagaagggcggcagcttcgacaagcgtcgcggcggcggcggtggcgggggcgggaagccgtggctccggtcgatcagcatgaacaccggcaacggcaatgccaacggcgacggcggcaacaacatcgaggcgacgagcggcctggacatcagcagcttcaggaggaaccggaagcggagccggcggcgtgggcggtccgtgggcagcggcgacatgcacagcggcgacttcctcagccgggagctgagcacgacgacgagcatgcgcggcacggtgtgctacgtggcgccggagtgcggcggcgggccgtgcgagcacggcgccgagctgctcgagaaggccgacatctacagcttcggcgtgctcgccctggtcatcctgtccggcaggcggccgctgcacatcctctcgtcgccgatgaagctggagaaggccaacctggtgagctggtgccggcagctcgcgcgcgccggcaacgtgctcgagctaatggacgagaggctggacggcggctacgacaaggaccaggccacgctctgcgtgcagctcgcgctgctctgcctgcagcggcagccggagcaacggccggacagcacggacatcgtcaagatcctcgccggcgagatggacctgccgccgccgccggtggactactcgccgtcgccgcgcgtccggccgttcccgcggtcgtcgcgtcgcgcgcagccgcccgatgccaccgagtgattggtaactctgctcacttaaaaaatttgatccttggggatcaatctacaagttgccatgccctgtgttcttgcaggagatttaacaaaatttgtcgaattttgctaatctactagtattgtttttttgtacatagcaatagcagcaattcgtcttcccctaattgagcaatggattctttggatgtcaattctaacaattgatcttgcatcttgcaaaaacttagcaatagatttttaggatttagtttctgatttctttgtcagtttcaacatatttagcagaacagtactagtatttttgttgattgttatgtttgtacatgggagatccaaatccatcttatcatggaattctttgcctgtcaatttcttgatgtatcttgtttgcaaggatcactaaacatttttgtgtgatttaattgattgttctctcgtaatttcttcatgtgcctgatcttaataaatgaaaccttggtctctatcaaaggtggagaaaaacaaacgaacaaggtagtgagcaatcaagttgatcagatattttttcagtgctacatccaaattgcacagaaaaggaagaacatttgcgtactccttgtgtgttacgatacctaacatatacgtcaaatacgatgcgtctctatcaatcttcagccaaaaaaataacaataatgattcgtagcatagaagtcaaccctttgtacatgaaaaacctttatgaaaaccaaaggtttggattgcttcccctcgcgacaaaattgaattctccaaaattctctaccggataagttggtttatgttcacaagcaaccgatcctggagaaatactacaattagtacatttttgctttattctcaatctatttgctgcagcaaatggagtttcctgtacaataagcggccagtctgcagattcaaaatcaggatactttcatagtctcaaaatgatcaaaaggggtgacttcttcctacaagtttcaaaaagctcattttgccaggcatccatggttggtgttttcagtcaattttcaccaaccacacatcaaacatggttggtgttttgttcttttactattccttccataaaggttttgcttacttttcctcaaggagataactacaacccaggaaaaatattcagtaaatttactccatacacgtgtgaaaactattcctgatgaagtgaagtgaatcttcttggtaccaactctgatcacttgttgtctgaagaaggaaaggcaaaaggattccctgtagaatttcagaaatcaaaatcaaaacaactccctcttctcctttcctagcatgtttcgtgggacgattatgcgtatgttttgttcatattccttagagcccacccgagttgctatgaacaaaattcattcatacgctttgtcgtcttgcgccttttgaggacttttttcacagttcattccttcttgagactttcatagctcccacaaattccatttcagtgggatggtccaaaagtgccattttgccctccaacaccatctagatggccctgaatcagcttcagcctttgattgattactgctgttggagatggtgtttggtgattgttgtatggtgagtccgtgggttttgcatgcactcaaaatgctgccacaatgttcttgctgtggtactcccactgccactgcccacatgacctttccagctcccagtgctcttcatttccttttagtttatggccttcatttgtttgattagggtgtgagatgtccctccctgcactagactaatgaaattgcatatctgttccttcagtttggcaaggcaacaatcctttgttactactggtcaatggttttagtggatgctttgccttgtgacatcatctactcttcaagttgttgtcttaactgaagaatcctcatggctatatgttaaccaatgaagatagcaaagatcttgttctaaaatgctgaagttactgctgatgctttttgtactagctagtagaaaatctctgtcaggaagcactgttttcaccatcttaaacactgtgcatactggtcagttcttctaggagactgacactggacaaatagaatggtcaaattttgttaaaagacaaaagcacccagactgcatgacctggctttgtgcatgatggatcaagttgacctgtaagactgaaaagtcttttttacagtcaatttaatttgcaggccatgaaaagaaggaaaaggttgcatacttacatggtccctgatctaccatgccaagaaatgtttgagctgtgagcctgtgatagactacccttttgtccattatcttgtttataaaactcatgttttgtcacattttggatcctaccatcctagcaagtcattaaagataattaatggtcttttagggtcaaaaagtttgttaaaagtgcaattctagatctgaaaaaattaaggttcaagatagatactgcaaatcttggtgggtatattagcatttctgaagggatggattggatactgaagatatgagtgctatttgcaaagtgttaagaatgtgatgttcatatatgattagataaaatgcagaggggaaaagagagtaaaagtgaaacattctactgctatccgctagaccagctgacaaaagccagctactagtttcttttgtgacaactgaaattccacacatcctaatagcagctccaacgagaggataaaatcgaaccttgcaaaaaacaaaaaaaatcgaatgtgagtgaaaaaaaggggttcatgacagaagtcgaacacaaccgaatagaaaaaaaaattcatcgggttgtgcgagagggaggcatatgcgggtgaggctgagattttctttatgcgtgggtctcacactctcactgggtctatctctaaactgcagcgattgaaccgtaattttgttagattgcatggaccgaactactcgcaacaacgctagagatgccctaagaaactgaaacctaaataaaactcaatttactaattcagatatccaagaggggcactacaagatttcagtgtttctgtttggaaatatattatatcaaaataagttattgtacggttttttatgacactacaatttactatgcgatgaaattactatacaatttatatcaccaaacgttatatacccaaaattgtactttggagatcatgtcaatgtccaaaatacaactaatatttgactaaatggagtaccaaatgcagtactttgttttgagatatcacatttctaactgctactactaatataaagaaaagaaaattcattgtccatatattctccactctcatgtccctatcaacttatcaaggcgtttctcaaagaaattgatctatgagtcgtacgtaattccattattggatttgtctttcttgttaagtctttcccgcgtgcgtcatttaccttttaaacatgatatcctcatccatgtcactgaattgactcactgaatttctcaccttatttttctttgccttcacaaaacaaaaaaaaacatttcttttttctcaacaacattagctagagtcttcctgggtgatttttttactccctttaattaaattccgacaggtcttctgccgtcgttcccttaaaaaaacattagctagagccaggttgcttctacttcatatggggtcatatggggtcccacacgaattcatgcgatagtgctaattccctctagctaggcagctcacgtctgttgcagatatgctggataattattggaacaaaatattttttttctcagctagtagttaagatatacgatgtgccagcccatgaacacgggttttctgctcatccaagccatgggccacagggacatgacgtcaccgtatgtatgtgttgtttactgcatttttttttccaaaacacaatacataggccgtgtttagttctcccaaattcccaactttccatcacatcacatcacatcgaaaactttcctatacatataaactatcaactttttctccaaactaccaactttctctaaactttctaacttttccaccatctaaacacagccataagcatgttcatataaacggtgctaaatgcgagcatactactgctataaacgcctacacacactctatccctataaacaggggcggagctagaacaaaacgaagggggttccacttacttgctttactctggtttgaatcaaatttagcttgatacggtgtgacatcccagcctagggtttaataggattaatataatactcatatcaacaagttgcagcttcttttccgaaagccgatttccaaagaactccaaggttaagcatgcttggcctagagcaatttgggatgggtgaccgaccgggaattctgtggccaagaggggacgttcctggcctggggttagtcgacggggacgtcttcccggtgcgcacgagtgaggtggcggacgtggccaagagggccacttcctggtgcgcacgagtgaggtggcctggggttaatcgacgggggacgtggcgaagaggggacgttcctggcctggggttaatcgacggggacgtctttccggtgcgcacgagtgaggacaaagtgtgcagaaaagacacgtgttggtctgtgagggcagtctatgacttatgaaagctgccagatgtaagcgggcccggcctgggagagccgggacattacatacgggtgcctaaatttaaactgacggggtatatatacagtgaaaatagataaactatagctaaattttttttgaaccgggttcctaggcacccctagctatactagctccgcccctgcctataaacacattcgaatactagatctgcatatcttaacattcacgaagtgttcatatacgactcgttgtcgatgaaaacattgcatataacttgagaaaataattagtcataaatacgagcacctcgtgccaaatctagcacttaaactcgggtgaacatgttccaaaaccaaaaaacctaacctaagtagctgagcaaggctcacttgcataaatttgatccggtgaaaaccatcaaataattaaaaacccgtgaaaactagacctaaaagttttaagaaaaaaaatcataacactccaccaaattccaaatccaaaataaactttattttgaagggacaaaacaaacaaatattgaaaaaaacaatgaaagtcccacgttctggagcagttgtcaaatccacgttctagtttcactgtttttttcaagggctttatccaaattcttatgtcagcttctcgttcctccaatattgcgcactaagggtatctacaatgcaagctactcttaaagtgtccatactaactaaggacactagtagggaaactcagctcgtaatggaggacactcctagatgggctcctcaaaatctgaagcaactaatagagacactcaaacccacaatgggtatcccagtccacaaagccccatatttatttttccaaccctacccataatctctctctcgccccctctttttttcaccacgcacgggcgcctctccatctcaccgccgcactcacctctccctctcgccgccgctgccgttcgcctctcccgtcaccggcgaccgcgaggacgacgaggagggccgcctctcccgtcgccggcattcaccgccgcccctctttctccctctctcccgtcgccatcatcgccatccacctcggcctcctccgtcgcgccatcgtcgccatccaccccagctctctctcttcggcggtggccgcgagaacgacgaggaggaccgccgcggccgccggagcttcatcggcaagggcgacgaggatagccgcggatccaccacctccgccttggatccgtcgctgccgctgctcgccgccgctcgccgctctccccacccctctctctctctctcgtcgctgctatttcaggccacagctcaagacctccgtcgacagctaaggcgagcccgggcgatggctactgcggcgcggtggccccgtcgtggatccgtcgtcgtggcgcgtggttggcctctctctttcttcggtggccggcgagggtagaagcggaaaaacaggaggaggcaacggtgtccttgggctactccctagccacgccccgcccagcgcgcctcctcgctccccccccagctgaggcgctcgtagagccgtgtccctcagctgggggacggcaaagcgacggagcggagacagccatgagcagggacacgctcggggatacgcattggtgatggcctaagggtatgtttggcacgtgcatagctccagctcaggtgaaactagaacccaatcaaatagtttgagtttagaaatttgagccctgccaaatagatcctctaagtgggttttgtttggcaaggttttgtttgtcatgtagaggcccgcaccccgctctatcccttagtttattctttagatcaccttagcttgctccgctttcttttgagtgaagctaaaccgtttggtttggatatagctctggaagaggaactgtagccctgccacgcaggcccaaaattgtcatatgtaacccacatatgaccaaatccaccttggatttggttagggcagtaatccagttcgaaccgttttagagattgttcggtattgcgttagagggaataaattggcctaaagcacaaattgaggagcaaattagactttttacttttatgagagggataaatccaaattacatccttattgggtttgttaaaaaaatatacttctcaaccatgaaaccaagcatttaacatttgtacttaaataccggtgaggctaatacaatccaatttttatgagcttgacatctaagcaatatatttttgagtaatttcagtcaaaattacagaaaaaaaaaacacacgagaatttttgtttgtggaataggttttatggtctaggggtttcacagaaccccacctttctcaagtaaatttgatatatatgaaacaataatatcaaaaagagtaaattaattacactctcaggacataaacttggtggatgtaaatagctacaacaattataaattgcttattctcaaacaataacttgtcatgagaacccaagccaaaattatccatgcaaagcaaaattgatttaacatgcacatactaatgtgtaattatattacatataagattttagacctacagaatgtgtaattattattcgtaggatatttttaagatttacatgactaaaagggaaaaaatgctaaaaatgtcagaccatgaaaactaattatatttgttcagaaaaaccgagaaatgccattgacaaatacaaaaatctaataaatatcatcaacgagtgcgagttctataaaataccattttacaagcactactataaaatatcaaataggtgtcgccactataggtgccagtagtactaaaaccggcacctatagaccttttcctacctccactagttgaaattacaaaaaaaccggcacctttaagtaattattggtgtcggttctaaataaaaaccggcacatattatattctgtatcggttttttt

SEQ ID NO: 7771 - DNA, 7062 bp, Oryza sativa
atcttctaccctcccctcctgcttcttctccggtgatgaatgttgtgatttttttattgcataaatttgtgttgtgggatgattgttgtgggatgaatccatctttgaatgctgtgggatgaatcagtctttgaatgttgtgatttggtctgttcttgcggatgcgggttcttgcggatgtgggaggtcttgcgatgcgatgtgggaggagggactgctcgcctgcttggctcgatgcgtcggctcgatcgagctgtcacatcgagccggcttttttttgattcgtcgaacctaaaaggtgccggttctaagcaaccggcacctttttattttcaaatcagtgccgccttccttgtgccggttgggaaaaccggcaccgaagagggttccccaaccggcactgaaatcattttctgtagtagtgaagcgattttgtcccataaatattattgtcgttaaggttcatccatcccgcgccattaaatgcactgttcatcctatagcattcaacgagggatgctaacggaactctaacggtgaaggtatttttgggacaaagtcgtatgcacaatggtatttcatggaactcgtactcttcgatgacatttcttggaattgtgcacttgtgaatggtattttttggattatttcttatttttttagaagttgctgacttgctggtactaaggtgtgatagaaaattatcttggccatgaacatatatagaaattaacattgaacgaattatatagaggatcaatttttccaaaacataaaataaattttttctttcttaaacataaaaaatgaacttttgcacaacttatttctatttttgtttagattccaaatagtatcttcaaaacatagttgtgtgtttagctgtcagcatattatcggtgtgcgtcacgttgcgtccattttacttgcgtgaatcgtgttgggctaggttcgcatggactagccgactaattgcacctgaatgagtaatttgcaagctattataccaatttatacctatcccgtaaatttgtataccatgagcgcaatttatgttcaagagttagtaatcacttgtattaataaatcaataagtaaaccgtcaaaaaaattaaatcaataagtaaaagttttcatagacactttattcatgacaattttaagtaaatgtatgttcaacgtgcatacgggtgagtttggtgaaaccttaagaccgttatacccaaggtaatcaaagtacacgtggttttctgtaacttcgatttttttttcaaaaaaatacatatttagatgttaaaatcatgaaaaacactactccctcagtttcacaatgtaagtcattctagcattttcatatatgtctagattcattaccatcaatatgaatgtggaaaatgctagaatgacttacattgtgacggaggaagtagtatacaaaacaaggttatattgtacttgggggtattttgccaggctttgatagttgagaggtgttaaatgttgttttgatagttgagacttgagtggtactatttgttagagtttgtgtcgaatatgtgtacatagtcggttatagtttaggacttggagttgtactatgtataggactagagtatgagtcggactctatcctaggatctctcataaatagaggggcgtgcctgttgtaaccgcatgacgacatagcatagcgagagggagcggctgccggcggtaactggccgtgagtcgttgtaactctgatacgttgtatatgctagatcggggaggagcgctcgtaatcagtgccccggagatgtaggtatcggctgaactccgttatcaaatatcgtgcctcggtgtcgtcatcatgtttggatctcctgtggcgtttctgccgcgtttggtttccgatgtgaattcagagccggtttctaacaagtggtatcagagcctgcgggagatctatggtagaggtacgagggaggtgctccacgccgcgacgactacacggggtgtccagggacgaacatggacgcaaggtggagcacggcggcgatcaacggaatttgatcggtggaatcggacacttcaggcggtggtctgaaccgttcgatggctgcaatcaacagggagatgaccagacgtggtgctcgggttgatggcggcgcaagcgattggcggtccaatcggtgggtcggacacttcgggcgggtggctcgaactttctggtgagctactctcaacagggagacgtgtggccacacgctcggggttgattaaagctggaggcgatcggcgttctcgattgatggaatcgaacactctgggcggggtggcccgggcctttcgatgagttgcgttcgacagggagacggctagacgtagcgctcgggtcgttcggcggctggaaagacggcatgacgatttgtcggcttcggcttgcggctaaattgacggttgtcaattggaggtcggagcggatttgttggcgacgaagtccgagcggcaggaacacggcttggtgtggtcgtcgtgttggtgctggcgggattcgacgcgggccggctcctgtcaacggaggcggcgacggtatgcacaggagctgcacaaaagttggaccaatcaatagaagctgtttggatttgtgccatggatcacacatgcagtcacgcagagaagtcatcaagcatgaagacatcaattaattaattgcatggttgcatgcagggagtagttaattggatggatgtgcttgcaggctcggttcatggtggctgtggatgtgtgtatgcatgcagcagaggggtccatgggcatattgtgcgttggtccaaggcatcgagcagaggttgcatcggaatcggtcgtaggtagatagatgcatgagcagttttttccgcttgtggaggtcgacacgatcacggagttgttttcagctcggagatgtgatggatgtggagatcaatacggaggctaggtggctgggattgtcaccaaagccaagtcggttactcatatggacggtgctgttagggagtagatcgaggccataggatcgacagcgaaagtaatcgtgcatcaaggcttgggcgttacgattcaaaggcaaaaggttgtgtcggtgtaggagtgcagtaaggccacgtgcaaaagaagttccgggcaacggcgggtgaaatatgttgatggagacaacgggtctgtctgacagtacaggatatatccagaatctacggggtttgtataatggggatatatgaaatccgcgtcactaaaggagaagagcgaacgctatggtgataatttcttcgggtgattcaaggcaacggtgattttctcaaattgtccagttcagcctacggatgtggaaaagcgtggatgttggatttgttagctcggttcataagacgacaaggaagaaagggttctcttcgtgtctagtgagtttgatttatctatttggtgatgacgtcggttatctggccatggattagatcaagtcaaatttaagatggtagatgaagttgaacatggctttcaagaagtctataatgtgacggctaggaacgaattcaatttcacttggcaagacgattgtggtgataggagagaaggtggagcactgttgcaggtggagtcaagaggaagaagttacaaagatggcggagtctcttgttacggtaagcctggtggacgcttgtcggggcagctcggcgagagcggcgaaaaaggaaccaactcaagtccgggtacacggaggttcgaacaagtaacaaattcaggtcgtcgtggcatattcgctaaggtggagtttgttagagtttgtgtcgaatatgtgtacgtagtcagttatagtttaggatttggagttgtactaggtgtaggactagagtatgagtcagactctatcctaggatctctcataaatagaggggtgtgcctgttgtaatcgcatggcgacatagcatagcgagagggagcggctgccggcggtgactggccgtgagtcgttgtaattttgatacgctgtatattctagttcggggaggagcgctcgtaatcagtgccccggagatgtagccctcggctgaactccgttatcaattatcgtgcctcggtgtcgtcatcgtgtttggatctcctatggtgtttcttccgcgtttggtttccgatgtgatttcggggccggtttctaacacttagtaagacaaacctaatagttgaggggaagggtgtaatgtggatttatcccttgataatacaaatattacttcccgcttttatatacatagccatattaatttaatacgtcgtgccttgtgtgtgcgtcataatggacaaagcaaaccggcaattgaagtagctagcgcacatgtgatcttcctttgccatatcagaacaaatcgagagcaacaaaatggacaaaatttcgggtcaagaaaagcaaggccgtcagcgcagggcacagccacagaaactccatttcgttttgtaacatgtgttgtttctatgcatcgacttattatgcacaccgtgtccacatggccgagcatgtgggctaggagctagtatcaatcacttcatgtttggcagatattttaagttatttgttagcatctaattttagtacttaatttcatctgaaataaaaggatattcagaaaaaaattatccttaattttatatgcaattgtgttttctggttttccaatttttttgtgcgtttttgtttactttttcacaagatgatatgataaattggtaatcgccgggcgaattctgctaatatattttcaccttgagtcatatttgcattcttgcatatatatatatatatatatatatatatatatatatatagttatttccttttcaccggattttaacatataaaaaaagggatgttaacatgttgggcatgttacctggaacctggaaaggcagcgaattcaagcaccgtgtttggagtccaaaaaagcatgagacaatatttagcaaacctagattaataaaatggccggcatgtataaccaatgcatatgcgccgcagctcatgtacttcttttcatgacagtgcatgtaaccgtacacagcagctagagtaattttcttttcctgaaagcaaatagctcgtggataaaggcctgattagttaccaaaaactttttctcaaaaacatcgcatcgaatctttggacacatgcatagagtattaaatataggtaaattaaaaaactagtaagtgctacagtaacccacatgtgctaatgacggattaattaggctcaaaattcatctcgcggtttccatgcgagttataaaattagtttttttatttgtgtccgaaaatctcttccgacatccggtcaaacgtctgacgtgacactcaaaaaaaattcttttcacgaactaaacaggcccaaagtaaacattctggcaacttttttatgtagattctgtcttattttgttttttaaaaaaatgaatatactgaatgaaaaaaaaaatgcatgcgtatatgcatggtttgatttttttaagtcctttagacggttctactatatagcggtagctgttctagatttcaagtttatttgtatccaatttttcttttcttttcttgagtaaattttgtcagggttatggataccacatacctaatagtagttgactaaatctcggcaggacccaccacataacatgttttatacggaaacaacatttgggtatagaaggagttccggataaggaaagataaatagagttctacatggaaacgacaaggattattcggattgtatccatattggtttccctagttctaattggaaaagggaacacctataggtataaatacaacggaacaatagatcaagacataagatcaatatacaagccaacatacgccaagacaagacaccggatattgacttcagagataagcatggctagtcccctacagtgtctacggatactgataggagagacatagcgctgtctttgatcttgccggatgtggattcgaagagaaaggctaccctgttgtcgactacgagtcagcacttcagaccgccaagtcgacaacacttagataggctaccccaaatattgtactagtgtgattatggtgaataagagcaacgaccggcttcggtcaacaggagtagggttattacctgacaattcaggggcccgaattgaacctgtataaaaatcctcgtccccatctcttttattacaatctcgcatatattctagtaccaacgattcccatactatgcaaatactggaatcgcgacatcaaacgtcgccaaatttcataaaactacatatgctttaatcaaaattatgataaaactctatatttaaggtagtgtatcaataaactacaaatttaaaaatattttttcacaaaactacaggtttaagctaagtatcacaaaactacatactttagggtttaaatttttagtactaatattagtttgtgtaataaaggtccatattttgtgattaaattggtgttgaaccactagttttgtaatactttaccttaaatatataattttctggtaagtttattgctaaatttgttatatcaggttaaatatatagttttatcatggtttggttaatatattataattatgtaaaatttactcaaatttaattgcacccagctttggtccaaggtagatcaccagtatagagacttgatagtagtgtcgccatcatcatccgtgtagacaggtctaaactacgcaaagattcgctggataagaacaaactagaacagactagtctatgaagtcataaagtagactagtctgaaagttacggttcttgtatatatcatggtgaaattatcaggacataaacgttcaagttgaaaggttcaatgtgcacctttttctttcatttctgcaacataatctgtctaatacttatatagttaatccccactaaatataattaatactatttctctcttctctcattaagccacattatctctattagttttagcctttggattcaatatatatggttcaaattgtctcctttcctctcccataaaacc

SEQ ID NO: 7772 - DNA, 521 bp, Oryza sativa
aattgggttatccgtttatgcaaggtccagtggagcaaccacgccgagaagaagctacttgggagcgcgaagacgagctgaaggccgatgatggcgacgggagagagggagaaagaggggcggcggtgaatgccggcgacgggagaggcggccctcctcgtcgtcctcgcggtcgccggtgacgggagaggcgagcggcaccggcggcgaaagggagaggtgagtgcggcggtgagatggaaggccccctttcttgtgaaaaaaataaggggcaaaaaaagaattttggttcgggttggaaaaataatttggggcttttgggactgggaatcccatttggggggttagaatgccttttaaatgggttcaaatttttaagggacccatttaggatgtccttccattacgagctgagtttccctactagtgcctttagttagtatggacactttaagagtatctggcattgtagatacccttagtgcgcaatattggaggaacgagaagctgacataataatt

SEQ ID NO: 7773 - DNA, 669 bp, Oryza sativa
agcgctagtcataaactatatatccaaacttggttgaacaaaaattggctatatcatcactttaactagagtaagcatgatattctaagatatctttttggacacaacacacaattcaatctaacattacatatccatatatagacacttttggtgtccaaaaaaatactgcatatataagtttggaactattgatactcattcaaaataagcttacatggagatacaaaaaatgatactgtaatagtttgattagttgccacaatgtatcacatacatgatgaatttcgagaaaataagaaaccaatttagttgtttaaacaaacaagggcgcatatatatatcataagtctggatatatagtgaacctccaaacatttatacatgatgaaaattagccatagaaaattccaaataaaattgcaacacttgcagaaatagcgcccatctattttatacattcataactttacatctaaatttggtctccatgtagtggtatatagaaatatagctacctggaatacagtatatctaaattagctttaattagttggattgatcgatgtgaaatctggatgtcatattttgccagtagaagaactcaacttttgcaaggaaacatgttatgcattagttacacttacaacccaccagccgagatgtctt

SEQ ID NO: 7774 - DNA, 591 bp, Oryza sativa
gccgcgccgctcgacggagaacgtggccgacggggagtcgacgccgacggggaagggtcgtcggccgccgccgccgccgcctcggcggcgggaggggaggaagtggtgggcttcatgaaggattggggatttttttttttgctcctctcctctctctgattgttttttgggatgcttttctctcttttttttttctggggggtgatggtttgggttttccttggtcctgcggcaggcagaagccagaaacaaaggctttgatgaggtgatgaggctgctgctgatgctttccaaccagtgatgctaaaatacatggttttgtttaaggttgctttacatattatacggtttgtaaggtttattaggatatatttccagtcagtgatagatacttagatataaattaattaatatacataaactaatagttttttttacctataaactataatagttttgattggatgtatttgtaatttttgccctgggagaaaagtatgagttatcacgagattggtgctatctcaaacattaaatccttaagccactagtgatgtattcttacttgttcaaagttactttatggtctat

SEQ ID NO: 7775 - DNA, 15962 bp, Oryza sativa
gtgttatatgagacacacaacttgtcgacgtttgaggtcgcgactacggtatttgtatgtatggggatcctcgtaccaggttatatgcgagattgaggtaaaagagatggggacaaggatttttatacagaatcgggctccttacctgtcaaataatagccctaaatcttggtggccaaagccggtgttgctctttattcatctagatcacacaagtacaatatttggaataacctatctagctgtcgtcgacttggcagcatggataaccaactcgtagtcgatgacggggtagtcttcctcctcgaatatgaactcatcgagatcagagatggtgctagatccctcttgctggcctccataggcaccggatgggggatgtctaggctaatctctgatggatctagcggtgtgtgttggcttctggcttatccctctcctcatatgtcacgcccagaaattcacgaaccagaatttctaagctgaatgtgtattaaacccctatccaggaccagccagggtacacaaacgacaattgttgacatacagatccacgtcttacaaaaatataaaagattacaaatgcagcggaaaagataaaacaagctagacttggaaacttgacttctgcagcggggcgactccactccacaggcaatccttgacggcagcgacgaaaccaacttcgacaaaacaactcccactaggaagatcttcagctctggtgtgggggaaagagagcaagactgagtactacccactgtactcagcaagttataccggaagaggaggtatgatgcaggatatatccaaaggaggctaaaggctcatttgcataaagctagcatttaaaagcagtagttgaaagcagtaaaacagctgtagtgatttatcaatattaaccaatcactgtccaacgctacaccacgttgcaacaggcccaaaccaccacctgaactaaccagttccattagctaactagatgtgagactaatcacggtgaatctggtcgaccgcccataactgcgggcacggctattcgaatagttttactctgatcagaggtgtacaactgtacccacaagacacagccccacgacacattcccatgcaccgacatgccaccacgacataccggaaagaggccgtgacaggacccttcgcataaccccctctaaccgatcgcaccacaccttagggttcgcccccgtccccagcaggcaacgggcagcccccctttcatgccgtggtgaatccggaagccgatcaaccggacaccccggctgaaccaactccatcacgcccaccctcgtctgggtacgtcggctagaggaaagctacactacaagcccagccgttgcccacgctggcttgtggtaagtacggtaagttcttccagggtatcccgcgaaccggtccttaatcgctatgggcatgactaacaaaaccatgcacccacagcccaccatgtagtgtattttaattaaccaacaccattacggtggcactaaaccaaagctatgccaataatcaaagtctatgctttaatgtgattccctttttgtgtactagtagaactaagcatggctaagcatttcctaaaccaacatctagtcattttaatacccgagttagcaatggcataaggtaaacaatatatggctgagtagtaggactcatcccacatgatattgtaaaacaatgcaatatttaatagaaatgcgggacatttgtaaattgggtacaatatgatcaattgtaatgcatgacttgccttgctctcgcactgatggaaccacagcaacgtcttcgagaaaccgcggatcgatgaaacggccgaaatctacgcgacaaacaaagcacacaagcaaaacaggctataagactattgaaacaggaaacaaaaccatttttaatggattctatgcatttttatgaatttactgagacttgaatggacttaatcggagctcggatgaattagttatgatttttaaaagattctctgtgtttttactaataaagaaaaggccttaattaattactgcgcaataaatccccagggctgacgtcatcaagggagggggcgccgacatgcgggccccactcggcagcggctcaaggggcctgtccaccgtggaccgggaccacgtgggtgatccaccgccggtccacgggaccgacggcccggggccgatcggacggtgcgggtggcggcctggcacggctcggctcggcacaaagccggccgaccggccatgggggtgcggcggcggcgcacgcgaccaccggcgacggcaagcggcggcgcgagcggcggcggatggcgcacaggccgacggcggcggccgaaggtgatagcgagtgcgcggagagcggcggcgcgcggggaaaagtgggaaggagggaggagaggggctcctcaccggagggcggcgaccggagcgggggtgaaggtggcggcgacgacctggcgacgagaaggggcggacgggcgccggcggcacctaaggagggggaggagaggggttaggggtttagaggaaacccgcggcgacaaaaatggccggccagagttgaagggaatggaggggctcaccgacgtgcgaggaaaccggagctcccgaggggttcgggcgatgtgaggcggtgaccgaggtgctccaagcggcggcgaagctaacggcggcggcggcttggcgcggtggcggctctagcggcggcagcgcgtagctggaggcggcggcgagctgcggcgcgggcggcgagcggcgcgagctcggtaggattcacgggagggagcggcgagagcggaaaggggaagaggagggcacggagaacgttttataggcggagggggaggcagacgtggccgggaggacctccgatttcgccggcgacgtggggaggagagagaggagatggggggattcaaaatgcgaatcccgccccttttcgagcgcacgcatgtgccgggagacgcggggagagggcggcgacgtggggaggacgcgtgggcgatgcggcgtgggtgcgggaggagcggcggaggtgggcacggcggtttcggcggtggttgccgacgtggggcaggcggccagaggaaggggacgaccccgacaggtggggcccacctgtcggcgtcccgaggagagatggaggggcggcttgggccggcccacaaggaggagggtgcgcgtggcggtggggtggactgggccgacggcccaagaagaggaaaaggagggaaaagaaaaagaaaaggaggaaaagattttccctgggatttaaaaattgcatgtgctcaattttaattggttaaaattatttcgagagctctgaaaattgcactaaaagtcttgttaatgtattggagcatggggaactcaagaaaaattccaccacgccgaatttgattattaaatgcatttattaattgaggattagctctaggttaattcaacaatttctttaggcgatttatttaacaaattttaaagctggaaaggggaacttcagtgcgtgacatcataggagagcttgtatttatacccatagattccccctgtctatgtagaactagggagaccgtacttgccgtttccatatagaactatatttgtccttccttatccggaactccttctatacacgaggtatgattccgtataatacatggtatgtggtgggtcctgccgagcttagtcgactactattaggtatgtggtatctataactatgacactactataaaccgataaaacatgtggtagccagaatgagttttatcggatatgaccattttcttgaagcaaagttaaattagtacatgattcttacaaaaataaattacttttaaaaacaaatgggttgctaattttcggtgcacaacaattatgatcacaattgaaacatatacacctaaacaccgaaaagacaaacatagaatttaactatttccatctatacattacacatataagtttaagtttttaatgtcattaagagcatctccagccgagcggccctccatcctacgccgacgtagctctgccaatagcggcagggatgacgtggcttccccggctcaactcgatcaggcttctcgtcgatgagtagatgtagggcgtggcattgcagcctcgtccccaagaccccaagtgtcccgctagtcctctatcccaccgcttcccgagcagccgagcaggacacagcggtagcctttatcgtcacttgtagctggtagcgatgatttgtttctatttgtaatgcactaaaatttgttttcttcctttggaaaatagagattttatctttgcttatttgtagggattgagatttaaggggatatgatgctttttttagcaataacccatataaagacctataagaaaatacaggggatatattttaggaacgtattactagaaatacagctagcaccaactttcaaccttctttcttagatgttgcgacaattgtattgcacttcttcgttgatgtaaccatatacaaatatacgcacgggtcaacccccaacattttttctaacatcatatatgccattcactcaaaactcatagcttagctttgtgcacatcaatagcttacaactaagtagaggtaattattgttgctatctatgtttggttttatcttaaaaataaaatattgtaaatcataaagcgactttgaacaatcgagacaacatcactaatggcttaaggttttaatgtttgagctagcaccaaccttgtgacgacctagcatatgtaacttttttcagcggaaaaaatccttatgtatccaatcaaaacatgtagttttctatatattaattaacttacaacttagtacttatcattgttacattgcatgcttgaattaccttaataagcaaccttaataaacatttaaactatagtctataaaacaacttagagcaaaccagaaactatcatcaatgcttggaaaatatcatacctcaccctgtttccggctttcccataaaaaaaagagaaaagcattcgaaaaaaacttccattttcttagctagcttagccaaacataccaactggtatcaatccaagacaagtaaaactattttcttaacacaataggatcatgtatgtcattcacttaaattttgcagatttacgcaaattaattaaattgcatgcaagcaccatttattattaccatctatgtttagatttaccttaataaaatactatagaccataaagtaactttgaacaagtaagaatacatcactagtggcttaaggatttaatgtttgagatagcaccaatctcgtgataactcatacttttctcccagggcaaaaattacaaatacatccaatcaaaactattatagtttataggtaaaaaaaactattagtttatgtatattaattaatttatatctaagtatctatcactgactgggaatatatcctaataaaccttacaaaccgtataatatgtaaagcaaccttaaacaaaaccatgtattttagcatcactggttggaaagcatcagcagcagcctcatcacctcatcaaagcctctgttcctggcttcctgcctgccgcaggaccaaggaaaacccaaaccatcaccccccagaaaaaaaaaagagagaaaagcatcccaaaaaaacaatcagagagaggagaggagcaaaaaaaaaaatccccaatcctccatgaagcccaccacttccttccctcccgccgccgcggcggcggcggcggcggccgacaacccttccccgtcggcgtcggactccccgtcggccacgttctccgtcgagcggcgcggcgacgcctccgcgtcgtgccggtggacgctcccggactttccccgcacccgcgcccgcaccttttacagccgctacttcgaggtgggcggcttcgactgccgcctactcctatacccgcgcggcgactcgcaggcgctcccgggctacctctccctctacctccaggtgctcgaccccaaaaccccgacgtcgtcgtcgtccgccaccaccacctcctcctcctccaaatgggagtgctttctcagctaccgcctctccgtcgcccacccttcccccgatccctccaagtccctggcgcgcgactcgtggcaccgcttctcctccaagaagcggtcgcacggctggtgcgacttcgcgccgtccgccgccgccgcctacctcttcccgccgcacgactccctcgtcatcgccgccgacatatcggtgctcgccgaggccgcctcgttcgccgaggccgacagccgcttcacctggaaggtgctcaacttcggcaccttccgggagatggtccgcacgcagaagatcatgagccctgccttcttcccggcggccaatgccggtgggagcgactgcgggctccggattagtgtctatcagagtaatgtatctggcgcggaccatttgtcggtgtgtctggagagcaaggagcccctggtgcaggcaacatcagggtcctcggcatcagcattgccgtcgagtgccgggggcagcggcgtgcccgatggtgaccgtgggtgctggtgtctttttcgtgtttcgatcctcaatcagaagccaggtgggagtcacatccacaaagactcgtatggccggtttggggctgacaatgccagccttgggtggggagattacataaaaatggatgattttttggctgcggatgggggttacctgcttgatggtgctgtggtgtttagtgcttcagtgcatgtgatcaaggagtcaaactcgttcactcgcagcttaccgatgatagcaggcatgagtggtgctggcagtggacgagctggggctagaaagtcggatggacactttggaaagtttgtgtggaggattgagaacttcacaagattgaaggagctgctcaagaagcgaaagatcacgggtctgtgcatcaaaagcagaaagtttcaggtcgggaatcgagactgccgccttattgtgtatccacggggtaagcattctagcaaatgttttctccatactcatctggtagtttgcaagatcaacttgtggatttctgctacataagtacatatactgcttatagaggctaaactttggtaacatacccaggcacacacatcacacacctgattgatttaatcagaactataacatagctaaatgtgtggggtgcttttaactgtttgaaaattttggaatcaaggttaagtggcctgtgtaaattggaacctggaaatggaaatgaggtaaatcccaaaagattaaaaaaaaactagtttagctactggctagtatgccactaaataaattaagcagcttgggtttcacatttttcgttttaatatatgatcaaatcctgtttattaattaaatgatacaaatgaattggtttgttgcataaatcgtgccaattctcctctcttagatgcagcatatggtcatttgaactcatcttttaaaaactatagatgcctcaatttttgttaagtacacttgttttattaagcaggctcgacatcttctaaaaactgcagatgccacaattttttgtcctatttattgagttctctgcgaacgtatggcttcattgcaatctaatcgttgtcactttcctatcaagtagctgttgagtatggtttacttatagttatgtaactgtatactttaagaatgcgaatactcattctgtcagttggttctcttaacatttctgtaatcagggcagtctcaaccgccatgcaacctgtcagtgtttttagaagtgacagatccccggaatagcagtgaatggagctgctttgtgagccatagattgtctgtcatcaatcagaaattagaggagaggacaatagtgaaagaatctcagaaccgttactctaagtcagcaaaggattggggatggcgtgaatttgtgacattaactgtcctattcgatcaggatgccggttttcttgtacaggacactgttgtttttgctgcagaggttctcattctgaaggaaactgctactattcaagagcttagtgacgaagattctgaagcatgcagttcaggttctggatgtcagattgattctttgccaaaacgtccatcattcacgtggaaggtggaaaatttcttatccttcaaggatattatggagacaagaaagatttttagtaaatatttccaggctggtggttgtgagttgcgtataggtaaaggaagttacttttcatgtcttgtgccatacatttcttgccttttgtgctcatcttatcacaatttgcaggtgtatatgagtcgtttgatacgatctgcatatacctggaaagtgaccagccatctgggtttgatcctgataagaacttttgggtacactataagatggctataattaaccagaagaattctgcaaaaacggtgtgtaaggaatcatcaatctgcacaaaaacatggaacaattcagttcttcagttcatgaaggtctcagacctgttggacactgatgctggttttcttgtccgggacactgttgtttttgtttgtgaaatcatagactgctgtccatggtttgatttctctgatcttgaggtgagattggatttgctgtttttcatgtggcttgttcctttttgcttcctgtgctgggttggggtaaatattgatgatagtcatgatactattatagttactccaaatacatccaaattgccttcgtgttgtatagcatgcatgcttctaaccaaatgttgttgcagtacagtaaaatccaattgttcatatcgaatgtgattatgcaacttgacatttgatataacatatgacagagatcaaaagaataataagttgaaaaagcttaggatactcatattttttggtgatttgggtcatattggattagttgctttggaatgttggggagtatagtgactcaagtcttagaaatgctaacactctttttttgtatagtatagctgagattagtaaataacagggattgcacaagctgcatatatatatttttaatttagtggatacattatgataagagattaataatggaagttgacaacatgtaacaactatagtgctcaattttttgtgacgggaatcatatatagacataggctataatttaaacttctgtgaagaactagtgctatatcatttgataattaggtgtatctatttagttggaacaacacacaactacaaaggtgcataggtgaaatgttcttttaagcatttttacagaaaaaaataaattgcaacactggtcagatcgaatattgtgtccattttccatttatatgtacattcttcattgaactacccaaaaatcctaggaaatcaaaaaaatgatttcttcaaatccattgtagacaacaggactaaagcacgacagtattccatgccaatggatttcaaagtctggtggcattactgacatgtcaatttcaaagtccttaagaagatgccaggttctgggcactattaggctgtgctcgtttgtttgggttgggaacccatttgctgcgcacggaaaacggagcggaccattagcacgtgattaattaagtattagctaactttttttttcaaaaatggatcaatatgatttttttaagcaactttcgtatagaaactttttgcaaaacacacaccgtttagtagtttgaaaagcgtgcgcgcggaacacaagggagccgagttgggaaagttggggaaagaactcagccttagtcaatattcactagatttaaggacataagcatgagtagcagtccaggtgttcttctattcgttttcctgtattcgggtggtagcataacattatggccttctagtcttttcctatactgtagtattgtacttggataactgttgctgttcatgcctggtagaaaagctctctgcatctcttatagtagtcacacaattgcaggttttggcgtcagatgacgaccaggatgatttgtcaacagatcctgatgactttattgagtctgaagacagcgaggatatgagtggtgatgaggaagatatgttccgaaacctcctctcgagagctgggttttctcttacatatggtgaaaactatactcagccgcaggttactttaagagagaaaattctaacagatgctagtgcaattgctggatttcttactggtctgcgtgtttacctcgataacccagcaaaagtaaagcgcatgctacttcctaccaaagtatccaccagggctggtggaaagaaagatgtttcaaagtgcgactcgagttccacaagcctcatcagtttgctgatgggagttagtgtcttgaagcaggctatcatagacttgcttcttgatataatggttgagtgctgccaaccttcagaagaaagaccagcatatgtctcatcctcagcaagttccaaaacttctcctgactcgaatggggctagctctccaccagagctcaatgttgaaggtgaactgacagaatgtgctttcagtaataagtatgaaaggctgaaacctggcaatgatgatatccatcataggctttctgtacaaaacacagataagtgtacaaatgatattcctgccagagttttagaacagtcctgttctccccctgaagtatctggtgctgatttgctagaagatgaaggctctgaccaggcttccagggtatgacttaaagtttcctattatggtcagcttcttttttatctttcttctttgataacaataataagttgctctgctggattttttttttcagacaaaatggccagagcaatcagaggagctgttaggactaatagttagttcattgagggcactggacagtgctgtcccacatgggtgccctgaaccaagaagacgacctcagtctgtccagaaaattgcacttgtactagagaaatctccaaagaagcttcagccagatttggttgcccttgtcccaaagttggttgatagttcagaacactctcttgccgcttgtgcactgttagatcatcttcaaaagccagatactgagccttcgttgaggttaccggtaagatttcctatttgtcactatgtgaaaaaaaaatgtatttacattgtttttattaactaatggctacacatttctacatttgtgtttctatattgtgactacagtgtatcagtatctaaggttagcttatatagtaggccagtaaatgattaaacatgcacgtgaactctgatacctaatgtagttctttgtctttaacatcacaggtttttaatgctctatctgagctagaatttgattgtgatatctggaaacaagcatcttttcatgcactcgaattgttggctgattcaaatgatgagccacttgtagaggccattacatatgttctcaaggcagcatcacaatgccagcatattgctcaagctgtatgtttaccatccaagattatgttactttcctattttttaaaaattatcttctcgcttttcttattagtgtgcctttcttgttctccataggctagagctgtccgatggagactaaaagatctgggtactgaagttcccctgtgtgtgcttgatttcttgtctaaaacagtgcatagctggtcagatgtagctgatgctttgttgaaggatattgattctgactgtgagcctgatagcagttgcctctctatgtcctgtagtactagtagtacagacgagttttcagctgaagggatgcattctttgcaaggtcaagctgtacatggaaaagatcatctatcagatgtttttatactgatagaaatgctgtcgatacccagattatttgttgaagtttctcaggttttgcagagggctttattgcgaggagcctttgggctgcaattagtagccatggtgttggaaagaaggcattctcacaggttaagtcttaagtctgggactgggactatggtgaatgattcacagaacaagcaagttctgttagacgggcagtttgaacatttgcctgtccaagaagatgatttcacttcagtccttgcacttggtgaggtattatctctatctacagaaaccagggtgcaagattttgtgcggatgctttatgctatcatttttaagatatataccgaggatcattatagatatagaattctgaagggtcttgttgaacgagcaacaaatacttcagatagctgccgagcagttgacatagatatggatgtcttggtatttcttgttaaggaggaatttggaattgctagacctgttttgaacatgttgcgtgaggttgctgaagttgctcaagctgatcgtgcaaatctttggcaccaaatatgtgctactgaagatgagaatatgcgtttgcgagaagacatggatatggaacaaacaaaattcactaaggaaaaagatgtgttaatgcaacaactaactgagtcagaggcagctaatgcgcatctaagggtatttccttgtcattcagctgtttggccggactattgttgtctatttctagcctaacctttttcttctaattttcttgttattgtagtctgagctaaaagctgagaaggatcgttttgtccgggagaagaaggaactttctgagcagatgctggagatggagaatcagttggaatgggtacgatcagaaaaagatgagcaaattgtaaagctaactgctgataagaaaaatcttcatgatcgtctacatgaagcagagacacaactatcccagttcaaagcatggaaacgcgaggaactaaaggttagagtgaactaccataaagacagcatgcaatacttgttcgcgaccaaaatgaactgtccacttctgaagttctagtgttcatttctgttgttagatgctctctctgttccatattgcaagtcatctacacgttttttcctaagtcaaacttctctaattttgaccgagttcataggaaaatgtaccaacatctgcaataacaaataagtgcactatcaagacatatttcatggtggatttaatgaaactaatttgatgttgtaaatgttggtgcatttttttataaactctgacaaagtttgacttaggacaaaactaaaatgatttgcaatatggaacgaatggagtaccttgaaatgatgctaactctttacaaagtctgtcttatccatactgaatcccatcttttgttctgcacttcgatactattatagatatatgttactcgttattctcaacatgcctgtgcacctagaccttggttctctatattatgcgaatacactttctggttaatttggcatgctcttttcagaagttgtggatccacacctttacttctggtacttcctacctgcgatctgtagttgccacgaatcaagatccatacattgatttttaacaattctttcatggccactgcagcaccacacatttcatgtcaaagtttgaaactagcacatagtatcataagaatgtgattccagcatgccttgaggagcaaccgataccactacaccacgtgcaggattattcatgcatgataaattgcaagtgcatgttttttggatatgaaaatcatatggagcaagccattttggctttttttttttgtgttatcattaccttacatgttactactgaaagttttagtgacatcaactacatcaatgttttcccatcaaaacttatgtttttgcatgctacagaaaataaccaaggagaagaatgctttggcagagaggcttaagggtgttgaagcttcaaggaaaagggttgatgatgaattcaaacggtttgttgctgaagcacagactcgtgaagagattcggaaatcacttgaaggtgaagtaagaaggctgactcagacagttggacaaaccgagggagaaaagaaagaaaaagaagaccaaattactcgttgtgaagcttacatagatggaatggagtcaaaactacaagtttgccaggtcttccaccttgctaactttttacgttgccaaaataactagtagtcctaatattaattatagaattatttttcaataccaaagacaccctttatctttctagtagaaaactccttatggcgcagagttgttttccacttattaaaattagtcattaaaataaagtaatttggagaacagcaactaagtaatagccttaatgtctaattatagtttatcttagttttaaccatggatcaaatttgggtgctccacttttttttgggtaccagtttggaatgttttaacaactacatttccactttatattgggaaacgattggcctaaattcaacattctgtaaagagcatgcaaaaatgttgaaagtaggtcattctacagtttatgtagtagattgtacggcgttgaaccaccagtcaactgataaattgtggcgtgcgtaacattaaacgtgcaattgcacgcatttaaggcatgtttgcattcagttttttatatttctgctcttaaatgattaaatgattttggaatgttcagtggtatttgtaaatcgtaatgatgaaaaagctcaccgtatttgtcacaattcacttttttcttctttaataacttccccagaccttttcacactatatttgatttctgacacatatcttcctattgcagcaatatattcacaccctggagacctcaattcaggaagagatggcacggcatgctcccgtgtatggtgtcggcgtggaagctttatcactggatgagcttgagacactcacaaacatccacgagcggggtttaagacagatacatgcaattcggcaaaggaaaggtagcagtcatcgcttgagtgccccttcgctcccgcacgtcccaggtttatactcctcgcctccttcaatggcagttggtctgccgtcctcgctgatccccacatcgtccgtagcacctaatggtgcaggcatccatggaaatggccacatgaatggttccatgggtagctggttcaatccaacctaattcagaagatgcagcaccgcaacaccggtgtccattttgtgcatcaattcgacgtatcacattttgcctggccgtatttaccagctgctgagcaatccaacgtgataccctttttgtcctcgccatttggtttggcttttcttgcttgtattttgaactggtagcgccgtcggcttgatagatcaaagagcgttaagggggtttccgcatggaataagttgtaataatcaagataatccgatggaactaccaggtattcaggtgcaagtgggaaagctatcgaaatggttgatatcaccaattgcttggttatttctaaaagcattgggattttttttttgttcaaacttctggaaaggtgcaacatgagaaaagtattccagtttccataggcgtgtctgcctgttcttttactggcatgtcttctgtaccggtgtctagctttctcagtgctatgatggtgctcacatagtcacattagtgcacactttcctttgtttatgcacatggtctgaaacctgaatcggtcatccaaatttcgaaataaaagtcttaacatgaatatcttgagaagaaaaatcaaggctacacacgttattgtcttcttgataaattgaaagttgacgggcttgttagtaactgtcatccaattccaatatttgcactgtcgtaaaaacgtgaaatttgcacttgctggctaggccaatattcgattaatttgcaagtagttgggcctaattagcaacacgccatcgaaggcaatctttcggcccaatcacggcccaggtttgggcgagagcctcgggtcagtgtcagtgtcctctcgaaaaacgaaaaaagggaaaaaaagaagaaaagaaagaacacaagtggccatgggggatgagatgaaaaatgcgtaacttgtctcttcccgtcgcacgttttcacaagacgtgccaaatcgaaatgcctgacctagacgtgtcaaaaaatttacaaataaataaacagaggtttact

SEQ ID NO: 7776 - DNA, 1570 bp, Oryza sativa
acactatagaatactcaagcttccggccatcagctggttctttggtcgctggcctccttggggcgccattggatcaggaagaggaggctgaaaacttgcagcaagcggtgcgcccttatgtgatggccctatccccaccgagcttttcttccaccgcccctcctctcgttctattctcggatgcttcttgcattagaggcattcttttcgtttcgatgaatgatagttaagcggtgtcttcttgaccttgcaagacttttcatcgaaaaacactcttcttcacttttctcgtaatatccttgccaacatttctcgtcctctcgcgtctatcactcctcccatcttctttgtccccgtctatccctcttgagcttgtgacttgtgtgctaaggtactttagatgtactacttttgttattatagatggctatgtagtgagttggtctatgtttctgatatatcttttgagttatgaatcaattagttgtatggtcgtcactcgtcagtagttccttgcgtggtgattgatctctctctatatatatatgctccttgttttattgatcctaactaacagggaaagaagatatgccatgctagtaagcaaagggcaacgcttgtggtgtttaataccttgtgcttgtgatatgtcctctctctctctctctctctctctctctctctctctctctctctctctctctctctttaacccttgttcctgtgtattcacagtgtgtacatcagtacatgttggtgtttctgattctctctttattttttgttgatgccgtcacgcgcttggacagttggacgtgcaaaatctcttgctatatatattatgctgtgtgttgtttcgtccgtgagactgtgagagtgatgttaatttgttctccggatcctctctgatctgttcgcatttgctgcgtcgaaaatgcgagacggaccatgcatgaaccgcgaacacagccgtcgtttcaacacacaaaaaaaatgaacgaattttcactggtcgcgctggctctgcagtctgcacggacactatttacgtgcactgaaacatccaggaccctccatcgagtatatatgcacgtacacgtacgtgggtgtggtcctacgatcgaactgcatacatctaccggtcgtatatatatacggtagatgcggggtagtagcgttatattaccgcgtctgcccacacaaattaacatataccggcccgacaccgatcgcgaattaaccccgcattcaaatccccgcgcgtcgtaccacgctacgtacgtgcgatttcatcgcggatgcgcaggcgcgcgggcgccgcgcgacacccacaactgaacgcagaacgcacgtacgtacgcgcgcgacacggcgccagcagcagccatcccttcccgggcgcgccgccggctgatcgatcggtggcgcgcggcaggccgggggcgatcggatccatccgaaacgctctcgcgcggctcgccgcgcgcccggcccttctgctccctggccgggcgacacaccgtacgtgcgcgcgacacagatcgatcgatcgatcgatcctgcgtatagc

SEQ ID NO: 7777 - DNA, 1969 bp, Oryza sativa
  unsure (1)..(1969): unsure at all n locations
ttttgcttaggttcgatatattctggtggtcaagcgtctttatatagtttgttcagttctcttgctcttttttttcttggattcgattctggcgatcgagcgcatttatatagtttgttcagttctcttactactttttcttgggttggattcgattctcgcaatcgagcgtcttcattatacagtttgttcagtcctcttctactatttcttcttggatccgctcccatatgatagatcgtccgatacgctgccatggccccccgggcggcatgcatgcgcgcgcggcgacggcacgcacatggtgacaagcttagtcgtcgacgcgcggcgcgccacttgccactcgagagggcccgttgtctgtgtgtggccggtgcgtttaggttagcaacgcactataacagtaggattgacgattgttgacaagctagctagccggcctgcatgcatgcaccatcgctgcggcatatgcatgagatgaaaaagagagaaaccgggggatgtcaccctgctacagcctacagcgtttgcaccggacggacggcccgacggctagctagcaacgaaagattcggtatcctacagttccctccagcgatagatcatagatgaacagggtatctcatctcatcgcattggatttcgaacaattggggtactccctccgtcctataataggtgacgtttttgactttttatttgtaacgtttgaccattcgttttatttgaaaaattagtgtaaatataaaaaaagataagtcatatataaagtacttttgataataaagcaaatgataaacaaaataaataataattctaaaattttttgaataagacgaatgatcaaacattgacaaccaaaaattcaaaaagacaagttatatgggacggaggtagtacgtagcatatgccgacaaataaatgcacctgcttgagaatgccttggtcaacatatagggtttctgtaaagtgccttctactgctccagtgctccttgctcttccgcacgaggataatcattctcaaaataaattgaggtccttctcattctaaactttacatcatgtcacatcaatcgtttgaacacctatatataatattaaattaaagctaaaaaattaactaattgtaaagattgcgactaatttgcgaaccgaatcttttaaatctaattgctttatgatttgacaatgttgcgctagtaaacatttgctaatgatgtattaattaggcttaatatatttatcttgtggtttactgacggattatgtaattagttttcttattagtgcccaaacaccccatgcgatatgctatataatattcgatgtgacacgccaaaactttacacccctagatctagataacccctaagttatggcaaattttgctacaagacatcgcgactttgcggttttagccacggacaccgcacgaagtcacttttgggggaagacactcttaaaatgtggttatttgccgatggacaccgcatacattaaaatattaatttttgggtcaataggagagatgaacactgtaaaaggtctaaaatacccctgggcccacttgtcatattctttctccctcaacaaactccctctcacactctagccaaagcgccaccttcgctgcgaaggcgacgaggagtaacgcgtgcggggatggccgccgcgttgcccgagcggaggccgcggcgaagaggaacgcgtgcanggacgccgcagcgacacctgctgtgtcgcccgagcggacggaaaccccccactgctccgccttggagagagccacgggtgcgttcctgccagtctgggtgcacggcgagcagcacaatggcccgggtgttgaagccgttgtcctgcttgtctttgagctcagtggtggtctcgtcttcctcgccgctgtcgccgccattgcgtcgtccgatgagcccgaccaggccgcgcttgatctccctgtccatgcc

SEQ ID NO: 7778 - DNA, 7214 bp, Oryza sativa
aattattattttaatgggtgtggtgtccaccagcaaatatccaacttttgagaatgtctttcccaaaagtcacttcgtgcggtgtccgtgggctaaaaccgcaaagtcgtgatgtcctgtagcaaaatttgccgtaagttatctatccatacatgaattgatcgagaagataaattaaagctaacacatgaccaccgcccaaaaacatactttctccattctaaaatagttatctttctaacattcaagatttattttaaaatacttcttatccaatcatcttccattcaaatttctcactattatacctataactaccacaccacttctaataaccatatactgtattatcatttaatgagggagactatgttattttttcttaaactttaatacatgctaaactgcctaaaatgacaagtatttcaagatagagaaagtagcatattggtttgtacatcaaatatgaatcaacacatgagttgtaacatttgagattattcagattatggtgctctacaccatcttgaaatgtgaaatcaaaatccaaagtatgtttaaagaaactaatgataaattttctgggagttgtaacatttgtccttaaaacttctactccttcatttttacgtgcatgcttctcaaactgctaaatagtaagttttatacaaaattttctaaaatgggtaaaaggaaaaaaaatagtggagattttaatatatgtgtccaatatataatgtctatgccatgtgatcaaactcatccaatttatccaatttatatgcaaattagataaaaaccactatgcaaaaccatcttaattaggaggttatataaatggtacaatattgtaaaatttagggggttgaatgtccggtttcaaagtccaaagtgctaaataaactttcatctaaaatgtagggtgtatttggactttttcaaaatcatattaatccatttttaagtttttagctaacacttaattaattatgtgctaatctatcgtttcgttttaagtgctgagaaggaagagttcccaacgtccccctcaaaggaaaacaaccttaatattccctattgatttgccaggtgtttctcaatcagcaacgtcttaatttgaagttgtaatttaaatgtaagcagataattaagtttcagatatactccatactagttgacaaggctctttagtttaacaggatataacactttggtagctgacattgctcatatgttatcgtggaagggaaaatattttccatactgttgactacacaaactaaaagattgtgcatatatgcaccaaaagatagatagatatcttcacctataactacgagacatttgtataaattcataactctcagctcattgaattggagaacagcatgaagtgattattaattacaaacaccatatataggcctggtttagttcccactttttcttcaaactttcaacttttccatcacatcaaaactttcttactcacacaaacttccaacttttctgtcacatcgttttaatttcaaccaaacttctaattttgacgtgaactaaacacacccatagaaatctgctatatctaaacactatatatagatggttctggccatctcgtgttcaaaatcatagaacacccaagaagtgcgcacggtaaatcaatgaagccgctgtatgtttgttaccgtgtgtgttttttgcatgttaccaggtgtttctggcacacgggagccttctcatccctagtcgtgaatccgtaaactttctatatatattggagacgtacgactctttctttcaagaaaatctatacttacagcaagcaagaagctcgttttcaaaactcaccatgatgaatacaatggtgcactactacattcatactcactccgtcccaaaaaaaaacaaaccctggtttccgtgtctaacgtttgaacgttcgtcttatttgaaaaaattataaaaaaaattaaaaagataagtcacgcataaagtattaatcatgttttatcatctaacaacaatgaaaatactaattataaaatttttttatataaaacggacagtcaaactttggcacggaaactcagagtttgccttttttgggacggagagagtagacaatacgtaatcattgtcctacaattcccaacaattacagtacagtgcttcttgatgacataaagggttatagtacaggatgaaacagttgcacgcttgaaataatgcaaatgcaattcagcaatatgcgaataaagtgaggtccaaagaaaaccacatgtgaagtaactgtagccaattattaggccaacataaaggaaagcatcactaacagttttgcagcgactctatgaagaacacaggacaaaagcatcgacgcactaaatccagaatggaacagtgtagcttgatcaacgagttgattatgcagggagggtaaggtttacagcggtccgggaaagggacacgtccttttctacctttattcatcccattcctcgacctcctccagtaaacagtcaaattctttacaaaccaaattgaaagttcagagatattgcttccagttttaataacacagtcagaagcacaccagatcaacaaaacatgattttctcaggctagactgttatatgtttttttaagtgaaaacaggtcatgtcaaaaatttcagtgttcatgctggaaagtgaaacacttggtcaaagttaatacaatttcctgagcatgttcgaatcttttccaatatttatcatgtcaacattgtttaaatgagtttctataaatggacacaaacaaacgtttcaccattacctcgtattagcttctggaataaaagcaaaaagattcattactagccttcaaacattttctttttctcccatcatcaaaccgctgtttgattaccaattaattgcagactgctcagcagcaaagttgttaacttgattttcctctatgtgttaactgttatcggcatggatgatgcccagcaattttttcttttggggtgaactcaataatgcattggaggataaaaaaggtcgcgagtactagtgaatcaactgcaatcaagaaatctggaggacggatgtgtggcatcttggtttattcaaatgatcaaatcgtaatattctaggagaatgacattacattacatagttttaatgtgcatggggaagaaaataaaaggacaggaatgcgtaggtcaataataaaggaagagagggtaaatgtgtacactgtaagtgcctatattagatgtgcatgctcaagccactattcgcatgtgcaagtacatacccgcacattgactattaaaggtgcaaagacacagtcaccgaggagaatattttcaaggagataaaaatagctgacgatgataaactaattgcagaaaactgtccgggccaggtcaatgaatgctgattgcagaaaactaatggctggtttggtttgaggacctgctaaaatttttagtagtgcaaagcccaatgcttgggcaagtttgggactaccaaatttttggtagaggaaagttgagaagagtagaattgatttgatgccaaaatgtgactatgagagacaactatgtgaacaaaaccccaacgttttggtagtgcagtacttgatttatttttttttaaaactaaacagtacttgatttgttaccctaccaaattttggtagggcaaaatttggtatggtagcaaaccaaagtagccctaagccaccggacaccagcaaactattcatccagtgaggtttaatcaacaaagagttttgagaagacactaatacatccgctcttaagcatcacactaactgaataacatgaagatcaacagaaggaaacaccattattttttaacaaatttctgatatcaagtcatgtgttaattggtaagtggaaacaactatgcttgttagttttacatggccttatcattggtattgtgtacccaagtcgatatctgacatgttttgcattcagaaataatgcatgtgaaaaaaaagagattatcctgatactagctgaataagttgtcgtttgccacaacagtttaaaatggcaagtggtagcagtgtactcacccattctccatggtaaagtgatctgtagtacttcacaaatttctcagaggcaccagtgtatcgtcccctttggcactcaaaacacttgaagccaacaaacttcattatagaaaagaaagtaaggacatatattattttcaaataaaaaaagttgaagtacgaaacacagagaaactgctaaggcctcactgtggcaaactatacatgtggtactcaatatagccagtaaaacagtgcctggttttagtttgttgtcagaaagcagaggtcagcaggtgctgttttcagttaaatctgaagattttaaaaaagaaggaacttattagcaatattgagaatagataatacaacagaataagatgttgtatgaatgagaacatggtcatgaagggtgatgtaaaaagtgggggaaatgaaatgaagtgtttatatgtgccagtaaagtttcagaaagagtaaatgggtcatcaatggaatgtattaggattggtttgtttaattaagcacacttggataccagattcctgttcattaaaaagacataggcccaatgtattaggataggcctatcaaattaaccacactaaaaaatagacaccagatttcaattcactaatcaatttatcataggtaaatttatttttccactggtgtgaattaggaaagacatgcagtggtaaatattgaagtgcactgtaggcagtaatcatgatgacactaaactgccataaccagaaattacctgcaaccggaaacattgagaagaacaaactgaactgataagcaagacataggccctgtttgggggagcttctcccagctgcagcttttcccaaaagctacttctgttagaagctgccccaaacagtccacagcttctgagaatctgtagttacagggcctatgtcttgcttatcagttacagcttctgagaatctgtagttacagattctgaaaaatgaactaagatgccagaagctggagaagctgggtttcagagcttttccagattctcagaagctggctaccaaacagctgcttctcagaatctaaagctcccccaaacaggccctaagaaacgcaattcagtctgaaatgttaaaacagatagagaacaaagcatagagcatttgcaatttcatttcgaaatacttcaaaagcttcagactactcttaaataataaactgccatgacatataatgcgaatcagaataatcaacttagtgaaggaattatcattgttctattatgtcaataccaaaagagaactattaccaactagtgaaaatttctaaagaactgaaagaatacctataaggctatataacatgtgaaactttcagctagtaagctgagcttgcaaaacaaactttaacactttaaactgagcattcaaactattaaatatccctatttcaacttaggaagcagaatattcactaatttagccaaccgatggatttccgtatctaaaaatagcttctagcacaaacttcaaaactttcaacttgaatattccaattttcaactgaaaccttccaacttagacccattcatagagagattacactatagttaataaactagatcagaagcttcactgccatatcaatctaaatagattattgcttcttccttgcacccaacgacatggaattttactatagcttttccctgacaagatttgtgcgcaggcacttgagtgtaaaatgagagaggcgcaaaattcccagcctcccagggggcaatgatgcaaccacaggatgaggcaatccaatttcctagtactaaatttaacctacttaccgccgcagatcgataaaccgcacacgaccacaccctcctgcaataatcatccccctcttcgcagcctccgcgtcgctgatgacccctgacaacgcaggaccaagacttccagaatgatccccccggttctcggatttagttaggggcaacaatggcggcgagccggcgggtaccaaatgggatggagcgggcggtgtgggactccacagatggaacggaagcttctggaaaggatcgcgtacgcacctcggccatcatctccggggaggcggggcgcccggttacccgccggcgtcgcgcggcgcaacggcgggacgccgaggaggcggccgcggccgcggcggtgcttggtgggcgaaactggcgtgggccgcggccagcctccatggctttaggcctatgggggttggattcttgtagctgatgggcttacagaccagaagagcccattgggtatagcccaataagcccagaaggagcgatggtccatcccgctatgttggtgggcttttttcttggatacgtgtgttggtgggcttgatatgccattggacttgttaggcggaataagttcactttatgctcctcatctgaatgtcgagtttaaatcacattctttaaccgcaatatcataaatcttgaccacccaacttacaaaaccgggttgaattagttccttcagaggtatagatggatggttttgatgatgtggtagtgaaagggtcaattaggcctagaggggggggggggtgaataggataatttaaaactttatgcggaagctaaaactgagttagggtcggaaagtctgatccacagtcagactatccgaaaatatcagatagtctgatgttggatcagactgtctgatccactaaaagaacactacaagaagatctagtgcacaaacaagagtatggcgcaaacagtgactagatctatagcagcacaaaagcaaagctaaataatgggagaagagatatcaccaacaatgaaattcaccgagttgttcccggagttcaaatccttgaggggattctactctccgttgaggagctcactaagagccgggtctttgctaaccctttcctcaagaggttgcactaagcactcctccttccactaaagggtatctctttccttgtggagggagatccggccttcacaaacttctcccggccaaccacacgtagatcggtggctcgggagtgacacctagccgtctaggagtcctcaacatccaagagtaacaaacaccacacaactcttggtcaaccctagtgctcaagatcgagtgaaacacacacta

SEQ ID NO: 7779 - DNA, 45006 bp, Oryza sativa
catcctctcacagagactcaagttccattgaatttcggagtctctggatcatcggatactccgatcacatcggatagtctgatttaaaactcactcaaaaggaataaaaagcaattcaaaacagagagtgaagttttgagaaatttcagatagtccgacgtatcggatagtccgaccttatatcggatagtccgatattttttagccaacactcagacccaagacagtgagcaaagttctgtgaaatttcggatagtctgagcatcggatagtccgacagacataaaacaggaacacttcaaataaatgattttgagcactagtgttctaccaattatatgcatgtggcatccctcttaatagtatgacatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcaatctcccctttttggtgattgatgacaacacacttagaagtaataaaagattaggattttggtggagctccccctaaagatatgctagaaatgaaataggagagctccccctcaatctatgcactagattagaaatgacaatataacctcatgcatatgccaatgacaagatatttcacacatttgagcatggataatagataattgcacataacaagacacaaaagcccaagattcgactagccatcacgaaaggagatagattaccttccttctcctcttcttcttcctccataggagccttgccacgatccgcatgagaggagcttgcctcagctgcaaaagggtcctcaatcacatcctccccactgtcctcaacctcagaaccatcgggagaacacggcaaatgggcgttgcgaaggaggttcttgagccgtcgagtgtccttcttccttgctctgcgttccttggcttgccgaactgagatggtcttgcataagttgaagatggacttgaagaacctcaaggacgagttggagtccggcttggtgacggtagcggagtgaccggcacgagaagaagcacgagtggttcgtccagccggcacaacagcagccttgatgggacggacttggtaaccggtatgtgccacctccttgtgaaacttcttcttggacacaatctcaatcatcttcgtaatgtaaggcccatagctaagtcctcgcttaggcatcatagagataagccggatttcttcaaagatgaagtcaaaggcgtcaaagagctgtgggtgagccttcatcttgtaaagcaaatttcttgtataggcaaggacgttgctagcatcaccttccttgggattaagagttttgcgcaagagcttattgagataggcatagaagggaaggagacctttgatggtgcctaactcatagtccacatcttggtacaagaagtgaagagaatttgtgtccatgggcttctcatcatgaatcttgacacgattggagccggaaaccccaaaatggcagcaaacttggcatatgacactgagtatatgatgccatctatcatccaatgaatagtcttttctttgttgggctcaaagtaaactgtggcatagaattgtgcgatgatttccttgcaccatgggtattgcaagcccatgagttccttcaagttttgccgagcacaagcttcaatgacttcatcaataattggatcatgcaactcctccatatacttccaatcaacccactgcataagaatagcccccttcttaggtgcaatcactatctcatagtaatcctgctgaaaaaggttccaaaaccgaggatcagtggacaactgttgaaatttgtagggatctttcttacactctttctccacttcagtccacttgcggttccaccttacgactcttcgatgataattaggatctctagagggagcagtgataaagaaaggcccttcttcctgagcagcttgctgagcggcaatgtcctcttctaactgaatctcttcctcaaaggatggtgcatgagaaccactaccgtgacccggctcagaagaatccgtaggattgcctctccttactttgctagcaggtgcacttgatccttctccactgactcggctgcggcgaagaggaagaggagcaccacactccacattagccacttgagctgcttggtcagaggcttgagcttgcgcgtcaatggcatctttgcgggattcggacatacgccgtatagcatgacgagccttggaagagggagagcgaccttgagaactcattgacccacggcgagagtaaagttgattcttgaactgacccctgatcatgaggatacactgatttagaacagaggataaagattaagaagaagtggaagaagaatacttaaatgtgaagcaaggagaaatttggactgggccaaaagaaggtcggatagtctgatttgacgtcggactatccgatgtacatcggactatccgacggcatatcagacaatccgacgaccttttgccctagaccaacaaatctcgattcacacaagaatatccaatagaatcaaaggatcttgtaggtactagatctagacactaaaacaagaagattcgccgaaggaaatcttgaaataatacatcatgagggagatcgaggaaaaacaaggaaatacctcaagaaccaccaagagaatcactggggaaccagtgatttggaaggagttgagggagggaaaccaccctaaagcgaaggaatagcaatcggagactccgaaacgaagatttttggtggcctagaactagggtttggagtggagaagaggggtggagagagaaacgactgagacaaatgactgaaggggtaagaaagagttacccctagggaggttaagtccccttgcccttggccccacgtcgaatagtccgatttgaaatcggactgtccgattatggtcggatagtctgacttgatgtcagacagtccgacatcctttgtggcagagacaataaaggatggctcaaggaagaatttttcaacaacattttgataggatgaactcgatggctagactattacttggacaaatgcagcaaaagaaagaaaaactaggcaccctcgagagagggaatgtacgaatctatagcaaattgtgcaaggaccaagattcattagagaatgagatccccgtacacatagattcaagttatccacatagattatgactagtgtttattcatgaattgaatgttcactttgtcatgatgtagcaagcaaacctattctagtaaatgaaaaacaaatgcatgcaaaagatcaagccacattccgagaatccaagatgtttagctcacttctcaactcacaaaacctagcttcatctagagacttggtgaagatatccgccaattgtttgtcggttctcacatgttggatatctatgtcgcctcttgtggaatggtctctcaagaaatggtggcgaatatctatatgtttggttcgggaatgttggacggggttattggctaacttaatggcgctctcattgtcacacaagagtgggattttggacacatttaggccatagtctctcaaggtttgcttcatccaaagaagttgagcacaacaactccccgccgaaacgtattccgcttcggcggtggatagggcgacggagttttgcttcttggaagaccaagaaacaagggacctacccaagaatttgcaagaacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacatatgcacacactaagcataatattgggcctagatgcacaaaggtaaagaagtgagccaatgatggaacggtataccttttggtcgacgtctttaccttgctcgttgaggtcgaggtggccatttgatggcatgggagtgtggattgcttcgcattctccattccaaatttcttgagcatgtccttcaaatactttgtttggcaaatgaaggttccttcctttagttgcttgatttgaaggccgaggaagaactttaattcacccatcatggacatctcaaaacgtttggtcatcatcctactaaactcttcactaaaagacttgttagtagaaccaaatatgatgtcatcgacatatatttggtacacaaaaatatcattatcatgccttttagtaaaaagagttgaatcggctttcccgatctcaaagccatttttcacaaaaaaattgcaaagacactcataccaagctctaggggcttgcttaagcccgtagagtgccttgtgaagcttgtatacgtggttgggatattttggatcctcgaagcccggtggttgctccacgtataccaactcgttgataggcccgttgaggaaggcgcttttgacatccatttgatatagcttaaaattgaggttagtagcaaaagcaagcaatatgcgaattgactcaagtctagctatcggcgcaaatgtttcactgaaatctaatccttcgatttgggtgaacccttgcgccactaacctcgccttgttccttatcacgaccccggcctcgtcttgcttattgcggaagatccactttgtgctaatcacattttgccgaggtcgctccaccaaagtccacacttcattccgggtgaaattgttcaactcctcttgcatcgccatcacccaatccggatcattaagagcttcttccacccttagaggttcaatagaagatacaaacgagtaatgctcacaaaaatttgcaaagagtggatactcccttgttgatgtctcctaagatgttgtcggtggggtgatctcgttggatactttggtggatttttgggtgagctagatttatcggagagagtggcacttgctcgccttcttcaccttgatccaagcttgaagtggagggattgtcggcttgggttgatgtaggtggctccacttgtgttgaggaagagaccccttgttgtggctccctaggacgcacgtctccaagagccaatcttttgattgcttcgctagggtcctcctcttcacctaacacatgtgagtcaacttgctctacttgagagccgttagtttcgtcaaatgtcacatcacgcgcgatctcaacaataccggaggttttgttgaaaacgcggtatgcgcattcatttgacacatacccaagcaagaacccctcatcaactttaggagcaaactttgaggatctagccttcttattaagaatgtagcacttactaccgaaaacacgaaagtaagagacattctctttaccaagaggacgttagaaatggaaaggtcattggagattgcaatcttacccaatcccattacttttccctttccatcgtccccgaagactatgttctcttgcgaagagccattaggatcaagggagcaaaacattgattcttctccggtcatgtgatttgtgcatccactatcgatcacccaacttcttccaccggagagatattcctacaagagatcaatttctagttttaggtacccacacttgtttgggtcctctcatgttagtgacaagtgccttaggcacccaaagaactctcttgatggaaaaatttttgtcccttggtcctacatacttagcaacaacacgaccactagcattcttcctaagaacataagatgcatcaaaagaacaatgtgaagcagaatcattaggaaggatactttttgccttaacaaaattgctaaaaccttggggcctctttatcatcatactcttgtccacctttccttttggtggaggaacatacccaagaccctcatggttgaagttgtccctttgatagcctaggtactcctttagggccttactatccatatggcacttaagtaggccattgtgaagaagtcccataagcttctcattttgcttttgcaaagcactcaaagaaatagagttagtagcacaagcttcaatatcaatatctttgcatctcacacatgattcattgcttggaacaattttggaacaagacggttcgctagggagagagacactattctttaaggtttcgaacttctcttcaagagagaggtatgctttgtccaagccatccactctctcttgaagttgagcgttcgccacctcaagattagcatgagactctttggtttgcttgtaaagccgtgccaaagcctcatttttctctctctccttagcaagctcactcttgagttcatgagatcgctctttctcatgaatgagcaaagcctcttgcctctcaagagttgcatattggtcctcaattctcccaagcaactcactcaagtgtggtagagattccttagttatggacttgaacaatttgtcatccataacctcatcctcaacctcatcctcctcatcactaacaagatcaacattaaatgatttgggaggagaaggtaccttaggctcctttgccatgaggcaaatgggagcatcctcatcacttgagtagtcgaagagtcttggcggtgatgaaggcttgacggcgaatgtggcgactccttcttcataacttgagcttgactcggagtcggagccgaaaatcatcccaaggtgagcttggccataatgttcccgcttgctatgcttatacttctccttcttctcatccttcttctcacccttcttcttatcttccttgatgtgggaaccatccttgaggtgagggcaatccgcaatgaagtgcccgggctctttgcacacgtagcacactcttgcagaatgtcttccacttgacttgttggagtgatgcttggaagaatttcccttgaagaagccgcttcgcctcatgaacttgccaaacttcttgacgaagagagccatttcttcatcatcgatctcctccttgctcttgctcttgtggctatcttcttcttcttcctttgccttcaatgccaagtcttacttcttgatgcttgtcgttgagctttggttgatgtattggatgacctccttggagtcttgcacaagcatgtcatgggcaagaatgtgtccaagcaaatcatgaggtgtgagagtcttgtagtccggacgctcacaaatgatggtaaccaaggtagagttccttggagtgattgctcaaaccatcttcttgaccacaacctcatcggtcatgtccttggagccaagtcccttgatctcattgacaatcttgctcaaccggtcatacatgtcacttgggctctcaccatccaacatcacaaatctctcaaattgccccttgaggatctaaaccttggactcacgaacactatccgtgctttcatgcaagttctgaagcgtgtcccaaatcactttggcactctcaatgccatccacacggttgaactcacttccactcaaggcactaagtattgcattggcggcttgagcgttcttgtgctcattctcgtcgtcctccttggtgggatcttcgggattctgcaaaacataacctttttcgactattctccaaatagatgggttaatagacttcaaatgcatcttcatcttatgcttccaagcggttaagcctaattaggagattatgctctgataccaattgaaagggtcaattaggtctagagggggggtgaataggataatttaaaactttatgcggaaactaaaactgagttagggtcggaaagtctgatcaacagtcagactatccgaaaatatcagatagtctgatgttggatcagactgtctgatccactaaaagaacactacaagaagatctagtgcacaaacaagagtatggcgcaaacagcgactagatctatagcggcacaaaagcaaagctaaataatgggagaagagatatcaccaacaatgaaattcaccgagttgttcccggagttcaaatccttgaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtctaggagtcctcaacctccaagagtaacaaacaccacacaactcttggtcaaccctagtgctcaagatcgagtgaaacacacactaggccctcaaaccccaaatccacaaccaccaagatccaccacacaaagaacaatgagggatttgagagagggagaaagagctcaaagatccaaagcaccttagcaccaagctcaacccaaagtgaatgagaatgaaatgagttgggtaaccctagaaaagggttaggtggggggtatttatagaagccctcaaaatgtggccgttgggagagaatcttttcatcccaccttggaaagtccgaggtgacatcggatagtccgatgtttttgacccccaagcaggccagagacagagaacgaaattctggagaatttcggacaatccgatcgatcggatagtccgatgtcatatcagatattccgttattttgaaccaagaatttcatcctctcacagagactcaagttccattgaatttcggagtctctggatcatcggatactccgattacatcggatagtctgatttaaaactcactcaaaaggaataaaaagcaattcaaaacagagagtgaagttctgagaaatttcagatagtccgacgtattggatagtccgaccttatatcggatagtccgatattttttagccaacacttagacccaagacagtgagcaaagttctgtgaaatttcggatagtctgagcatcggatagtctgatcaacatcggatagtccgacagacataaaacaggaatacttcaaataaatgattttgagcactagtgttctaccaattatatgcatgtggcatccctcttaatagtacgacatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcaggtgggttgacccgacccacttgtgctaactaaacgcttacatgaggaaaaatgagccccacatgtcattctcactcttccccctcctctctcgcctttttctctccatctctggcaaacggcagctagaaggatcacgccgccaagccaatcgagcctggatgctggtatcgcgatcgccgcctcaataacgacacacaaactcttctttctatctgctcgcgatgagggagtccatggcaggaacaacgcgagcccactaccacgcaaagcatggcaggccgccatactctagaaccaaattgcctacgacttccgtgtcgtgccatgatgcactcctcctattcccgtgagaacggatgcgtcctcgtcatcctcggccatgccacctcgcagtctaccgtcgtgctccatccccttttcgccgatcacaacgcatccacctccaccttctccccccaccctcgtgacgtgtctgggtttgaccgcttgcgctgccactgcggcatgcgtcggcatccccttgatcgtgcgtgtcgtcctcgggaccaaactgaccatgacactcgtcgtgtgcggtgttggtgaagcctacaagctataacaaaacctgtaaactgcttaaaacttgcttgcttgcagtagatggggagaaaattgggggcgggggagaggatgagagaagagtgagcatgatatgtgggatcatttttgtttttttttcccatgcaaacgcctagtcagcacaagtggatcggatcaatttgtcatatcagcgaaaccagccatctataccgtcggagggcctaatttaaccgattttacaagttggtgggggggggggttcaaaacttttggtattgctgtttacaatgtcaacataagggacctaaagggcctgtttggcaaaactccaattcctaaatttagcttaaggagttaagtttgctgtggagttgtggagcagcctaaacccacctccacctctctagttcattttgtgatagcgctccacccagctccaccccagttacactaccattttaggtggagctgaaactgtttaactgagttttaggagagatgcgcatgagctggagctgtgccaaagaagctcaaaatgaacttattccttgttaggtcgcgtgcggtttcaaaccatagtttcgaactgatgactaattagcacatgattaattaaatattaataaaaaatagaaaattcaaataagttaatatgattttgtaaagccactttattatagaaaatttggatagaaatgattccatttaacagtttagaaagcgtgttcacgatgtcaagccgatgttacctaacgcctccgttacttactgacggcatgatccgtgcaacgcaagtttcgagaccggccgaaagctgggtcgttctaggaaacttgctttttcgtctttttcttcgatggctcaaatcgatataaattaaataaaaagaaagcaaacgcatgattttttttttcaaatgacgcagcagcacatttaacagtttagaaagcgtgttcacgatgtcaagccgatgttacctaatgcctccgttacttactgacggcatgatccgtgcaacgcaagtttcgagaccggccgaaagctgggtcgttccaggaaacttgctttttcgtctttttattcgatgactcaaatcgatataaattaaataaaaagaaagcaaacgcatattttttttttcaaatgacgcagcagcaccataaaaaagatatggatgaagataagcacgtcatatagctctaacaaaaaaaaaattctctctccctctctctctctctaaaaaaaagataagcacgtcatccagcaacacgttttatactacggactcctccgaaatagccgcgcaaaaaaagaaaaaaaaaagcatcaattcttttcccccacgactcgtcgacgcatccagcgaacgcgaggtcgcgagcgtttccacgcgcccctgtccacgcgtcccgcccagcacctcgtgcgggccccacctgtcatacccaccgagagagggagccgtccagaatcagcccgccagcccagccagcctggaaggcaagagaagaaaagaagaaaaaaaaaaaggaaaactccgtgcacgcggtccacagcccaccccgggttccccctgcccccacggcggtggaatcggcacgcgaggtgggccccacatggcggcgcgggtccagtgaaccacgcctttgcacgcgagacctcctcccccgcggcctccaccaccaccccactataaatacacggcgaagggaaggcctccccttctcagcctcatcttttggttggtttcgttttggtattcccatacactttgtttctcttccccgtctcgtggtcgagagaaaccgagaggagagagagggagaggagcgctgccgattttccggagggggagatctttttcttctccctgaaggttcgagatcgatctgcgacgaggaggagcggggaatcgtaactttatttccgaggaaattgtaagatctcgcgcgacctgtttgttcttcttggtgttcttctgcctagttacttcgtttgttttatgtttgatctatagtcttgatgatctgtgaagactagttgttgttttcggtacggatggtaggaaaggtattttcctttgtttaaggaattgcaagatctcgcgcgacctgttcttgatgttctgtctagtacttcgtttgtttgtttgatctagtatgttagatgatctatgaaaagtagttattttcggtacgaatggtaggagaagtattttcctttgttggcgtcaaaatataatctttaatcactcagtcttgtgaatggtaattctgaattcatatttttcttttctgatctatatcgtgttattctgtttatgattttttgctgagtagatccccttgtgctcgatgtatgataagttatctatatcgtaatagattcgtatgtcaaaacttagtcgaaattttcgatctcatctcttctgttagccacaggtggctgattgaaatattcttcaattgagtctgaatttttatgttatatgcaaataattgtcccgctccagttcatatgtctgatgaaacatgaatgtaaaggaattaagactttggttatatgattcgagtctgaattttcttatgcttatgcaaataatagtccaaaagaattggtgatttttttgtgtagttcatatggttgataaatatgaatgtgtctcaaaagcaacgaagattttgatgacaagacaatctgctatttgagtctgaaatttcttatgcttttgcaaataatagtcatagtcagaacgaattactgaaatttccctccagttcatacggttgatgaaacatgaatgtatctctttagtaattgaaactttgacgatcagacaatctgttgcattgcctagtcttgcagattctcatcgatccttttaattcttctctgcagtcaacaaattgatgcactaatggagtccaagggtggcaaaaagaagtctagcagtagtcgttcctccctgatgtacgaagctcccctcggctacagcattgaggacctccgacctgccggcggcatcaagaagttccgctctgctgcttactccaacgtatgtatcgaatcaactgaacactagtttgtttctctaattggcggttgattggttgctcacggtgttaaattgttttcatctcttgcagtgcgcgaggaagccctcttgatagcccccttggctaccttgacctagtagtttagttactcctctgaattctcgttttgggctttcttacatctctctggctagctgcttcccagtgaccgggaaggtcatcagtcctgcttcctttcttcctcatctctggcatcgtccttcgaaacaatggcagtcctgtcagttgctgactctccaccggtctcggcgatcgggtttgagggatatgagaaacgcctcgagatcactttctccgaggcgcctgtctttgctgaccccaatggcagggggttgcgtgcactgtcacgtgctcagattgactctgttcttgatctggcgaggtgcaccattgtgtctgagctctccaatgaggtcttcgactcgtatgtcctttctgaatcgagcctctttgtgtacccatacaagattgtgatcaagacctgtgggactaccaagctcctgctcgccattccgaggattcttgagcttgctgaagagctatctctgccacttgaagctgtgaagtactctcgtgggacattcatttttcctgaagcacagccctctccacacaagaacttctctgaggaggttgcagtcctgaaccgctacttcggcggtctcaaatctggtggcaacgcatacgtgattggagatcctgcaaagccagggcagaagtggcatgtctactatgccacccagcacccggagcaacctgtggtcactcttgagatgtgcatgactgggctggacaagaagaaagcttctgtcttcttcaagacttctgctgatggacacacaacatatgctaaggaaatgaccaagctctcaggtatctctgacatcatcccagagatggaagtctgcgacttcgatttcgagccctgcggctactccatgaatgccatccacggccctgctttctcaaccattcatgtgactcctgaggatggcttcagctatgccagctacgaggtcatgggcttcaaccctgcttcccttgcctatggtgaccttgtcaagagggtgttgagatgctttggcccgttggagttctctgttgcggttaccatctttggtggccgcaaccatgcagggacctgggccaaggggctggatgtcggggcctattcttgcagcaacatggttgagcaggagctgccttctgggggtttgctcatttaccagagcttcactgctactgctgaaatcgccaccgggtcgccacgatctgttctgcattgctttgctgatgaaaacacggagaaagctggtaaaatggaggctctctactgggaagacgatgctgtcgaggagatagatggcacagagggtaagaagatgaggagctgctgatgagggaagcgcactgaagattaaagaatactcaaaactccagtagcgatcactctgttactttgtgaagcagccagccagactattcatatagtactagtatatgctatgaccaatgttctttattatcttgcatatattctgaataaaagggctctaggtggtctgctttgtctgccacagtgagcaaaatgtatccgaatatcaaactttaatgttgggaatataatacaagtcattttataataatgtcggcattgtcactccctttgtttgttccggttgtgtggtagtattctggtgatggtgggaggcgggaggcggcacattatttctttgtcaagatgcttgtttttcttcccttgtgtgatggatgataggtacttcttggcatgtctattggaccgtcaaaacatcttgcgtattggatttgcatgggaatctgattcgagtcgattgagactgcatttgttgctatcaggcaatgaattgagcactttgtacgctgatttgattctgtgtacgaacactacggcaattggcaaatatgacttctgttctgcacctatcactgttctgcacctatcagtgacccaagtggttctgcaacagggactgagacaggtacccctgctttgttgatttgatctatttcaaatgcagttactttccacgaagaaatgcttcagtgtcaatctagaaatgttgagtgaatgaatgttgaaatctgatatactcttctgtaccagtgccttctccgtgtttctgatattttgtcactagccagaaggaatgtgtcaaaataatagtataagattctctaagacaataatagccctcatgtactcgcctcaacttgagggctgaggcaatcgagagttggagcacaacattgattacatgagatagtcgagtattctcagcgaacaactgtaaattaaacaaactatgtaatcaaatgaatattgtaacaaattacaacagggagttttggtggtggtggggaggagcaatgcaaaagaatcgtcgttcaaaaatcaatttcatgtgagaaatgtgtcatcctatattatacagatgagaagcgacttcagctattgccacttcatggcaaagcgggcagggatgcagcagcagcagcagcagcagcttcagtaactgacgcttgtatgcttgttggagatgtaacggcaacggctgatctcctccttttgcatccccagcatatccggtgtattttccgtttgcttctcaagttaaatggtacctctatacagttggtccaaggtaacaaatgtgtcatcggtttgtgtcttgaagcagaggtgtcctgttgtatcttcaaagattcaagccactcgttctccaatgctgcaattgcgagagcacgctgcgtaggattctttatttggttgcccaggtaaccttgacaattttgtgccccgcaatagcatttaaccttctccccgaaatgcacaaacctgaaaaggaacgtgaactattgttactgttgctcatagaaaatcattattattcacaagactcctggaagaaaaaaaaatctttcttcgtgtgggctgggagaatagtcaccgtttcaacgctcccacataataacggtattttaatctaatacaaatgctaattggtttcataagaaaataacagaaaaaaatcgtggtgtttctgctaccgaagcatgatttggaaattcaccatctagaagaggaagtgggaagcaagtgaacaacgtttgagtggaggagaaaagataaggagaagatactcaaaacgaggtgagccattagcatacaactaattgagtattaattatttaaacttgaaaatggattaatatggttttaaaagtaactttcgtatatatgttctttgcaccaaaaaagcaccgtttattagtttgggaagcatgcgtgcaaaaaacgaggtaaattttctctctttcttgccgagtcattcacagagcccataatgtggatgtaaaagctacatgccacacaataatagtacaaaggttctagttcacacaccagaatttacatatgtacatatactccactagatatgcatatatttcaaatcatggttaaccatagctgattgcaggaaagcagtttctctatgcaggaactatatctccatatcaaaagaatgtattcattatacctttttcagtaagaatacttaggatccttaaaaatatagtttgaaaaactattgtttgcacatacctgtagtcataagttaagtgttctccaacttggatggaacgagaggcgaaaacaccaactcttgtctcaccatcaacttgcctggacaagccacatagacaatcaggaacattaatcatttcatactgttcacaaacaccgagtacagagcttttctgttccaaaaagatggcattaccatttttctaatttacagttgggatcacaactgtggttcagaaaacgtgatgtgtttcctttaaatgttgcatctattgtaaaatctttgctgatttcacacatgtagaaatttttatcacctcgccgtttcatgtcccaaagcctttgttcacatgttgcatcattgatgactggaataatgtttaaaacacattagaaaagcatttgaaaagaacagatgagcatagcattaagttgttgtaattagttatagagagaatagctaagagcctttgaatcaaacccagaaagatataatacgatgctatcccacagcgccataaaactcaactaaaaaacagtgaaggagacatactctgtcccaaaatggaagcatttcttgagaagtaggttgaattaaatggggaaaggttgcgattggttgagcagaggaagtaggtgaagaaattaaatggagaatggttatgatgggttgagatgaaaaggtaggtagagaaatagctacattttaggatgcactttgactgctagaaatagctacatattaggacagagggagtaataaaataaaaaccacaaagagctaaggtcacaagaataagtggcaacaagaactgccattgttcataattgtaggcttcgtagctatgttatgttataaaatagagtgggaacaaaatgtacactcgttatccaattttcagattaatataataagttttcatctaaagctgaggtaccttttctgttaaacagatgcaatgactaaacaggctttttcatgctaactaccaataagttgcttcaaatttatcttcaggaaatattcatgtcaagaaatttggattgtactgtaatggcataatgtgactccacaatgacatgcatacagtttactaaagaatatgctaatttgtataatataagtttaaatggtagagtaacttgtaccttcaccaacatactcaattataaaatcacctttttccaatggctccaatgaaatagcaccccatccacaacgttttgtctgtacagaaaagtagttgctgcagttacagacttattctccctaacaaatgaagaatgatggtgcccggaggtgtcaacagaaggtgaaagtaatctacatttgatggcatgacaacttcaaacagcactatcatagccatatgccattttacattaaagaacaatacaaaggaggtttgtggacttgaatacttttgagtcgttggcacaatacttctgttattagatatcatcaacgtttgaagctcagttccaagtttaggtaaaattcaaataatgtaatcagtaagttagttgttccatgatgatacaacttgtagctaaaagcacaggctcttcgacaaatgaggaacttgacaaatttgaaaagttacggcagataatatcacagcatgcaactttatatgtatgccgaaagagttacacaggtaaggaagaatgtaatggtaattgatgtccttaacgaaatcaagaaaaaaattgcaggacataattaccttgacagcttttatttttttatccttgcggaatggcttgttcgtacacatatctgagcagtggcaattcttggaacaactcatgtaaaggcccctgataaagtgcaggaaaaaattagaactcagagaaacatgtaaaaaggcaacagaagagtggtaacgagagagtggcaatttttggatggcagaagagagtggttgaaatgagtggcaaaaaagatgctaaagcaccctcagctacagtagcattagctacagcagtacagctatcaaaagcagataaagatttatataggaaaacaacaacggcaaccttcacacatacgtaacgtaatgatattttgaagaaacaaatgtcaggctacatttgattaaaacaaattggaaaaatggtatccagtcttactagtccttgaatgcatggtcaacattttaagactagttcattatatgataatgatattgataaatttggcattaaattcccagcatacataatgtacaaaaatacaggtaaaaagaacagaggacatagctacatgctgagacatgcaccctgttttgttagaagaggacattggtgccatctttagagcgcaatgaagaatttgtgcacgaatcaaactaaagctttcatgaaaacttctgtatgaaatgtattgacaaagtaagactgtttacctgcattcgcagtcatctttgcacgtagaatcagcactgcagtttgtgcacccagcttccgcgcgagaatcaggacgttttttcttgattaaatatacatcttttaaaaatcaagaaaacaaataggatatgtagagatgaaaagcagacaaagacgaaggtcattatagaaaatgtaatagctaaaggcttcattctataactgttacttaaggatactgcgtctgataaacgtaaagtgtggtggtttgcagacagctgcagtgaaatccctgatggttgaatcaatcttgaagtcttcattaacatatggaacaggtagtcggcaaaatacttcctacagaacaaacatgtcagtgtggccatgaagaaacatttcacaggcaacacacttcatcttctgaagaaaaaaaatgtttttttgtttgaatgagataacactgaaatacttttacaagggtttatagcattagtgtaacaaatatgctcctcgccaatcttcgtgaatttcaattgcactgctgatgttctttaggtgtatagtaaaagcaagtttcaaatagccctcctggcataaattaactgatgttttcatctttttcgtctccaagttacattacagcctcgctaactaaatttttataatactccctctgtttctttttgtatgacgttagttcattcaaatgaactaaccaacattaaacatttcagagcaggagtatattgtactaaaattacaaatgaacataaaaatatgtggcatcctatatatagctgcacaaatatcagccgaagtaaaaaaaaaagaagcaaaaattcacatcccaaaataccatttgtcttgtgacatagggggagcactactttagcagaattccaaaaaaacaagagaaacatgcccagaagcctataattgaaccatccaggtattccaaggtgactagctatgaaatgtgcacaatggctttatctaaaagcaattgaaacaaatatagaagagaatatagcaagaatggagttatatcatacaaaacactaacctctatgctgttcgtcaagtcagcattctgccaccattaaacaaagtagtcctgtcagacacttcaaacattacaaatattacaagaaggcatatgaaatgactatttgaagtattcttcaaaagaattagcttaaacagcaaccttttatggttttattaatttcccacaatccaaattaggataaaattttgaatgtaatggagacatcagcattgggcttgaaaccatgaaacaagtttgttaacctctggttaaaagcaagtaatagaaaaaatgatgctacacatgaaccttactaataagaacggaaccatagtgtcacaatcatttcatgtagttgaaaggagtacaaaaattatagagaagatgaagtcaaaacaattccggaaacgaatcagtgaaagatgaataaggatcgtgatagttcagtgtcacagctgcaccaaaaggactttgatgcattcatgtgtgattgcactagcttgcttagcctaggaacccagcgaataccagcaatgttatgataagatggagaaaaaaagaagattaagacttttcacttataaaaaagcattaacacttctagaaaaagaactaatactgtaaataacttctagcaagatcaaacaatattatataagcaggataagatgagttaaaacagaagagaggttaaagcgacaagaaagaaacttggaaaacatgtcttacattcactgagcacaagtgagaaaataattatatataaagacaatttgatatccatccaaagcagtaattgtcatcgacattaaaataatgcagcatacagtaaaacaaaatagctttgttgcacagataaaaaaatgaaaatgaacatcacccaaggagaaaaaagtatgttccaacaatttagttttaatcttacacccatttttttcttgaatcttgagaacatatcatattgtactagatttttttttggggggcatctagcaacataaagtggtcaatcttaagggtaaaaggatagacctcattttgaaggagccaatcagagggatgcctccaacagatagcacttccttggtcatcttttaaatgaattactggccatggtgcacattttgtatgtgctgcaaccgtacaccgtccacaacgccaaaaaaacatcttttgcttacagaccatacagccctgattggagataaaattaaattaatgcaagttcaagtaaaactatcactattaatccaagagcaagaagtgaaacataacaccaaaaaaaaacagagagagaaaagaggtttataacataacagcaccatggactgcagcaactctccttggctacagacaaaacactctagggaagcttctagaaggacaattgataaatgtccaatactctacttttaacttcacaaattacttttgtttgggcagctaccagtgagctctgatttgttttaggacatgaacatttggaaggtattctccagcaccttaaattacaacctcatttgaaaaagaaaaaaaaaatctcctgtgctcttagttgaaaaaatagccttccatgccttggcatgtggtgtgaacacatgtgaatatgtgatgcatggtcggtgacttgggacccattagattgaagttttctccattaaaaggacaaaatagagcaaaattgaatgtttagggctaaaataggatattttaaaaaatgttctacaaacaagaccagctcaaagttagaagatcataattaagtcttcacttttaaatatatgttccttcccccacacatattgcataaatttgtactgcccagctggccatgaacatgtgatagatttatacaattaaaactacacagaatttgactcagtattaatatactccttccgtcccaaaatataatgacatctagagttgggcatgggtatcaagcagaaaagtaaaataaactgagggatggttgtgattggttgagatgaggaagtaggtgaagacattaaatgagagatggttgtgattggttgagatgagagagtaggtacaaaggtagctatattttgggacaattattgaatgctaaaagtagctatattttaggatggtgggagtatgtattacccgtaggtgtgatagtatatactgcatcccttggcctcaaaacaataaataatgcacagctgtactgtctgtacattgcatgaaagtaacaactatccatgttatgaaattaaataagatggccagagaagcctacaaatttcagcagtggatttttatttagagtggttctttagtaaaatcttacatgctcccttatgtgcacgagagacttagcacatactagagcacactccagttcataagatcggagcttacatgttgagggcatttgaagctttcagcaatgaaatttgtggtatcttctgctgcacaagtcaggtggaacaattctccacatctactaaccgaacactttatttcttctccaggatgaataatcttagaacataatcgacattcaacctgtgcagagatgaacatggcatgagctgctaagcaaacaaaaaaacaataacaaaaactagtgctgatgttgatgtaagcctgcttttactgcaggatttacacagaatttcataggaaacagtcccttcattaatcaatttgacatttgtttattaatgagctgctgttttaacaaggcagacgcacataaaagtttgataattattaagtaaggatgtaagcatcaagcaataatagaaacctaggtgtcagctcatacaatgtttccagaactccaaccaggcatttcgtaaacattcagaatcggacacatatctcagtcctactgttggcattgagtgcagttagcagtccgaatgagggaaacaaaatgcatgaggaaactcctcccaaaaaaggactgattcttgcaccaaagtgaccaaacattacagcggtattaaatttttggttttttaaactttaaaatgcttctgcttgaacattacacaaatttgcgtagcggaaacacatgtctcagcacatcataagtatattagcaacatcaagcatagccccacggataaatacttcatgcattctagcatttctgtgtcagccatcaaacatctagtgttagcactactactttttatccacattatttctgattaccacctgacagaacacgaatcgtatggaatttgaagttatcaagatgacaagacatttaatggacattgcacgcacaccagtgtgggaggacccaaaagtgtcaaatttatgtgttcacctccatactgcatgctactgcagtgctactcccttcagtcaaaaaatattgtccttatggactttgtagggtataataaataataatacagaagaatgtcttatgaccaatctacccatatcattctaatgtgataataggaaatgcttaaaatacatggttgttcaaaattcaaatatacaaaaatccgagctcgtgtggtctaatgtttctaagaatttagaactagaggaaataaaatctgcaaaacacaaggacacaaccaacacattcaaaacttcaaatgttctaatacgttttcaaactgctgcattacttatctaaaaatgtattaccagtctaagcatcagggttacaattttttctcacccacatggtatatattattatctactcaattttgcccctgtaaaccactagatcacttctaaagtcataatttcactcgtcatgcccacgaagagacagttcagtttgttcaaacaaaagttctaagtaagctcaagcatctgttactacatcaaagcatatcattacgagcaaaagaaaaacgcgcaccgccttaggcgtgccggttaggaaaggcagctcgcagcgtccggccggcacgccgagcgccgccttcttcgccttccactccttaacgtactcctcgaacggccgacccgatggatgagccggcgcggtcgccaccgtggacgaaggcgacggcgcggaggacggctttttcccgcccccgcggcgcggggcggggcacgcggggacagcggccgcgcccgcgccctcgccagcgcccgcgaagctgcgaactcggccgctccatcggcattccaccgggagaacgggcgcgccgtcgccaccggaggcggattctgcttcccccgccgcctccgcctctgccgacgcagacaccgccgccgcggcggtggtgacggcggcggcggcgggctgctcgcctgctagctccccgccggcggcggcggcggtggaggggggttgcggcgagagggggaggcagacggtgctcagatctggcatggcagcgaggcgggaggggttatgggctagggtttggagggcattggaggtgggtggagtcgtgcagaagggggagaagggaatggggggaatggaggtctgaattggggaagaaggggggagcccccgcgcggccgcgcctcgcaacgtttttttgggggtgaaaattttttcgtgagtgaaaattttccccgtgctgcttttgcagagtggtccgcttgaaaattcggaattcgtttctctcaaacttgcgaatagacccttcacttgatatgaatttgtttttttacttcacctacaaacgcgggtgctcggagcacatccgaaagactgactagtatatcttgagattgataaagacttactagcatcctacacctagaagcacatccgaaagattaaacggcatattttgatattgacgaagtcaccacaaatgcctcgatgttgacaggtatatcacctattaatgaaaatatttaaccgtaaatacaagcattcatgtttagtatatggctcgaatttgggtaagctagcttgatcacaaggaatctaaccatttaaactatactcactttattataaatttctaaccttactaaattcaaattcaaagtgtacccatttgtgttttttttacacgtgaagatttgaagtatgttaggttgagtcatgtactaataattttatcatcacacctttagtacttttactgccattcttttttttagcgctgctctcacttgatttgcaacatatcaaaggataattttcttttcggacgaaataagatgaatttttttgacaaatttatattcgtccttcaataaacagcaacatttacatgtagccaccaagtgtccttttgatcactcaaaagatcatcatttgagcaagtttaataggatagccaactactagctccaattcaactatagccaatccaatagcttattcatacaatagttatatactacactattaatacctggtcccacttgtcatacacacactgtctttgaatccgtgctacagctggctacaaatatatagcccgctactcctctttcttctcatttatatttttaaaatatgtttacagctggcttatagcctcctactgtacctgctctcaaggctgctgatcgctgacagaccgacgagcgcgccgcaacaacgaatagccgttggatcggagacatcgacggtccagatcgaccgatcccctccccgccttcctcttctcccccctactgcgttggtagggttttacgcctcactgcccaccgccgccgccgtcaccaccgggcgcggccgccgccaccatgagagccctcatctccctctccaagctcacccgccgcctcctcccctccctcgccgtcgcccgcgccccactcccgcccctccgccgctgcctccacgcggaacccccaccgcctcctcatcacgcgccgccccccgtcgcctcccggatcctccagtccgagctgaccccgggcgcgggcgcggacgcggacgcggagcaagaacagcagccggcccccgaccccttgctcgacgagttcctcgcgcgcttcgtcgccgcgctgcggccgaccctcgccgcggcgttccccacccatgcccgccacgtgctcgacgagatgctccgcctcgtggcggaggccgtcctgtgccgcctcaccggggtcgagccggaggagggcggcgccgtcgagctcagcgacgacctctgggcggcggtgtgggaggtcagcgccgccgtgcgcgacgggatgcagcgggaccgggtccgcgccgagctccggggctacctccactgcgaggaggtgaaggagatgacgcggttcgcgtcggacgtcggcatccgcggcgagatgctccgcgagctccgcttcaagtgggcacgggagaagctcgaggaggtcgagttctaccggggcctcgacgacatgcgcgcccaggccgaggcggccgctaaccctgtcgcgctcccgccgcccaggctcgcagccttgccgcagaggaagggggagatcaagttcaagatacatgggttggacttgtcggacccaacgtggggtgaggttgtggagcgcgcggccgaggctgaagcgcattttgtgccacaggaggccaagccaatagaagggaaggcgaagaaggctgaggagaagctgatggcggttgatccgaggaaaggagacccggcgcctgccatggaagagtggaaggaggagctgctgccgaaacgtgccgactggatggcgctgctcgagcgtcttaaagcccgcaatgttgagttgtatctcaaggtgatatatcctttacttgaaggctctactattgtgccttatgtatgtcatgctagtcaagtagattactttcaggttgtaaaattccttgttctttcatggcacatcttctagttttaggtgcttttgctgctgcgctaaccgctaaaataccctgattatgtgatttcttggtttgatcagtttgaagtgtgcttttgctgctgcactaaaatggcctgattatgctttcttaggttgaccagtatgaactgtgccatttgcatcacattacttgttgacttatagtatttgacgataaaggaaccatcaatatatgtaatagtctttctgtatcagatatagctcactttcaccctctccaaaatgcatcttctgaccactaattttgttcagcgttttgttgaagattttaaacaataagatgtgttatctgatatttgttcatgattgttgcctatttaggaatagtgcaaatgttgcattcgtctcccattgaaatcctaagttttagctactagcataatcagatagactgctattacatgtccagctttcccatgattgagatagttgttctgcaccaacttttctctgtaacctatgactatttcagctgtatttaacgtggtcaggctagttcacatggaaatgaaacttcaatttgtggacaattggcatttaaatccattatttttaaattgagggagtactttgcattttgtaaagttggccaactgccactgagtttagaaagccttcagccatccacttacattgaaatctcttttgtagtttcacatgtatgctgtgttgtaatttacaggttgctgaaattctgctggctgatgaatcctttggtgcaaccattcgtgattactctaagttaatcgatcttcactctaaagcaaatcatgtggaagacgcagaaaggattctaggtaaaatgaaagagaatggtattgcacctgatgtcgtcacatccatcactttagtccacatgtattgcaaggtggggaatcttgaacaagccaatcaggcatttcaattccttaagggggaaggcttcccaccagatatgaagcttttcacgtcaatgatcagagctcatcttaagtctggagaaccaaaacaagcagaaaatttgttacgtgaaatggagagatcgatcaaacccacaaaggaactattcatggatgtaatcctggcatttgctcagcgtggcatgatagatggagccgaaagggtgaaaacatcgatgttacttgctggattccagctcacgccagagttatacacatcacttatagaagcatatggacggggtggtcacgttggccaagcatataccctgtttgagcagatgaggagttctggacatgaaccagatgatcgttgcgttgctggtatgatggttgcctacatgatgaagaaccaactggaccacgctctgagcttcctgttgaagttagagaaggatggacttaaacctggagttaaaacaaaccttgtcttgctggattggttgtctaggttgcagctagtgcaggaggctgaacaagttgtgcagaagattagaaaggctggagaggaacccctggaaatgcatgttttccttgctgatatgtacgcaaagtcacaacaggaagagagaacccgcaaatccctcaagattttagaggagaagaagaaattattgaaggcttatcattttgagaggattatagcaggccttctcgaagggggtttcacggaagaagccaataaatatttcaaaatgatgaaatcccatggctttgttccatcaccaacaattgagattggggtcaaggctagttttggggttagggggggtgttcatccaactggtaggcatcgtggttaaggctttgtccgttggcagtgatcagctgccattcaggcactgattctggtttgaaaatcttgaagtagcactgacgacgccatagccaattctgtcaactgaagcggcaaaaaaaatttccggcttcaattggttttgtttgatctgatatcagatgtcttcattttgaagatgcctccatgaactatggattcatacaagtagatggccgcttgtcctgttattgccgggattttttttcctcatcaattgtacttgcatgctcacacttaataagtcttttagtcactgtaacgcctggatatctaggttgtgcttgtgccaacaatcggatttatcttagcaaatatcagttatgacttacctgtcataggcatttgtcaccaaataaatgtttacattttaatgaacaatgaaattatatcacactgtcaaattggtgcagatgcactaatgcgctaagttatgagcattccatcccgtatcagcctgtctatgtatatatttattctgttcttatggtaggtagtattggagcaaacacgatgtaaatccgtgtaaaaaaacgcggtgtaaatcttgagcaaaggattcgtagaatagagagattagacaggcgcaccacactttgaatcaacattcatttttgaaatataatacattaggtcaagttgtgtggacgtgggattgtgggaagtacaatcgtaaaccatgataggcacaaaaggaactactgctatgtttgaacaagagcaataaggcaacggacagataaaagcaaaactccctccatttcaaaaatatatgacgtattttgttccgttagggtaaggtttgaataacaatcgctctactcggacatcatttatgcgataaatgaagcataagcataagtacgaacttttgaagactaatataataaattcatgtcacaaaacttatatcctaataaagtattttttggtcaaatatttatcctaacgaaacaaaatgtcttatattttgaaaaggagtatacagccaaatccttcttttattcacaaagagacacagcagataagtttaactgatatattgggtaccagaggcaacccattgaaatttaagttttgtcagaatatgagcacacaatgtgaaactctcattgttttacaggtaacacctctgacaaccatggccacatctcttctcgctggtgagagatatcgaactgaaaccactcactaccgctgagctagcttcttcaagtgttggaacaacttttgctttatccactgtcgatcatatggcagaaatgcctgaattgagtgatcataactgcaaatgcagaaaaaaatagtagctgattgttttttactttgaaaactatacacataaattaacattgcccgattctgatccaattctttaaaagttattttactcacactagtgcactgatgtcagctaggccatcaatgaagttatagaggtcagtgatatcatatgttatgtttggtaccattgggtttatgtccctaattttcctttcataaagaccacacagtcctgtcatttaaaaaaagagctgtggtgagtaatttacaaagagcaaaagtaaaataaatcaagaagcacatttgaagaaatgaaatagttccgattataacagagtagaatggatacatgtcatgcatcaaacgggcacatagcagatcataaataaaacaatgttttaaacagaataccaaaaaaaattgataatgtgcagctgaagaacatccctctctcctttctgaaaaccagccttcaacaaataatatgtaagaggagagtctagtgccataaatcctgataatgtctctaatgcactatatgcaaatttggacgtttgcagtttatatggtattgaactttcaagttaatttttctaaacaaatcgatcacatgagaaaagtgaattcataaaattgcaagatcatatcgtactcactaggaccatataaaaaaaatatctaagctattatctaagcattgcatcattagttaagctttcaaaaccgtacgtaccatccaatgcatggttaattgaattataatccataaatgttctagaagccctgttttgggatggttgcatcagaataatggtgtgcctcccagcctgcacaaataccaaaagaaaaaaaaagattcaatgcatgcttcaagtaacaagaaagaatggtgcaatttgatgatactgcaaacatgccataactacagagtgttcaacaaattcctgaaaaggtaaatatttccagagtatccattacctgaaatatatcaggctagtactacaaaagcgaggagtcgttatactaaatagtaatatgatagcatggtcagcatcacaattatgtcaaccagaaagctttattatctaaagacagtgattccctgataatacaacaaccctatccaatgtactgcttataaataaaaaataaataccatcagtagcacaaaccacatatctttgcttaaagattatagtatttaagcagtggcggagggctcggtagggcgaggtgtggcgctcgctatacctcacgccacccgataaaccccccaccccccacactttctccggacagcagggcgccgagccgcaaagagcgcggcaacgccgctttggatgagcaacatgaaagggcgcgaggcgctgcgtgggtgcatccgcacgtacgctcaccaacaggtagcaggccaagctgggcttgtttcatgtaaatgtttcttttgactattaaaccctagacccaaattcccccatctccttcacctccatcgattctccaatccggcaatcctcatcccgaccctaatccccatcggcggtgcggctgctgcctgctggagcggagtcggcgcacgagagggaaggtggaggcgaggaggggcgaggccgccaggctcccgagcggcgggcgcagagcggcggcatccgcaccaggcgccagcacagcatggcactgcggcaggcggcgactgcgagctatcaggaagtgaccagccagccaggggtgcagccatgtatcgcaggcagggcagagggcgccatcgccagcacaggcgcacagcagccagccagccactaacctctgccaactagccagccagcagcagtgcagcaccaacaccaagcatagcaagcaagccaagtcatcagcagaaaatggatagaaagaggaaagggaaggcattggcatcacaaagaggtacatattgttgacaatttaagaatattacaatttgcaaattcaaagtgtacaaatttgtttctgaaattgcatttgtgtaatttgttttgcagatttgaagagttacttcaaccggggctctagtagtagaaacccaagtacaaagcctgaatcttaaggagttgagatatgttttagtacatactcttctatttacacttgtttgcaaatggatgatgaattatgaacttgtgattagtgcttgttgccatgcttaatgtagacttgttgagataatgttgtgtcgtacaatatcatgcgttgagattttttttttcttttattcttgttttgtgctcgcagtagtccataggcccccgggccactgtatttaagcaaaccacatatctttgcttctatcaaaaagatagcaatggtccatacggcactacatattatggttttctatatagactattgctacaccaccggtaacttctgaacaatacaaagctttaacatatcatatgcacaaacatctcgatcagtacaacatgcacctgccattaagccaaaaaaaacacacgaatgcccaaaccctagaaccctgtgggaggaagggtgaagattggggggggagaacgggtggcttaccatcgagagcgcgggcgggtcacttgcgacggacttggagaaggcggcgcacaggtagggaccttcccgacggcacaccggactcaagaggagtcggcgcgcaggtcagaggaggtggagtcaaaagcggtaagagaggaccgctccggagacggaggaggcgagctttggggggtgggggggcgagaagagctatgtacggggcggaggctcgccggaggcagctctgagcggcgtcgagttcgtcggagtagccggcggcggcggcggcgtgtctgctgggggatttcacgagtcgcgggggaggggggaggggggagagcgtcgagcggtccgggtcggtggatggaaaaggagaccaggtaggagacccaatcctcgcgtgtgagttgtgacacgttcgcagcacgaatcttgaagcatcaaacttactaataagtgttgccctgttaaaccatcgaatcaattcttgtggctctaggatttccttcctcctagatttcctttcgccctgttgccagcattaagagcaaggataatagtatagctcactttctactattagcccattttaaaaccaacatatataatgattagctataagtttggctacaactttcttcttctctctctatctctcacatatgcatttaatgtatttacctaggagcatgtgttaagctagctcttgcatgagagccaacatccttgatttttttgttatctcgtctccacataagcttatagtaggcttatactccctccatctacttttgatagtcatatttccaaatcggaaaattctatttttgataggcatatttcaattcaacaacctattatcttaatgactttctcggatttaatgtatgactctccattctttcacacaagattggctaattgagcatcgtgaaatgtaaatattaatgaatcgcttgtttacgaggaatgactagtagcatgtttaaatggatgataagtagaattactattatacttgctctaaggcaagatgaaatattggtctgtgtgccaagatgaaatatgactatcaaaagtagatggagggagtagctcactattatacttgctgtaaggcataagtaatggtgtgacgttatcatcttaaagaaaataccaacatgatttttaatggcgtaaaagattgggaaagagaaaagagaatggtgccattctttttaacatactgataggcaacataatactacaatcataaagataatgctccctgtctccctccgtcccaaaatatagcaatttaagatcggatgtgacgtatcttagtactatgaatctgaacatgccccctatccagatttatagtactaggatgcttctaatccggttctaggttgtatattctgggacgaagggagtatattatattaggaattatcaatatatatctatatatctatgtatgacgtgtaaagtttgttgcaatagattaaaacatgatctctacattcgatatggacatacatcatgctctaaagttcttgcaatggtcttttgtcgcccaatgccaaacctgccgcctgctagtggttgtgcaacagtattatgtggttttgtaacgttagatgagtactcccttcgttcaataaaaaaaagaatctaatatagaatgtgacacattttattttagatttgttttttatagaacataagtactcttgtgatttgtgaagtaaaattttcactttgtaaaaaatccagagttatagccaaacgtagttttacctaaaggtctgcacgtgtcgagacgatctaagatctaaaacttggtagtctcgaaaaaaaatgtacgttcatatgtgtataataagaaattaaaagtcttgtttgccataaagcctgaaactatatggatctactaggctgaaactacattaatccactagacagaaactatatgattctactaagggaattgacagaaactatatgattctactaaggaaattgagacaatgcacatttcaaacaaagattagccgtatgcatctgttccagatgtagaggccggttttttcttaaaagaaaaaaaaaactgctaccgtctgcattacgccgtaacaacatttgcctctagtcactcgtgacctcatcttttcatttatacttatcagtcaaaatttaaattttcaaccttaaatttagagctaattttgagattttttttcattgaagtctatttttcaacatttgctttattcataaactactttcgtttacaaatatatcgtttggcttatttcataaataagcgaaacaatgaggccatcagattcatgacacgcaagagcgcgaaatgcaaacagtacgaattcccatatcctacctcacagcctcagatgagaagataagactgcattgacaggttaaattgaaccaaacaaatctcgaataaattgtcatgagattggctggaagaattacatcagatctcaactttcgactaaattatgaactcagttgtacccaacgctaacaagtatgcttgccaacacgcagcagtacctgttacaagaggagtagccgcgtaaaccaccatcgaggtattgttacggtgttatcagagctaaatctatagcttttctttacttcattatcagtcatctgaccttgcaaaaaaatacagctcacaaaaagctgttcctcaacttcagtgttgtagtttctcgaactgaaagggcaaaacctgccaactaccgagtaacaaataaccaatgtaacattcccagttaggacatcagtaataaggtagaagttggcctagtcaaacttgcgacaaatatttattccgaggatagaagtttgctgcacgcgtcgatcttagcaacatgtgagcccaagatagcctgacctgatggatttgctttcatgattttcatcatagcttcaaacactgcagcacgaaagaaactgtcctcaattttctttagagtatcctcaacgacttctatgctcaggcaatgtgacaagaccagccgcccaataacttcaccaaaatgtactggagcttttggaaggtcaatagcaagctcatcaagaagagaactgtaaagcaagcatccagtttccaagtcagtcgctttgaaaacattcttgttgtagagatgctccaacagcctcaaaagaggatcgatggaattggtgcctttatcaagagcaagattgatggcttctttaacaacttctgggtagtaatcaggactcttcagctcctcaatgcactgttgtgcttcatgtagaagaagtatgtggaaatactccttaagaagagatatggtcttcttctgaagctctgtagagcttggcttgggggcagcagctggttgctcaactataggatctacagatggagctgggatgagtgattttggtggtcctgtagtttgagatggtgtgacaaccagaccatgggatagtgggccaccactgcccacaagtgcactcgtcttgccactaattaatgctgcactgccttgaggaagcagtctggaattattaggtgatggcttattggccaatgatggggtgaggttccgaactggatcagctctgggctttgatctagaatgcggaacttcccagtcatcactacctagccctggcattccaggcatctttctcgctccaggcataccaggcaacatgccaactataccaggttggttcatagaaaaagctcctggtgaaaggggtcctccacctccagtaccagtacggccagttcttatgcttgcagtcgaccctggacgcaatccaagattgttttctgcctctctatgaatttcactgattttcttagctttcatctgagaaagaattaacagaatctcagagcaattcatatagcaaaataatatcatattgctttgatagaaacagtaaaacagaatccaagatctaaatgtttatcatgctcagtgactactagaatgagtgccactcggtgtattgcaaaaggtacataggacttgaagtgaactaatgtcaggtagaagtattgtaagcgtgtgaaacagaccatcatgactaactcttgtggtgtaaccatgtatatattaccagggcaatacttgggcaatttccaaaaaacaatgcattcaaaagactcaacatagtatctcaccatatatatgaaggttcttagtaatctaatttggtttcatttctgttattaataaccactgcatagctattagcaactagtagagagtactgggcagataaaaattctggagagtaatacaaatataaagagaagttgaggacctgtacctcttcacgtcgaggcacccattggtttgaacgaagatcaaggacatcgcgtgccatgaacctcaatcgtgatgccaactgagaattagttgttagatccttcagccggttgaagtatacgtcattaaatcgtcgagactttggattctcatccaactgtttaccaattgtgttgaagaactgacagatggcctccacattttcctcagcagggcatctgttgctttcagaacctaatagctcctgtttacagaaaatgggtaagaaaatatttagttgataggtaaatcaataggtctgtaaagtgcaaacaaggatgtcttgtgtcatcaaatgaagggtgttcaaacaaactgataaaaagtcagtcttaacatcccgattaggtgcacttctggcacatgcgtattcttgacttaatgattttcatttgatggtatattcaactaaacgcgaaagattgcatgcgcacctgaacaatgtgatgtactatcttctcagggaccattttttgcttaagtagctcaccaacaagacgaatgtttccaagtgtccgaagcttcactagcctttctttatcacgtctctccatctcttggtctagaccagtcaatttattgacctcagaccgcagattgtcagcaccttcaaatgcttcttggcaattgttcaacagcacacgtttgaacgtgatctctttaccaccaggttcttcagaagggaatgagggtaacttctcattgagatcaaagcaaagctgagcatacattggacagaaggtaggctcaagaacagccttctcaaatatgagactaataacatcctgaaacaaaaacagaccagatgtaaatcacaaggaactgtcgaaaggcaaagccagttgaatgaacaacaagaacataccttcaaaatatcagctgtagtgatccctgcttcaattaactggcccttaagaagatcaaacttttctggagtcaatttgttcagtatactgtgaaacaaataacaaataaatatatgcaagaaaaaacataatgtttggttactctctccagccacaaataaataccgctttggacatcagtacagtcccaaaagcaaaactatgacaactaatttctattaaaggacatcaataaagctcgatatagtgagttctccacaagtttcatgtgtcaaatcaaaatatttaaagaagcattagtgctcaacattcaaaaggtttggctgcaggtatgtctaaaacagcacattagggactagacgaaaaagagtaaataaattatatttcctaaatatgaaaatataaaaatgatgaggaaggatgatacaaatcaaacaataccctttcactgttttcagaactctttctttgttggagagattgcctctctggattgaccaagggacttcagccttgacaagagcaggagccggaccaacctgatgtttaccacgaatgagaatgttagataattgtcgtgtatcaaatcaaaatgatcagattacttttgcatgtagctttacttatgcagcatcagcatacagccaccaaagcaaacattctagtaattcgtaattatacatgccaaaattatagtatgaatttgaagcaatcatttcacttggtgcattgacagatgtctaattgcctccaaaggactagaattagataaagccataaagtccatacatcattgcgttgctatgatgtaattcataaatgcaagaattgccacaatatcaatcactacttgcaaccaggtatatgataatgtgcacccatcacaagcgtatattgccccctcgatggaacaattttctaccaacaatatatatggcacaacaacaagcttaggagttaggagcaggtgagaaaaagttcagcacaataattgtaaaaaaaaaatatattggcacatatgcagaacaagagagcttagaagacagcccattgatactcttttatcctcaagatacctgagcttttgcactgaactgggagctcaatttgtcttgattattaaattgatcttgctttccacttgaaatgtatgattcttttgcttcacgaaatttgtcccaagatttctcttcaccaccaatagcaggagtttgcacaggttgttcaatccgtgaacgccaatcacggttgtctgtctcagcgtagcggttatatgactgagtttgcacctgccagatatgataaaacatcaaacaggtagtaatcagtaaacgtgaaactgcaccagtcttactgagcagatacagtttgcaacacataggaacagttgaaaggtaaaggaagagttctcacacttgagtcattgttaatccagggttcatcttcaccatggagttctatgtcaatatcttgcttaagcttcaagatgttctcaggtatgtcgataatctgcaaaaccatagaatcaaagcatgtaattggaaagatgtcgagggaaataaagcagaagacaagaatatttggttatgaatacaagaaccagtggtaactgttgcaaatatatgttgttttatccatttaaacttctctgaaacataggttgttccacaactttgcttcactcctatcaatgttacaattaaaattcgagtggttttagaacagaattactgcaggagagtccattatgtatgtaggggaaaagatttagcatgatgggaattattcaaggcacaaaggccatttcatgtacaacttagtcattgtccataacacaaaaatgatatatatgtggaactgaaggcacaacatgatggcatgctcaacttccctttacagggaaatgaagagccatagaacaccagaggaaaactaattttgttatacaagtttcatacatcagatagcagaaaagatcaacagaaaaaataaaaggagccagattttctgagtaccaaagtcaatttctctaatcattttgtcatattcaccatagacaagtgcaagcaactgaatcacccttaaagcttgaagtgaattttggatagctagattgttatctcacttccaaatcttcagttctcaatgcacatatattaaatataatatgtaaaacgcagaatatgtgcaaaacaaaggtgagcaactgagcagtgtgtttcataaaccaagcaaatagattcagtgaaaccgcactattggtttatcaatatttcaaaatatgagcagctccatcattatagaagacagctatactaaatgttccataatgattaatttcatcatgtgaaatacagtaagtaaataagtagcaacagataaatacctcatgcagttcaacaagttgatccctagtgtaacgaacccgctcgagaggttcaaaccgcaagtctccaagctgtaacagattcggcaaatgccaaccaagcagaggttaataaactatatattcatatctggtggctcatattaaatgaaccagaccagaaacacagtctagacaaaatgcatttgaaacaagccaacaagttgcaactcaagaatctcgccatttgattggcccagcggagcatgtaacgatctaggatggattgtattctagctaattgttttctttgggtaaaagttctctaacactgggtttattgcagttagtacaaactacaatatcgaaggctcgaagcctcttttagtttgctgttagaacattgagggactttccctgtgaataaagcgaagggagaagtgcaattgttggggcaaatagaggggccgatttgctcctccattcatctacattgctttttgatttgcacagctagttgttgataaagagtagaagcactgcactaagaatagtaaaacacactcttttgataatgtcaatcattattgttcacaaatgctatcagaaatacagattctaaatcaagtatatccttcaagcaaatcaaaggggagtatcaaaccaaaaaaccagtgaaatgtcacacccatcagccagcactcgcaatgcaccccgcagaccccccccccccccatatgtccccttccgcgaggatcgaaccctaggaccatcacccccaccatccccaaatggagcggtctcaccttggcagcgaagccggaggatgcgccgccgcgcgggcggaggaagtcgagggagcctgtggaggcgccgaaggggaagaggcggccggcgcgcgggccaccgatgccgccgccgccgcccgggcgcaggctgatcaccgcctgatccgcctgcgtcatgatccgcctatcgaagaagagaggcggagagacggaggcgcggattgggggcggggtagggttgtatcccccagaggcagaggcgttttagggcttttgcgttgcggcggtgcggcgtcgtgtggtctgttttgctatgttggtggaggggtagaacggtctttttctgtaggttgtgtcactgcgctgctcgccttctcggagggcgacgtgtcgggaggacgaacatcgaggacgaaaatgccgtttcggtgctggaaatgacggtattgggtcggggtctccgggagtgcggggaatttcactgtgaatatacacccgggacagattttttttgtagtagtagacggagtaaatacgaaattgattagaatttgttaagcagtgcgtgcacatctaaaagtagggtttactcttttttatctttaaataaataaatttatgacgaggttaatatatcatgataatacaaacctgtacagtaaattgtatagattaataatattaaaatatgtcgtatctcgtattagattttgtttttgttttttttaatatagagagtaaacggtagagagattcccaacggtagagagtaaaccgttcagttttgtggacttcggctttatatcgaagaagttttccagctgcccatcatccaattgctcttatctatgcattcatccacttacccagacgtggagccgcatgtagggctatcatcgagctgagctcgaacgagcttgcctgccttggctcgagctcgacacaagctcgagctcggctaggcccacgagctcgaccgagtatacaataatgtatattttgatgataaaatttagtaaaaacaataattttaattaacaatattgaagaaaaatattatgagaactcaagattaatatatgatgccaaaatacactaattattcatttgaatagatactaatttattctaaagttacacacaattaggctcgtgagaagctcgagcttggctcgacaaagctcgcgagcttgtagctagactcgggtttgactcgttaagagctcgagctgagcgcttgagacgctcacgagtctcgagcttttttttttacaaccctacatgcaggcatcacgcagaaccaacaaaagctagtgggcccatagagcaagagcaagaaccacacatataggcccagatcgcgggagacgaggcacccgcagcttgcctctctcagagcaagttcaatagtatagctaactactagctccaattcatctatagccaatctaatagctcattcatacaacagttatatactacactattaatacctggtcccacatgtcatacacacactacgtcttggagtccgtgctacagctggctataaatctgtagcccgctgctcttctctctcctttttttatctccttaaaatatgtttgcagttggcttatagcctgctattgtacctgctctcatgcgcacgagatgttcggtatcttcggtgaagtcagttcacagcggacaaaaaccgatctatacatggacaccgatatacataaaaataaatgcaccaaatccaaaaacgcgaaaactagtaattcggttcgattcggtgttcgttttatttgtgcccatacacccctccaaacattttttaatataaattgtgagcgtgttgggattaaacactagacctcgggggttaaaaccacatacccttgccactgcactatcatgtgaattgattactacttcggtttcaaccgctatggactcatcggaaccaaggccatcaccaccccgcatcgcttgagcgcacagaacccctctacgtggcggtgcatgcaacaagaaaaaaaaaggtgagacgagaaagagaaagaacgagagggatggagaagcgatgagaggagaggagaaacgcccatgcgagacccccaaccctgatagtcgccagcaccgccatctccgccgtcatcgtcatcggccgcctccgcaaatcgaagcttcatcgttcaccatcgctgcctttgcctcgcccttcccccagccggcgatgggtaacgaaggggagagagggagattgctgaaacaagaaatatacttcgcatgtggggcccactcgccacgtcggctaagaacagactctatactggttaggatctcgagtataccagttttgtaagttgagaaactcattatatcttgtattgcagtttcgaggacgaaattcgaactcagcaacgaagaagggatccaaaatgaagggctagtttggtttgtgaccaatgttggccttaccaaaatttggcatggcaagttttggtatgtcaatttttggtaaggccaacatgtgtttggattgaagccaaattaaactaatttggctattgaaatggcctatgttacataggcatgtcaaaatttggcttcaatccaaacatacacaattattgttgaggttgccaaaaaaaaattggtaagcctaatttagacctcaaaccaaactggccggaacttattctaaatagcaacgctgcctggttctgtttaatttaatcatggcctcgttgcctcagagcccaattacaaggcactaaaggcagtagggttcggtttaaggcccccagccggaaggcctcgtcaaaaggctcaacacgtgccggccgcgaccggtgcagtgcggcggcaggccgcggcaagccggcaacgcgccatatctcatcctgactcggatcctacgtaagacgatgattttacttagagcaagtttaatagtatagcccactaccagctccaattcatctatagccgatctaatagttaatttatacaacagctgcttactatactattaacatatgatcccacctgtcatacacacattgcgtcttagagtccgtgccgcagctggctacagatctgtagcccgctgctcttctctctcatcttttatttcattaaaatatatttatagctggctaataggctactattgtacctgctctttgctcttgttccgtcaagccttcccgtggacacaaagacacgacacaaacctcccgaggagcaaaagcaatggaggcagctgcgctaactacaccgacccactactacccctcttgcggctgctcgaacggcgaaccactactatgtttttgcatctacttttcccccatgcgagttgcgaccaaacgcagccatatgatcgatgcagatgcacgtccttgcataggtaggtgtaaagccgccaggccccagagtagtttgctcgatcttcgaatcagccgtgcgatcgtgtgaaaatctccgcatgattcacgttggattttgcggtctctggatggggtctttgattgacactttctccgtgcgcctttggtcccggactccctgtccactgcaactgcaaggccgtgcgaagcacatcatcggttattacgatttcgtggcgccgtgacagtgtacgtttctgttggctatgggcctgtggctgtcggtgtaccggtccgggatgctgacatcatgtgaaagttcccttttaggattgttgtatgcagacatgcagtacttgagtccatgtttctctggagcaaccatcattctaaacattattagcaggctctaaacattatgcacgaatgaggtaccagtagcactaatcgaacacctgcaacgcaaagacgtcgaacggatatccgttcattttcaaatcagacagctttgttacttgttagactgggtcagagtacaggtttgcaggatgaaaggaacacggcatatggcagcagtatggcactgagcacacgttgtacgttccggctctctgccggtgtcgcggcgtcgcattcgcatacctcgtcatctgaagctgatcgatcgctggcttggtcagagctagtgagtaattggctacagtattaattactgtagcacctaacctaaacattcgtcagaagata

SEQ ID NO: 7780 - DNA, 24944 bp, Oryza sativa
ttttcatcacatcaaaactttcttacacacataaattttcattttttccatcacattgtttcaattttaatccaactttcaattttgacgtgaactaaacacagccttcgtacaattataccactaaccaataatcttatactatgaaacgttcagccgtaagagctggtctgtgcgtgcacacacgagccttgctgctgggtcatcaccgcatcagtactatgtatcagctggttcaacgagacaactaaaatttactacatctatattttaatacatgacgcctttaactttttatttaacgtttgaccattcgtcttattcaaaaaaaatttatataattatcatttattttattgtgacttgattcatcatcaaatgttctttaaacataacataaatattttcatatttgcacaaaatttttaaataaaacgaatggtcaaacgttgatcgttactgtttaaccaaaagcgcgcctggtagtatttgacagcagcagcgatcgagctagtagtacccgccgtacgtagtgccacacgtaattcaccatctaattcgcgtcatctaaactccaactgccccatcggtgcagctgaacagagcagtagagcacgagttggacaaggatttcgcaccagataaagctggacgcggcggtgacccgatccatagttccatacataacctgggtgcccgaatatttgggaaacggttaactcgggtttgcgttgtcagaccatgtgccgagcagatcgtacccagcccgatctcgccttgaactcgctgcatttaagctggggaaaaatctcagattgctgctgtaagattaaccgcacatgcaaatccaagcaaaattgttcgtggaaacgatacagaagatgtgacagtgtcaccggagactgatgtattattgcatagtctcaaagagattatcagtccgatcgtttcgtttatttatttgcaaacgaaaaataatttacaaataaaacttttatacatgtgttcttagcgatttaaaaacaatactgaaaataaactttgatgaaaacctcccaaaatcaacttaaatttaaggttaaaaatttatattttaactaataagtataagcataaacgaaaagacaagtcgttacgtcaattcgccaacaaaaaaacacgggagatcgatcagtggatcacaccattttccaacgccggtgggaagctgccgctgctcctgtttgtcattagggtaggcccgcgtgaatgatagatagtactaggaaggaagctgtcatcgctgatgcggcgaagagatcatcatcaccgccgcgtccattgtccggtggggtggaccgcgtccacggagacggaggcctcgagccgtcgagcgcagatggaatcaaaccttccccaagccaagccaggaaaatccgatccacccccgacctcctccgctttcacgcaggtcatccatcccaccaactcctcacctcttcctcctccgaagcaatccaccaccggtcaattactggcataaattccaaataaaatacttattcaggttgcatattcataattccttatcttttaaataatgacacggtttactatactcttattatgatatatccaataaataaacatatttttatttttattataacattttgtaagacaaatctatatagattgttttagtgtctttaaactaaatatttttgaagttattaatagttaaagttataaaagtttagcttttaaaaaagtcaataattatgaaaattgatgagtaacactgctactccttttctttttctttataaaagtcaagaattatgaaaattgatggagtaacaccgctactctttttctttttcttttacttaaagaaaaaggaaaaaagaaatatatgcgatattggcaatttggcatcccagcgacagctataaaaggcgctccacccctcgttagctcaccagctctcccccaagagctgcttacctaacatacttttacaactccaccattgtccattgccaaaggccttcgatctcgcctcccagatctgccccgcgtcggcgaaggttggttggaatgctctctgttttcatctcgtttgcttgcttggatgtttctccccgtttgctggtttgccggcgaggtgttcgaccgattgattggttgatcgtgttgcgtgcgatgcgagcagatgaagatcaacgtgcgggggtcgacgatggtgcggccggcggaggagacgccgcgggtgaggctgtggaactctagcctggacctggtggtgccgcggttccacacgccgagcgtctacttcttccggcgcggcgaggcggcggcggcggagggcgggagctacttcgacggggagaggatgcggcgggcgctggcggaggcgctggttccgttctacccgatggcggggcggctggcgcacgacgaggacggccgcgtggagatcgactgcaacggggaaggcgtgctgttcgtcgaggccgacgcgccgggcgccaccgtcgacgacttcggcgacttcgcgcccaccatggacctcaagcgcctcatccccaccgtcgactacaccgacggcatctcctccttccccatcctcgtgctccaggtatccaattctcctccattttttctcctcacgcgtagtaggaatctactattctatttctaccgccaccaactcgatcgcttgcctgcgggcgacgacccggtcagcgctcatgcaattcaattgctaggtgattagtggctggctgcgtcatgccaacaattttcttttcttttttggaccctatcaagctctagcttagaccgagtgaagcctccattcatggtgccaaattgccgaccaacctacctatgtgaattatcgaaacacgtatgaatttttagcatttgtaggctttttttaatatagggatttttcattaatttattcctggtatgaatcgaaaagaaaaaaaatcatacctgttgcagaaaacatttgttagtactggaattttctatggaaatgattagctttattccttagaaatttcctggaatggccacatcagctctctgtttttataggccttctattaatacatgtctcatgtcaacgattatctgagtacggtaatgactaatgattggcctgcgcacagttgaaccctgtcattagatcccatcaatttggaacatatgaatttaaaagatcttttgcgggaaatttaaaagaaattgtacagcatgaaaacaacctagccgtgtaattgtttggttagaaccatatattctgacagctagacaagtcgaaaactaccctgagaattggggaaggtgttctacctacttgagtccgacttctcgctgttgttgtgacttgcgagctatcatcgtttcttttgtcaaacatgaaagcgaagtagcgaaccaattgtttgataagattgccagatcatatttgtgcacagcctcacaattgtcacaactgctccagttggtacatcatcagcatccacatgggtgaccccctgacccggttgagatagagtgagcttaagggtgtgttatagttcctgaaaaaagttggaagtttgaagaaagttaggagtttgaaaaaaaagttggaagtttatgtgtgtaggaaatttttttatgtgatatgatgtgatggaaatttgggaatagggggaaactaaacacggcctaaccaaacaacaaaatgttagttatttgctggacatcttattcttcggatgcacgacacatgttggttgaaagacaatgatgtaccagctagaatgtaaaaaataaatgtttctttgtctttgctttgtgctagcaagcaaaccttaatttgattgatcgttccatatagggggtgtttagatggggctaaaactttttagtacgtgtcacatcgaatgtttggacgttaatttgaagtattaaacatagactaataaaaaaactaatttcataaatgagagctaatctgcgagacgaaatttttaagcctaattaatccataattatgaaaagtttactgtagcatcacattgtcaaatcatggcgtaattagactcaaaatattcgtctcgcgaattagtccaagattatggaatgggttttgtaattagtatatgtttaatactctaaattaatatccaaatatccgatgtgacaggtaagtccctgtttactaaacaagcccttagtctgcccttaatcaggttctccagctgtatattttctgtctaggctccatctatgatcccataattgagttcaggcaggtaaggtggtctgcaacatccaagttggcttgccatgaccgagaccttgagtattattctaagcaatcattcgctcatacggagtacacgtttagtgggacagaggaagtacgttgagatacaagaggtcaaatgaattgcttctagacgattggaatttaatatggtaacgttagttgaactagaggtatcttagtgaaacggtaggtgcaataaagaagttgtgttttcccttaagcacatggtgctgtgtgatctcgtccttttttttttccactctaataatgctcaggagattaaagaagtctcggtcacgtataactctgtaaaaagaattttgtaatctttgtgaaagaacagagcggttagttaaactttggcgccattttgctccaggtgacccacttcaagtgcggaggcgtcgccctcggcgtgggcatgcagcaccacgtcgccgacggcttctccggcctgcacttcatcaactcgtgggcggacctctgccgcggcgtcccgatcgccgtcatgccgttcatcgaccgcaccctcgtccgcgcccgcgacccgccggcgccgtcgcacccgcacgtcgagtaccagccggcgcccgccatgctggcccccgagccgccgcaggcgctgaccgccaagccggcgccgccgcccaccgccgtggacatcttcaagctgtcccgctccgacctcggccgcctccggtcccagctgccccgcggcgagggcgcgccgcggtacagcacgtacgcggtgctcgcggcgcacgtgtggcggtgcgcgtcgctggcgcgggggctccccgcggagcagcccaccaagctgtactgcgccacggacggacgccagcggctgcagccgtcgctgcccgacggctacttcggcaacgtgatcttcacggcgacgccgctcgccgaggccgggagggtgaccgggtcgctggcggacggcgcggcgacgatccagtcggcgctggacaggatggacagcggctactgccggtcggcgctggactacctggagctgcagcccgacctgtcggcgctggtccgcggcgcgcacacgttccggtgccccaacctcggcctcaccagctgggtccgactgccgatccacgacgccgacttcggctgggggcggccggtgttcatgggccccggcggcatcgcgtacgaggggctcgccttcgtgctccccagcgccagcggcgacggcagcctgtcggtggccatctcgctgcaggccgagcacatggagaagttccgcaagatgatcttcgacttctgatcctctgaaatcaaacaacacgtacgtacgcacgcacgaacgcgcacatgcatggagaggaggcggggtggttcttaacacagcctatcatcggtaggatgcagcaacgattctttgattccacacgttagttcctgcaaatttttcccttcctgccttcccgcttttgggcaggacacattttgtgccaactgtatttgtattgtgaacagttaattaatccgtaaacattacgaaacacagagggttaataaggttaatcacggtggtttacttcgcctatcagtttctcaagtacagaaatcgcaatatgcaggattgtctgcgataccgcatctgcaacagctgccgctaacttgtggaaccgagtttacctgtaattcactgctactacagatataataccgcaaaggacccatgtatcttacaaacagaaatggtcttcgtacccaactacagcattccaagcgaggcccaaatgaaccacatgcatacgtcatacgtggccacgtgcgcggccaacgtggcgatatgggaccggagttaggctgaattccagcggccagcgctcaagtcacctatcagggcgtggaaaaactggaggcttgagggagtaggttgagaagacgtgaagcaactctgagggaaggagttggtgtttggtggtggtcagtaggtgaggattggagtatggacccgattcattgcgatttcgtagccgtcgtatctcacggattatctggcaggtgtgtgcaagtgtggaagcaaccaaaagacttcagctggataaaaagggacaagggaagcactaatcacttgggctggtgagaatgagatcaaaagtgtcggtctagctcaagagtcttggcacgtagaactcgtgctcatcgtcggtcaaaatggcaccaaatggtagagccaatttggtgtaggatttgtaccgcaaggtacagggtgagcagtaaggtagaactgttttcagacaacgtgcatctcacttgtcttattaaagaagatgcgtccttatcagaataacagttattgccctgctctcttgaccatctcaatagtcgaccaaacatcatgctaaacccggatgcagtacagcagacaaacagtagtacgtgggtatatttgtggcagtacacgtgccaatgtggtccaagtggaatcaaccgattttagcgggaataaccgatgatctttgtgtttttagaacgcaatacaaacgaaaaccctcacaatacagacacacgcgcactctatccctattgacatcttaaaaagattatgctgacatatcttgagattaacgaagttaccataagcactcatgtcaaatctagtacatgaatccaaattgattggttccaccacaagaaacctaatcagttaagctgcgctcacttcgctttatctttttgttgctcatcattagataaatgaaaacaacaagagggcaactcttggctccatgtgtaagggaggataattggacaaaagtgtgttgcaactcattggctccattgttgccttcatcattgccaccgtaccattaattatttttagatcaaaggctccacgcccagctttactaacaaagcataacaaggttcgatacagaaagcgaaaaggaaaagataaagaacagaaaaggaaacatgacacaattggggttgccaacttgaaacagaagtacagatagctgaaagtgactagcccctcacacagcccaggaaactaacataaaggcacacgatgcatcgcctggagccaaaaccatgttgctgacttcgctatctccctacactatcttcttcctcgagcaggaccctgagatcagcctggtcttccctcttccagctccttgattcgagcacgcagcgagtccttgaagggctccacctctccagaaaatttctgtgccaccaagggactccactgttgcagcaacattaccaccttgtgagccatcaaagtaatgcccgaaagacatttattgttaaaaacaaaatcattcctcacaagccaaataacccaacaaacagcagagaaaatgcaaatgtagaacaaattgctcttatgccaggatctttaagtttctcaattagctcatttcttgttcggggcacataactccaacctaagatatctctcagacaacaccaaaggaatctagctggtgtgcacgcaaaaaacaagtgatccactgactcaacttctccacaaagcttgcactgctgatttccaggccatttcatctttttcagttgttgtgctgcctggattctccctttcagtatgagccacatgaaaatcttaatattaagaggaatcggagccttccaaaattccatcattctgctatctctcacgcctccaaaggtcatctctctgtatagtgatttagcagaaaatacaccagatttagttagcttccatctcatcttatctctccccccattcattggaacctcctataacaactcctgcaactctgttcactcttctaactcccactctgtcaaggatctcctaagattaatcacccattcacctgagttgtgcacttgcttaactgtttcattatggttggagcacgctttataaattgcagggaaagtaactttcaaaggcgcctctccagaccagacatcgttccaaaaactagttgaattcccctcaccaatttcataccagctccctagcctcaaccaatgtttcacagcatgtaaacctttccaaaactgagaaccaccctcttgtctagattgaaagaaacctccctccccctcattgctgcaatacttcctgtgaagtagcatgcaacaaagatcatcttggccagattcaattctaacaatccatttacaccgcaaagctgcattcatcactctagtgttaataaaacctaaccctccaaactctttgggtctgcataaagcttcccatttcaccatatgatacttcctcttattctcaagaccttcccagaaaaaacgaactctaattgagtccatcatctggtgagtagtttctggtagcaagtagacacccattgtatacataggaatagaagtcaggaggaattcaccaagattgctttccccccataagaaaggtgcccacatttccatgtcgccagtctcttctctagtttatctggggaggctgcaaaatctgccactgtcaatctcactgagcttatggggatccccagatatttcattggaaacttccctctctcacaattaaatttttctgctattctttgggcttcagcatcatctactcctatcacgaaaacctcactcttttggtaattaattttcatgcctgacatcgcctcgaagcaatacagcaagaacttcactgttagaatgttttcttctgtgttctgcaaaaaaaggatcgtgtcgtcggcatattgcaagtgagtgagccctccaggcacaaggtttggaaccactccctctaagtgaccagcttccttggccagggtcaacatttcagaaagggcgtcggcaaccaagttaaataacaatggggatataggatccccctgtctaagacctttctgagtcttgaaatacccatccacctctccatttatgtttatggccactctcccgttcagagtagctttgcccacccattgaatccatatctcatcaaagctttttttccttatcacatcaaacaaaaaagaccattgtactttatcataagccttctcgaaatctagctttaaaatgatcccttctagttttctaacactcaattcatgaatcacttcgtgtagaatgaccacaccatctaaaatgtatcgaccaggaataaatgttgtctggcattctctaatgattttccctgcaactcttgacagtctgaccgctaacaccttagtaatcagcttaaaagcaacattgagcaaacaaattgacctgaattgtttgattgtattggcattcttaatcttcggaatcaaacttatgaccccaatagttgagcctccaaagatctaagttcccttcaaaaagagcatcaagcatttctttaaattgcatcttaagttgtccccaaaactctttcaggaaactaactggcagtccatccggtcctggggcagtgtttgataccattaattcatcatgccttggtgttagaggcggcaacagaatgggtcgaggccgaattggaccggaatgaccccatcccagaacccacaactggaggaaatgatccccacccccgccagggtcccacaatttgcaccttcgcgtctttgagtgtcgttcgccacgctgactgttgagcatagtatcttgagcttctcctagtgagcggtgtggaccatccatgatggacatgctcctgtgtgggtgaggggatagttggacaagcaacactaagggaggaggatggcaggctggcggcatggcatgaccatgcagaagcaacactcacagctagccgaaaccctcatctgcgggcaacgagggagcatggtccagaggaggacaaatagtggcgcaacatggttgtgtgagagcaaagagaaaactagcagatgatgacatgactatgggactgaggggaacatccgccactttgcgtctttgcaactcaacttgttagggcaacaaagtcaaagcaactggcaacgtgcaggtgttgcgggaagggatgtggggataaggttgggatgagtagggcttttctttgggttattagtaggattattgtcttttgcaatggacttgtagaatgatccaatgtaccttaccgttttagagactcgtgggtgaaaacaaaaatccaccctggtccgcaagaagttaagccccttctcgacagacctacaggtgaaaatttgccttatccccgtacgagcgggtacctggtggggacttaaccccaacagggcaattgccatctctacttagtgttgacttgaggtggcgtggtcttgtgatgtcaagtaggtaacatatcatttagttaattgtcagatgggcatggtgtgctttagcttgcttggatgcgtgagcgatgtttaacacacatgtgtgccatggacttcttttttattcatgtgagcttctttttttgtgtgttacattgtaataatcagttgtagctcgttgagcaagggtcggaatattctatttcattatcttaaaagaaaaagtgtgccatagactggttttcgcgtttgcggcactgaaacaaaacatatgaccctgtttacctgttgcttctcttggcttcctgtcctgtcacccccggcgagaaaaaggataatatgccactccatttggtgggtttagataaaatgccacccaatacattgcaaaggataaaatgccactcagtaggttactttcaggatattttgccactttgagggattttaagaccaaaatacctctagctgtggatagagaggaagagggaggagcggaaggttgacccggacgatgctcatgctcgccggcagcgggtggcgagcacacggggggcgggctgtgacatgcagacagggggaggaagatggcggcgaagagggaggaagacgagaactgcaatgggggaggaagacaacgacgcttatcgggaaggacgacgacgacgatgggggaagaagacaacagcgatgggggaggaagacgccgacgaagagggaggaagacaacggctgcgacaagggaggaagatgacgactgcgatgggggaggaagacggcggcggtgatgggtgaggagggcaatgccgacgggaggagggaggaggcagcggcgatgacgtggagggctttccagcgctgcccgcacgtgcgctcatcccctccggtgccacctcgcgcgcttaccggcatcttattcctctccttgtcgccgctagcgggagcacagacggcactcgttcttccctcgtcgccgcccgctaccggcgaccacggccgccgtcgttcgactcccctctctggctctctctcccttcctctctctctccatagtaggggtatatttgtcttaaacctcttcaaagtggcaaaatatcccaaagataacctattagccctatttggctaatggtatagggaaatgatttcccatccattaaaatgcatctttaaatcctagccattcattctccctctttcatttaatgctaacccttcattcatttctcaatctcaatctcacccccattttccattatccaaacacactgattgagtgacattttatcctttccaatatattaggtggcattttatcgaaatccaccgtatgaagtggcatattgtcctttttctcctcaccggctaagcctccagaacagggcccatccacttctccatagaccggacccatcaagcaggctaacaaccgaaccggccaacccctgcctccttccagaagcgcccatctctattctcgacccatccatcccgtccgtccgttcgtccgtccgagccggcgccgcgcgagttatccccgtgccgtgcgcgctgctcgactcgacgatagccagcgagcgacagcgtgcagcggccaaagccaaactccgcccccctccctccaatcccccctcacccatggctgctctcctccgcacggccgccgcgctcgcgccgccgccgtctcccgcccgggatccgcgccggccgtcctccgccgcctcgtcgctcgccttcgccaggcgcgcggcggcgcggccgctccgggcgcagccgctcctgccgcccgcggctcggcgagtccctggcttcgtcgcgggcccgctgctgcgcggcggccgcgggtaggagccaccgaggctgacgaggccgcgcagacagcgactgaggtgagaggggcttgcttccccatcccccatcggggggtgatttttttgctgtagcttctgtaaatcatgctgttactttgttatccgatcgataagcagttagttttgaagagggcctatcagatttgtaattttgtagcgtatcagataaaagctagatagcagtgcttggttcagaaccacaaattgctcatccgtaggatacacaagttttgtgtattagtaactcttttaggtcatggtgtggtatttgatcgcttcatactagcattttctgcacgaattgtttacgagtagtatctaccttgtttgtaccatatctcatttaagcttatgtatccatcgaattaatgcgaactggctttagatgcaggaatcttgtgggtggttttatgtttagttgatcagctttttctatatgctattatgtcaattaacaaagaaatcccattctgtgctttatttgggtgatgcaaaagttctgcactacctatgtgaaagcttggcttatcatgatggatgataaaatgattgaatttgaccttcattggtagcttcaggaaatttaatactcaatgtaggatttttgtttcacctgatttaattagtttggtaaaattctaatggaatgccaactaaagtactttttcctgacttctaatggttcacattctaaagtaagttgcttttcttaatttgcattcagcataaccatgtggacctcaagctggtcaagataaataaatgttttatttagcttagccattgtgcagtactccctccatccacaaaagttagacatatttcacatttgagtttttccaaataagttgttcctatttgtagtcttcatgcattcaatacataaatgaagagataaattaaatgtttgattagaacccaaggagtcatttaaatactcattggttgcatgcttgcattcactacttgattttgtaacatccaagatgatttaatttctccttggttttggtgacaaaagtaatatgtgtaacttttgtggatggagggagtatgaaagttggaaggatctgttctttttcatgactaaggctggaaatagcaaagttttgctgatatgggattatttccaatctattttgcatgtcattgatctattggggaatcacatttggcataggtcctcttttaggaacttgtacatcagtacttgtaagtgtttgccatagttgttgtgtaacttcagtattatgaatgcattttagctgtgccttccacacttccctgtgcttacacgtgtgaagatgctattttattttctcaatgtttcctatctttggcccatgtgtattttgcaatcgagttacttgataacatggagttattgcattgttgcaaaaatcttttctctgactctttactagtcacatttagctatcctgttctatttccttagattctgtaagagcaaggctagattatatagtaggtcagtaatgcgaccatttcattttccagtttttaacgcgagggcctgtgcagattatattataggtttatagcacaagagtgtagtgcatctctttgtcaatatttgaggtaagaaactgcattctgctgaagagtcgtataaatgtaatactgacagttgttgaggtggcatgtagcacagtagcagtatgttatttcacttccactgctaatataaaagcaaaagaagttgacccttgtcaatagaaacacttggcttctcatttagacatcttttttgatgtcacaggaggattctgaaactggagaaactggtgcagatgatgccgctgcagccacagaagaaactccctctgttattgtcacagcattgcaatcatacaaggaagctttgattaatgatgatgaaacaaaagtcgctgagatagaggactttttattctctattgaggaggagaaaaattctcttttgagcaaaatcagtaccttaggtgcagaattgacaactgagcgagaccgtatcttgaggataagtgctgactttgataactacaggaaaagggtagaaagagagaagctttcgttgatgacaaatgtgcaaggggaagttatagagagcttgctgcctgtcctcgacaactttgaaagagcaaaaacacaaataaaggtggaaactgagcaagaaacaaaaataaacgacagctatcagagcatttataagcaatttattgatattctgaactcactaggagttgaagatgtggagactgttggcaaaccatttgatcctatggtaagcattgttagcagcacatgacatactaatccagttaacttttgaatcaaacacttatttactcaaatattgaaatttccatgtctcttttaaattttgtgccttccatggttttgggtgataagtctactataaagggctggatatgtgtaggaatctattttattttccaaaatttcttgggttttcaaagggtgttacttttcttaataagaattgtttgtgcaccttctgtttcagcttcatgaggctattatgagagaagaatcagtggagtatgaagaaggggtcatccttcaggaatttcgtaagggttttaaacttggggagagattattgcgccctgctatggtcaaggtgtctgcaggaccaggccctgaaaaacccgtgtatgacgatcctgcgatggttgaagatagtgtagcacctcaaaaggtcaaggaggctgaagatgatggttttgatgatgataatgctgagtgatggggctttattttttatttcacaggaaaagtccagaaattttgatgtttttctggaatgtgtcaagcaggtaataggatagagttagaaatttgactcaaaatttcccccttcctgctgttgacgctgagtgttgatattgcctcaaaatttctgtttcctccgcgtgtggtcaattgttatggttaggaaattttctccgttcatcgagcagttgcaatgataagcagaggtaaattggtttttgatcggttgggagtattggagatcatgtaaaacaacagtagtagagaattcgatcagctcttttgttttttcttgtttccaatatttgctcttttgttttttcttgtttccaacatttcgctgcaaaatacgggcctgtacggattttaaccaaaataaaccttatgatattttggcaatgccaaaattttggcaggatggtaatattgttaaaattttggcaggatgacaatattatcaaaattttggtaggatttcttatgtatttagcaaatctagcaacaaactgaacgtagacatttttttaataacttaaaaaagatggtatggttgaaaatagcatcaaagggctggtttggtttgtgacctaaattggtcttaccaatatttgtcaatgctaaattttgacaagttttggcatgactaattttggcaaggcaaagttgtgtttggattgaaaccaaaatagactaagttaactattgaaatgacatattttcttagacatgccaaaatttggcttcaaaccaaataaacagtaaacactattaaaattatcaaatattgataataccaatttatgcctcaaaccaaaccagcccaaagtaaacacgccttacgtttccttgtcttatcttctggttaaccactagagcgtgcctggtgccttgtgtgcttgtggactaccagtcactcgatgcaaaatacgtttccttgtctatcttctggttaacccctaaagcgtgcctggtgccttgtgtgcttgtggtcttgtggactaccggtcactcgatcaccatctagaaatttcccagtccagtcttgtaacctgccatcaagaatcaggctatgcacttgatttcatgggaaaccttaaacaaaaacagatgatctccagtcttgcaatttgccatcaagaagcaggctatgcactggatttcttgagaaacctcaacaaaaacattaaacatatatactcactaactcacatgctgtccttacatagtagacttgtatcctaacggtgacgtagtacttttgagctgtcctaggatggtactactatctcacatgcttgccgcagcttttttaagttttaaatctgtcgagaaatataggatgcatctgttcgcttttgcggctgctgttttgcagtagaagcgtatcggttcgctgttacagcctaaatgcgaaccgttattggtagtgggccctatacatgtcggaatctatctacggccacgcatctggagtcagtgctgacgagcacacaacacacacaggcagacaagcagaggcaatgcatcagtttacagaagatccattaatcagctataagcaaaacaatggaattgctgatgtttataagcatcaggtactgctgaaaagcaacagcgtctgcaaaacgatggcgccctgtcttgaaacaaaggcatcattagcagagttgtagcaagtgacatgcttgccgcagcgtttaagttttaaatctgttgagaaatctcttgaaacaaaggcatcatttgctgagtatatagtagttagcaaccaagtgacggtgaagaatacatggcattactactagtagactttacacatgtcagtatgtcacgaggctcgtgaccccaggatgtctagtgtgagtcgccccaggtgacccaagtagtgtgccgtcgcgacgacacgaaaattccacgagcccctcgtgaccgctctgccttcgacaacgagatggaaatggcggcggcggccgtcggcgtgctgctgccgttcccgttctactgggcgctctggaaccacccgcagcggtgggtcgacctgtgcggcggaggcggcggcggcgtggacccgtgccgccggatggcgcaggtgtcccacgtcctcaaggcgctgcagctcctcgccctcgcctccgtcgcctccttctcctggccgccgccgctctactccgtcgccctcctcgccgtcggccagtacctcaatttcaagtaagcgagatatatcccctaaacccctcttccgacagtcggacgcgatgctatcccctcgcgttcggatcgtctgcgactttctagtttctatgtgtgttgtgctaggttttcggtgtaatttatctgttcccatctgtgatctttccatgatcaataatccactaattgcagttcagcaccaaaaatttgcgattgtataaatctgtgttggtcgtttgtcgatttagtgctgcagaatcaacagtttgctgtagggacaagggatgagtaagggatgggacgattttcaagcaggaacaacgatcatctgcttctatttaccaattattactgatttatgaattttctccatgatttgccagaatggcatctacaatacacacacacacacaaaaaaaaaaaaacttatagctggagtataattttaaaagcacaagcaatgctctcatctaatatgaaaaaaaaggggccaaatttcatcttaagttgatgtgtactcataatgctctataatggactgatgcatctattgtagttgtcccgttctcgttcagtatttgttttgcattttaacaatatcatttttgctatagtttttgtcctaaagccctatcttccttaaatgattgccataccttgaaataagatagggccttcaatattagttataaacatttagaattgtttacaattgttagcgatttagacacttagtgatgcaaaagtaagttaagtgtcatagacttaacagtgctaatccatgactcattgagtttgatacctgtgaagccactaccctggggattagtcactgctaacttatttttatgctaattcctatgcattctatgttggacttctagcaactctttacaccagtaggaaatagtctgaggtagtcgaggaggcactcaagctccaaaatttgtttttattctgattttaacgtctctttaacagaataaaaacactttcctataatcttgaaacggccacttcggcaacacatattatttgagcatttggtaatatgagtatagtacacaacagtttatagtagactaaattctgtatttatcacaaagacggaaggggtaatcatcattcagttagttagcttgtggctgatatatgtgatttctcttcagggtgtaccagctgctcggtgagccaggcacctactacggtgttcgatttggaaagaaaatcccatgggtgacagaatttccatttggttatatcaaagaccctcaatatgttggcagcatgctcagccttgtggcactgctttgttgggttccattccaatatgttcttctctggtgcctcggctacgttttcatgatgtgggtggaaagcaaggaagatcctgccactcgtgccaagctgctctcctgatcacttagctgctgttgaatctgtagcaggctgtcccttagctgttcttcttggatgcctctctgacaatgagtgaaagtctgaacttgatcggttggttcaataaaaagtgtgtgccatatttttgctgccaagtgattacagccgttttggcgcatcatatttcagagctaggtatatgtgctatactgtttcacagctatattgcagaattcgccggccagttcacgtacgagagcggcgacttcttcctggtcagcaagtgagcaagaggctggaggccgaggagatggccgtcgctgccgccggcttcccggcggagcgcgcggccgttgtggaggacttttgccgccgcgccgctgccattgccaagcactcgttctggaccggcgttactaccaggagcacgacggggacgacggttactctgactagtgttaacatggagaccgttgcagcaggttgacattcactggattttgtacataacttttaattaactgggtttcaaattcactgaagcggtagtcaaatgtctaggaagcatgatcagtgatacaaaaaataaatttccgtttagttcacagtcactgtacatcaatggaacagaatgggtccgtacatacgcaagcaagacgtaaatttcatcaagatcatatactacctagaagcaagcaaattaacatggttttatacagggtaccaaattcatttttctaggacgcacgttctagatggacctcttcctccatgacgcaggagagcttgtagatctcgtagggagggatgcgtgatctgcataggatgacatccacgcacccagagtcatcactgcgacaactgtaagctatccctcctgccacacgattaagctcaggtcctaattgaggatcgcccccctgcttggtgatggagcagctacgaagcgtgagacgcatcggaagcacaagcttgagagcgatccgcccgatcagcgcgaactcctgcacgtagcccatgtcggccttgatcctcttggagttcgaggagcggcagagatccacgaggctctggagtacggcgcgccaaaagcactcccttgggtcggatcgcatcagggcgatcaatatatgcatccctaggaatgacccgttcaggacggatgcgatctctttagctgtagccgccagcgctgggtgcgccggccctgctggatcattcgccgctccgcgaaaggcgagcgccttgaagtggtaccagtactcctccttggacatcttcttggttctgattgcctcctccgtcgcgccgagacccgccttggtttggtcgtattcgctcgtgacgacgaccttgctcccgtgagccattggtaggacccacgctgtctcggcgaattcgatgacggccggtgcgtcctctagtatgagcagggacctgttccgggcaaagcgctcttgccggacgatgttgtgcaccgcgtcgaggtaaatccggtgatcttccaagctccggcttgacgtgtcgtccgtggcggcggctgcgcccgctccagcggcgtgtaggggcagcagcacttcgtcgaggccgaagcgctcgatcaccgcgaagtgcgcgcgcactctcgcgtcgtgggaggcatcgtgtatgagggtgctcttccccgtgcccctagggccgacgatcggaaggacgccgacgacgtgcgcagccgcctcgtcctccttgagcaggaacgcgacgatccgctgcttctcgacgtgacgcccgatcggcacgcacctctccgtgtccacgctgaccctccggggcacccgccggtaggtgcccagcatctggaggaacggggtcacgttctggaggacggcttgcagatgggcgagggcgcgggcgagggcacgggacgagtcgtcgtcgtccctgctgctactgccgagcacgaggcgcaccgcggcgccggcgctggtgcgcagccgcttggcggcagcgccgcgagcgtcgtcttgctgctgcgcctggatggagacggagcggtagcggaaggtgtccagcacgtagtagccccggtacatgctctgcgtgagctcccggagccacaggagcagcctctggctcgtgacgtgccggccctgtccctcgtcgacggcagcgtgcagctcaaggagcagcagctggagcttctccaggtcgtcgtcctccaccacgccggtggttgcgcggctgcggtaggagcggatcagcagggagacgagccggctggtcaagtcggcggccagcgccggaaggaggagctcctccacgatcttcatgatctcgatgactgccggccggcctcagagaagtgatcattcacatattaatttgctatcgactttgctatctgtaaacgtcgatgcacaatgtcagcgaaatcaacatcgtagtattgtatcagaaagccgcaggaaggttcgcggttgttcgttcgataatgagtaattttcacattagaccatatattttgaccgaagtttcacaattaacaagtgctaaaccaacattttcacttaacaccaggaacaagcgagtatttgcaagtttaaggcggcagtttttcagatagttcgcaaggtaattgttaccgaccaaaatcaattagttgccaacctaaataacaggtcaatacataagctgaagtgtcaataaacacaaaatccattcccagtcgcatgcgagacctatgcaagcatgtggtgatgaaccgcaacatagaaatgagctgacgacagatatataagtcatatggtacacaacagggtaaaaaacataagctcgacgggctttactagtgtagtcactgcaactgcccatttgcatttatcagcaattgtttctttcagttcagcgccggcgtctcttatcataatcatcgtcttcttcatcagaatcacctttctcacgaaacctaggattcttctcctgcaaacataaccacgagatattttgtaaacatattgtttttccgaaggggtagtacaggaaaagccagatgacacgtatgcaggctctaataccgaatcaatcgcatctctcttgaactcagagtcaggtgctctttgcgacgatcgctcatcgttccggtaacgtttccgttggtaatctggtggcagcacaccagattgtgttagctattagttcaggggaaagaaaagaacaagaatatgcgagatgtgcgacctctgtcgttccggtaagaatctccataccctctcttcctgtcacctctgtcatctgcatatttcaaaaaatgccaagatttgtgaaaatgatgaaatataatcaggaacatgtttggacagaagataaacagtaaattgattggacggtatgctgccaaggattgaatcaaataaagcagtgaaccaaactctcaaccaacgctttttggtggcaaacgacaaggtaaaatgcagctaaagttaacaagtgagatcagagtcaatagtggaaaggcacacatggtcaccagagaaaaaggtaatgtctaattatgctttactagaataaaaaaaggctacattatgcatgaatgctaacttcatgtaaatatgatcggaccagttataaagcaaattgtttcaccataaaatacttccaattgaaaaatatatcaagaggccacacatgcaaatctctaacaaagcaattactgcagttaataaggttaacacaaatgaaaattatacaaggatgtagttaaaggcttaaggtacagtcctcaaaactttcagcacttacattgaggtggtgcattaggttgaaaagcacctccatagtcaactaactcacgttgtgcttctagctctttctgaaccatcttaccatagccacctcttcgtaagattcattaaggaagtagccaactcaacagaaaaaacatagcagcatgtaaaggcatacaaaatttaaaggagcgctattaagaaacaatcagcagatagttgaattgccatatttaggatggatctacaggtaacattttcatcagtatgaactaacacggatgggtttctgagttaccagcataaccccgctctaaatgtaataaatggtaattcaatagtaccaaaggatatcaggatcgtagtccgtgcggtactcatcccttacctatgaaaaaagaaacatgaactatcatcaaaaatatggtcaaatgtcatacatttgttattcatgcagaataagatcatggtaatacttgtccaccactccgtccacgaccccattgtctgccttcttcaaagccccaatcaaaatcaacacgaattgggcgatcatcaagcattgttccactaatatatttgaccgcatcttcagcatcctccctggagtagtacctgaaaggaaggaaggtattataacgatatgtaggctaacagcacatacaccgttggctcaaactagataaatgtcatttttacatcttccaaaatccaatataaactaacaacatgcccgatgcacaagacaataaagcaatatatgcctatcagagaataatcccttccataactgtaaggttaatagaagattgataattcaaggggtgccttgctgccaggaatccaagacacgcacaccagttaaaggaactgtggtatatattttttgaatgaacaaaaaagacatactctaaccttaacagatcagagatcaagatgatgccacatttcgaattagaggtacaaagtatggctaactaccagcatacaaaaccccaaattcgaacacaaaacaccaaaacaagagcctgaatacataaaaaagatcccaatagactctcaaaaatcaccagttggccaaatataacttaaaccatgccccctcgacaaccaagacacatctggaccatattgcggactaatcaacactacatcagattaaaagtaaccaaacaaagggtaaaaaacaagaaacttggtgcactatattggcccatactagcggaccaaaaccagctctccaaggagccacatatgagctcactactacaaaattactcacttaaccaatagcaatatctaactgctcaagccaaatattcgcactgagatagaattctttgctgcccgtattctagggaaaatcacacattcctgccagtaccaacacaacatcagactcctaaaactcccttagcttctctgtcacaagtcacaaccaccattgatacttcactgttaaatcaatgcataactagaactagaaaaacatcttaaaaggcaccaaactacatttggacacccgcttatactagaataaaacagaagcagcacctttaatttgaacatagcaccaaactacatctcttgtattaaaaaaaaaacggattgaggaaggaaaggagagggtacagtatgaagcagaagccgcagggggtcttggagttcttgtcgagtcccatgatgatcttcctgatctcgccggcgcgggagaagagctcataggcctgctcctccgtggtgtagaaggacatgttcccgacgtacaccgtcaccgacgcctgcagcgccgcctcgtactcctcctgcgtcccggtgaaccgcctgtcccggtacgcggacagcttggtcgggtcctggaaaagcgaatcgggcgagccgcctcagaggaagggcgagaggagggggaatcgacgagctcgggtagctagggtttcggagggggggggggggaatccgtaccttgaagagggacgccattgctgcggagcggcggccgcgcgaggacgagctgtttgcgattagggttttgcctccgatttcgaagaaggtcgggtggggattggggagttttggggaagggtttcaccctccttgcgggggatttgccgaaccctagttgcccgggaggccaggagctgcagcctccaggtaggggaggacgggaggagcgatgtgagttgaaagtcggaggaaggagatgaataattttctccgatttcacgagatttactctaagtttggggtaattccgttaaattttaggccctcttgaatgggaggattggtacgagaaattttaaggattgtaatcatagacaaaaatctcctatcatgcaaccctttattaaaggaaaaatgttgaatt

SEQ ID NO: 7781 - DNA, 4620 bp, Oryza sativa
acgaattgtcatagctcatgttttcaattttttttttacaatttttcttgcgatacaacaacacctattttaaaatttccttttgtctttctataagaattaacaatccttgttactaagtcgtgtgttttttcaatttatgtgttttaaaggagtctttagagcatgtacaatagcgggctattagccagctataaacatattttcatgagataaaagatgagagagaaaagcagcgggctacaaatatgtagccagctgcagtacggacttcaagacgtaatgtgtgtatgacaggtaggaccatatgttaataatatagtacgcaactattgtatgaattggctattagatcggctataaataaattggagctagtagtaggctatactattgaacttgctcttaggcaataagaaacttcaaaaccaaactgaattttggttttgaaattcaaccacgctttttatgcatgctaactcgagacgagaatctgactcctaattgcttcagaatttttgccagaccataagaaagcaacgtacatgatatggccattgtcacaacatgggttatgctttttggaaaaaaaaatctatctaaatatagctaaaacgaaatcaccatacacgttaattgaagagaaaaaaaataaataactatactgccaggtcgcggtaggtttaaattagagtgaaatgcgccgttattaccataacttgcaaggtgggtgtaatttagtcacccatattgtaaaatgctcaaacaaatcactcatcttgttttgggggtgtaaatcatataaaacatgtgtcgtatggagtgttcgcaatgaagttatatgctatattaatttattttgcaaacatggtcacacgattcataaataatccaacgtgcaatactaccggtagtaaaattcaattaatgatgaattttgttattgattgccaagcacaatatgaccgtgttcattgaaagtaggggtagtagtatatacataaaaatataagtgttaatttgtaattttaatgcttatcctgtctacattggtaaaaaatgcatgatgctaggttaatatggactccaatttgaaaacaaacaatcgatgtgaaaatgtatttgataacatttgcactatcgaagcaagatgagtgacttgtttgagcaatttacaagatgagtgactaaattgcacccacctcgtaagttgtgataccatcggtgcattttactctataaattataacaacggagattatatctcatatataactgtccgatcagttttgtccattcaacattccttcagctcacaaacagacatagaagcagtcagcccatgagcaaacgtgcgggtctgtttggcacagctctagctctagctccacctctcatgaagttggagcccagccaaacagttttagctccacgcagagctgggtggagcgctctcacaaaatgaactagagaggtggagctggttttagacagctccacaactccactccagactcaactcctggagctaaatttaggagttgtagctctaccaaacaggctcgcatacggatacgacccattgcttcctttacttctgcaactcgatggtctcatgcaggaatcccttctttctataaagttaataaagttaatgtgcattaaacacctgaaactaacatgcaagcataatatttattagcactcctaaaagctacatgcaagcatgccacatcaacccattaaacacaaaaagctcaacatacaaacatataataattatatctacaatttatttcatttaaaaactaaacatacacatgctaaatcatcattctcaaattattttcataatatttcaatccaaattattttatcatttctacattgtctaacacatatcccgcagcaaagcatcggacatcatctagttaaaaggattattaatcacaactagaaaaagcatttttcccgacattggggtctttttttcgcaggctgacataacccttggaaccaaatgaccgcctaaaaaatataaatcggggtgaagttcgctgttcgcctgcggactacttaagcgatgcctgcaggcgaaccttatgtactccacctgcaaaaatcgtacctaccacaaaaaaaaaaaatcttaactccttatcttctcctcccaccccctccctaccactcatttccctctcaactctctctctctccctcaacacttcttctcctctccccaccgggcccgtccccctcccctccctccctccctccccgccggagggggagcgacggcggcagcgcggacggcgactgcggcggtgcggctcccctcccagatccggctggagggaggtcaggggagggcggcggtggtgaggcgaggcgtggggccagccacggcgcggggtggcgacgacaacgcgcggggcgggggcggcggctccggcgcggctcccctcccagatacggccggagggaggccgggggagagcggcaaggcgcggggccggtttgttcgtctagaggattttcgtaggcgggctatcgattttcgcagtcgttggtctataggcggtcctacccccgcatgaaaaaactacttttggccgcctaaaaaaatgatttttctagtagtgaatcacattacatcatgaatcatgcctgcgcatatgtactcgtacagaatacgtacaaatatatgtattggtacatgcatatatctttatatacatctatttaatctaatctaacatacttacaatgatatatatgttaaaaatatatgtaatgttttcacagaaattcccgtacgtcactccctttaagcttaaggggggcataggtgctgtgttaagacttaagagatagtgctgggaagattatgtttgcatcttatgatcaccttgctcattgccatatagtgcactggaggcagagtcagagatgctcgcctgtaaagaaggaattgctcgggccttgcagtggaccctggtgccgatcatcattgagtcggactgtctggctgcaatcaatatgattcagtatgaggagaggatatattcggacatagcctttctgatccgtgaaggtcaaggacctgctattaggaaatagggagattaagggcatgttcatcttgctgtaaaaaaaccttatcaaattttggcattatcaaatgctaaaattttggtaacttgccaaaattttaacatgatttcttatataattaccaaaatttggcaggaaactaaatatagtcactttttttagcaactttaccaaaatttggtaaggttgaaaatgacaccaatgtgaacaggccctaaattcatcaagggccagaggagctaaaactgtattagccatattttagcgaataaggctcgatgcgaatatgtgtttgggctctggctagaaaatacttataactttatctcacgtatggtttgtgaggaagcttctcttgagtactaccttcgtttcaggttataattaataaatctagacacacatatatatgtctattcatcaacatatatatgaatatgaacaatactataaaatcttataatataaaacggaggaaataatatattccctatttctcgaaaaaaaaaataattgctcgttgctgtacccgtccgtcagctattgacctgtctagcccaggtgtggcccaacatccattgtcgatcatgaccaggcccgtatgatggacaatctctcgagaaaaaaccaagacattaggattgggtttttgcaatttcaagcacatattcgcacatatctcattatcatccgaaagaggtccagaaggatagcaatctactccctttatctcacgaaaaatcaatctagagttgagagtacaggttatatcccctctaatcctatattgatttttttgggacggagggagtatatgctgcacaagtacagaaaatcgatctgttgtgttaaagtgctttctgcactaaatgaatccgggttcatcttataatgttacactctcttcctccttagaaaaaaaaaatcaacttctaactatgtagatctatttaaattgataaccagaagtttatcttttttatgacggacagtatttgagaaacaaaacgctgatgattgtatgagactaatcagcattcagcaacctaattaaccaccatcgaattcagcaagaaacgtgtgttcggtctttgtgttgcaagcagcagcagaggatggcaggttttatggtcgtgctgggccggcgtacgatgacttatcccccattcggcccatctagaatcatctcttcatccacaagcagccagcccatcaggacctttttatcccaaagctgtagtcaaattcgagaatttttttcgtttttagattttttttaatatttacagaaataatctatcgaccaaaaaaattgtagaaatagcccctaccgcctcaatggtgggcggcaagctgacgtggcagacgatgggtcgaccgcgccgtctgccgccatcggccaaaattgcgattaggcccttgccgcccatacagagggcggcaaggggctaattgcaattttggccacccataaaaagcttggggccgtacttttttcatctgggt

SEQ ID NO: 7782 - DNA, 5759 bp, Oryza sativa
ccagatgtaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatattagattcgaactaggagggaggtagtgcaatagttgaacacaacgacaatgtagtaatgggacaaggaagcatgacagtagaaatttcaatatgccaagttgtccgataatagctaacccctacgtgaggatccctctcctctctcaaaccgcactttagtaaccctgtattgctctggtagttcaagctgcacatcacgactaggtagagttagaacccttctggtgtctatccattctctgtattgacatctccttagtggttcctaagaggaaagaatagatgtaaaacgagcaaagttaggaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcactaaacctgtatcttggacgggcttcccatggagggagtgccgtagttagcacccgccagtcactctgttgttcacgatattatcgttcataagccgcttttctctgtaagtattgctcagtactttcggatgcgaaataccagcgaccttcttgtaaacaagtggttaggtcgagaacgggattttctgtatcgacccactcgatgtatacgcaagccgtagtgcgggtctgctgaatagagtagtgttacaaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacactccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacccctgattgggcccgtaagttacatgcctgatcagcgccgaaagttacattggttgtatgcgccaaatggcgggaaaatactcgtatcgcacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaaataaacaaagagaagactgctctactggccctgccccgcgccgcgaccacgcttggtcctccgggcctgtgctcgcacatggtcctgggagtaggtgaaacgatccggtggcacagcatgggtagcacgagtgtcccgcggaggagtggcctgcgcctggtcctgcgtctgcaccggcggtgcgcctcccaactgtgaggggccgatgacgtcctctgtcgagcctgaagcgaagtcgaagtcagtgatgtcgaagagcaaggtggaaggcagcaagcggtccgaagaggtcccagcatggtccagtggtggaccctgactcgacgtgccggctacctgtgacgaagtcccggtgtactgctagaactgcgctgagtgcgaggtcgacgcagctgcctgagacgctgaccctgcagcctgggagaagtgcgcggcctgcgtcatagcgaactaggcgaaacctacacatcgacaacgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggacctgtcaatccatcgtctggccgggtccgcgtcgccggcagcagcctccaccagccgacacatcggtaggaggccggcctcacacagcctacaataacaaattaatgcgtcattataaaaaatattacagcgcaactaacttatagtgatacactgttcgtacctctcgataaaggagtcgtgaaccgtgagtagctcaccgcacgtccgtgcccggaacgtcccaagctgagccccctgcaccgcaggaaggtgagaccggtgtcggtgatctatcgccgggtccaacaactgaggtgtatcctgacgtgccatctctggaaaatatagtgtttcgtgttagaacaattcagaaagtagtaatgtaaaacaaaagataacttgcaaaattatgaaatagtaataaagtcatgagaataattatgtacaacaagagtacaggctatttaaatatagcaaacgttactaatggtacataacgatgacatgcaatttaacatatatgtagagctcgataatatatcataacattacgtgtcgaagtccgacatacatcagcatacctaaagacgttaggcgccttagtctgacgttacatcacgagaccaaaagacatgacatgccgaagtctgacattacacgacgaaacataaacacatcgataagttcgaaacgaattacaaacaaagccacatgccaacatagaacataagaactacaccacgtagccagacgtggcacgatgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccttgccagcctccaactcgtccatatcgttgtggatgcgacgagtcctcctccttccagccttgcttcggagcttcgatgggtcaggaatattgagtacttcatcgttagtctctgtgacctccccagctatgccgaacccataaatctcgccgctccatgtatgatatattgcttgcttactgaagtactgtgacacatatactgcatctggtatgccacactccgctgcggcagcaatgacatgggtgcatggcctgtggagcagctttggctttgcacaagagcaatgacatgtgccgtcggctttgagaacacacttctgcttcactctcttgcggtagatacccctgcctgccttatcttgacatagtatctcaaacctgtgctgttgggtacctggcactagtgcacgatgtttcatggcctttttacgcaactcctctagctttttctgcatgaaagttccaaacaaaatgctgttgttcggcatagagggaagaactgcctggaaccgatccctaaaatacctgcatgtcccatgtaaaatgaactccactatgccaactagtggcagtccacggacaccgcgcatcacccaattgtaaacttctaccaaatttgttgtcattattccatatctagcaccacctgtgtcatacgccttggcccatttctcttttggttcatgcagaatccattgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctggttgcacagcctcttgaacatgttcatgagctccttgttcttgaattgcttgaagaaattagctcccatatgacgcatgcaccacctactctgtacatcttcccaaacaccggggtatcctcgttccatactcccaaactgcaacttttctatcgctcgcagaatgccagcgtacctatcatgtatcaggcacacatttggcctcataccaacaacttttgtttcaaccaatttcaggaaccagtaccagctgtcggtattctcactctcaacaaaagcaaatgccaagggcaatacctgattgttcccatctacccctattgctgttagtatctggccccgatactttcctgtcatgaatgtcccatcaatgcagagaacaggacaacagttcacaaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgacgacatgcgcatatatctcagatgcaacaaatgcacatgtaatgttcctgtggtatttctgaacaccaggtagaaaacatgtatgcttggtaacgactgacactgtccaataattcttccatttccccttatacacgtgcactctcaagggcaaccatctttttccttaacacaccgaactttatattgagaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgataagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcttccacagaagtctcatttacttcagcacttggtccctcgccatcatccattttcatctgcacacctggatccttcgggtgaacaaacggaaccaaagctagaggccacccgcgttgcaatgcattttccaaataccatctccacattcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagtggcccgtaacggacgtttcctggt

SEQ ID NO: 7783 - DNA, 1262 bp, Oryza sativa
atgttgcattagctagctagatctcctctctactagatatggatatttacatatatcaaccggtagtctagtactcctgaaaataaactgatcaagagagaacatggcattcacagtcaaagtgacgaatgaaataaaaagcgaactttacttcgggcgcaggaaccatcaattgatagatatgtttagcaccataataaaacctctgaatttactttatctggttaaacagaataagagaaacaaccggaccatttgtttctagtaagctgaaaatgaaacaaaaaccgaagagagttctttttttcttaaaagattaagactaacaagattccacatccagctagatctcccctaaaccaaaatggttgaagctaatgtatgtacatagttgcaggtttgcgcaaaatttgttttgatttgggaagttttcctttgagagagagagagagagagagggagggggggggggggacagtggcactgcagataagtacggcggcttgcattgtagagataagtacgagacgtcaccaatagaacagtaagtggacagtgacctagtccctactatttctggagctatcaggattcaggagacaggggttctatcacgcaattacttcaagcagcagcgacacgtgtagaactgaacaagtagaggacacacaagaaatctgtggcagcaatagctagctactgacctgatcgatctggtggttagtgagatggaaggagtaattagcagatctgagggaaatttctttcctcttcccgtcacctcctctaattaagctgatgcaacgaacattccaatcttgagagctacagtaagaaaaggaattgaacgagagatgcgcgcagatctgaggggaaatcagtagatccatgcaaattttatgtcggttatttccaagatccatctcttggaaccaatcaaaatcagtcaatgtcacagtaaatacagttagtattttgtaatcccaagaaaggaaaaggcagttgggagttgggatcccttggaaaagacgaacaaaattagcaggacaaatcaaaggactcttcgtacaaagcaagagggaatccgtacagcaagtacacacgcgcgtgcgtgcgtcaccgactcaccgtcgttgtagatccggccgcgtacggcaaccgcccaaaaaattttgcaggatcacggatcgagcccgaggagtacctggggcatacgatgataagagcacccggacgcggcatgcatgccggcggccggccgg

SEQ ID NO: 7784 - DNA, 17670 bp, Oryza sativa
gcacgcggcgcggtcgacggcgtacgaccgaccgttcgacggagcgaacaccgctttgagatgcgagtgtggtgcgccccaagtggtggtgaaggggaaagggggtgagggggtgccgtctatataggcggagacgcccgcccgctgggccccgcggtggcaggaacccgtcgatccgcgggggagggacggacgcacgcgcggtggaacattccgcgctggcagatggggcagcctggctggccggctggctagctgccttggctagatagggtttccccgccccgaccgatcgatcgatcgatcccgcgccgcgccgaggcgcgatatgatgcgatcgcgccatgtcgcgcgcgcgcccctcgcgaacgcgaacggcttctggcgcaataaagccgagccgtgcgctgcgccgcgccgcgccggaggggggttgtgggctgtggccccctcgacacgacacgaggagggggaaaagcgcgcagcggcgcaggatatttttttgccaaatattgcttctctccccttacccgactttgacagtacgagagcagagagagctgcaagtccaaactgactactgttactctgcctgaccgacctgcaggctagctacaattcgcacgcgtatgtgtacagttaattaatggacccatcacccaagccacgacccatcactccatcaggttgcttttgcgatcgagatagtcaaaagagataaagacatctctccggccggctaggagtattacctccctaaaaaaaaaagacaaaccatgagttgtcgtgcacaacgtttgaccgtccgtcttatttaaaaaaatgaaaaaaattaaaaagacaagtcacgcataaagtattaatcatattttatcatctaacaacaatgaaaaatactaattataaaaaaattcatataagacggatagttaaacgttggacacggaaatccacgatttatcttttcgttggacagagggagtataagctagtgtcatgtcagttaggtcgtcctcttggcctaaggccctgttagttctgaaaacaaaaatttcaccctatcacatcaaatagaatatttggacacatgcataaagtattaaatatagaaaaaaactaattacatagttcgccgggaaattacgagacaaatcttttaagcctaattgtgacatgatttgataatgtagtactacagtaaatatttgctaatgatggattaattaggctcaataaattcatctcgcagtttcctggcgagatctgtagacaatgttaaatacttcaaatgtgtgtccgtatatccgatgtgacacatcaaaacaaaaatttttggaaactaaaccgggcctaagctggagaaattttgttgctgctaagaacaaattttataatagatgtgactatcacctataattttatttatgttaatatatctctacaaattaacatatacacgacaagttacctacaacacacaaatctcagtaactctaatttttttatatttttattgaattttgtatagaaattgtccctcgtacgaggggtgactacttaatttactctctcttcatttctctctttcacattagtaaatgagattacatggtatagaggatcataactgcttaaatgcttatagtggcccggtttagattacaacttttttttcaaacttccaactttttagtcacatcgaactttcctacacacaaacttccaacttttccgtcacattgttccaatttcttcaaacttctaattttgacgtagaactaaacacagccagtatttgacaaacccgagaaaatgcacagccaagatcgagtggttttgagtgcagcatcgcttgctccaaaaggatcaggccaaagagcacgagagcacgcgtcgaatagtttttttttttcgcgtgattgcaggcatgttgatgcagcaccaggggctacctgcaaatctacagtccgatcttcacacttgttgtacgtagctagctagctagctaatcctttgcagggtatggctagtacaaatgtctttcttccagtttgaggcatgccaagtggtggtggaggcagaattggatgcatgccacaccgctcaacttacgaccggtcgcatgcatgatacatgtgactgctactgggagctgacaaaatttgacacctcccaacagaacggctcagctatctttaaagcatgccacatgagcttcaagacgagatagagctgccagataaaacttgtactccctccgtctcaaaaaaaaaaagataaaccttatagattttcatgtccaacgtttcaaaaaattataaaaaaattaaaaagacaagtcacgtataaagtattaatcatgttttatcatctaacataaataaaaatactaattataaaaaaaattatataagatggacagtcaaacgttggacatggacacccaaatcctctacggtaacacacaggtagaatggtgtccacaattacagatgttctttctcatgagtgatcatgtttggtatcgagttagccaaccatcagtgataggcttattggtccataacaaaatcggtgggtatgtctagtgaaatatgagcctactatgatattaggtccatcacaatattgtactattgatcggtattacaggctctaaaatccagtcagccttaatcgaaagaggattaggatggtgacgattgaactgtatactttctagattaagcctgggcaatgtacaggatgttgaggggtggatgatctggatgaacctcacagtcctcagtgctaaaggagtagcgcctgggacgagtaaaggcaaaattaaatcggttccatcttcgtatataacatatatgtatgtacaaggatgatttttgccctagctaatttgcacgctctttttttcgcatgtgatatctaatcgcatacatgacatagagagaactagaagcaaataagacaatgggttaatttttatgtagacaaatttagtggtttgggagtgtatcaaagagagggaatgtggctcgggtcttgttcgaaccagggcaagctaggttacatgttactggcttgacagacaaactcatagtttttacacaatgtcctaggagctcggggagttgtgggccccaccaggcctttcctcccaggggcttggggcgttatgggctccaccaaggcctacaaaatttgcatcttgaagttgttaagaagagtatcgagatctacaagatctacatcttcaaggtttcaagaagagcaccaagccctacaagatctacatcttcaagttgtcaaaaagagtatcaagacctactacatcttgtaggtgcaggagcggtcactagtgggtaccactgtctcgtccaaggacatgcccatcatgaactccttcatcgacatctttgaaaatttcgtccaatacaacaatgaaatttacttccggcaatgggagcactctaaagtgtccgggtgggtgccccaaggactcagcttgccaagaggacacaggttgacccgaacacagcagccagccgatgacaagcatttagtctctcgggccttgagcactaattagggtctcccgagcactccttgctggggttcatctcattaaggaaagttgttcgggtccagtaatcacatttaaaccactactttacattaattgtgaggtggttcaagattggcgtacaactcatacgctatttggggggcgtgacggtacacgcaaccccttgcatgcccacatcgcccgaagaacacaaggcatgcgacgttgcacttcctcaacaaccatcccatgggcccacctctactggctacgatggttgacggatggtcctagggacatttggaacgaagacttttaactcccctctccacttgttagtcagtaggtgtacctgccacatccggtcggcttgcttggaaggaaaaacgacaagactaagcatatcaattttagagtagtagaccctactcctgcatgcatgcaacaacattgtggactccccttcacatataaaaggaggatccatgaaaaacaaaatgtttgcgctctcatctaagctagctaggttagccaaacatccagtgagtaaggagcttttcctcctcacttagtttttcttcccacatcactttgtaattcctaagaacatgcatagtccactgcacaggagtagggtattacgtattcatgcggcaagaacctgcatatttgcttgtgttcatctctaccacgcaataaaaaactcgggctcagaacttacacccaggccgaaactcacaaatgaggagtacttagcttccctgctagaggagtttcacatactcactcactcactctctctctctctctctatggcgaaaaaataagcatcattgcaaaaattatcaaattatcggttactatttgagatgtcctcgagcctaggcacattttcgtccatgcaaattaagaccacaaatcctatagcattttttttcatgaaaacttttaacatatatactccctccgtcccaaaataagcgcagctatgagtttccgtgtccaactttaatcgtctgtcttatttaaatttttttagaaaaaactaaaaaacgtaagtctcgcataaagtactattcatattttataatctaataataattaaaatactaatcataaaaaattttaaataagacggacgatcaaagttggacacggaaacttatggctgcacttattttgggacggaggtagtagtgtttattaggagcattaatgacgccttgaatgctatatcacaagttcacaacattagggagtccattgactatctatgaccctgttggttgaggactaacgttgtcacacattttttttaagtaaggtgacttagcttagacatgtcacatttttgtggcaaacaaaatgataaaccatgcttaaacaaagttagataaaaaaagttgggtcagatgattaaaaagttagataagtcagagttgtaaccgaaaccaaacaccatctacttaaaaatataatttatctaagattagatgtggtgtggtaaattcagttaccaaccaaacacgtcctttctcttcgtcggctacccaaagccacccatgcatctactgttaatttgcatcggaaaacatcattactactactccagtagctagtacgcgctgcagttgtgtgcatccgaaaacatcatcacgatataatttcacgtgcgccgacaaaagccttccattattgttcactgtcacaaatgttttctctcccgggatctaaacatcactgaccgatcaactcgcactgtagtaactaattgtacccggctagctttacgttcacagtacaactccacaaacagtaaaacaccaacagtaaacacaccagctgctcgttccaattacgagctactcctaacttattagagcaagtttaatagtataatcaactattagctccaaattatctagagtcaatgtaatagctaattcatacaatagttgcttactatactattaatacctggtcccacctatcatacacatgctacgttttggagtccatactgtaactggttacagatatgtaacctgctgcttttttttcttttttttatctctttaaaatatatttatagctggtttataacctcttgttcctgctcttagctgtttggtaggcaaggcacgtagctccacaatttttcctttgctgtttggtaggccgaggtcgtatagctccacaaatttctcctttggcacggttctcgagtgccgagatcggaaatgtcctcttcctctaggctttcctcttttggtccgttcctaattggccacgattaagcttcacatggagctcgatcgatcgaccgatcgcgctgtcccagaagataagccgcgcccgctcgcgtcgcttcgaggaaacgaacacgccggcggcgagatcgatcgagcaggaggaggcaggaggccagagccactctttgtcgactcgtgattggccgcgcctcgctaatctattgtttaatttaatttaagagtgcttaattaatcgtcagaaagataaaagcagccctgcttttaaattttatcggttgcgagacatgcaggcagggacattattggagcagagccaataatgatagttaattaagtactatatgtactagtggattggttaatcagataatgtgttgttaattagtctgcacaatgccgaagcttttggccgggtgagcaggagctcgcatgtgcactgtgcacgatcgatcttgcgacgaagattttgtaattcttaaggtagatcatgtcgcgctaagtgctcgcgaataggatcaatatttggtggtttattttgggaaaatgtggttttggttttcttagtgtacagcgtcaggggtaagcatgcatgattggaacatcacaaattcggctcctcctcctcctcagactctaatactttatactcctcttgtactttagaacaatagtaatcactcctcttgtactttaatacgatagtaaccgctccatttgtaaattaaaacaccaaaataatcgctcctcttgtactttaaaattaacaatctgcaatggtacaattggtacgtcatatgtgtgcttttcgatcgaagtgatagcatgcatgcatgctcctagccctaggttcatagaaggtcagtcagcggcgttctggtcccctgtagtaccatattctactcggagcatgcgtgaaggactttggaatttgagtgtctcttcctgctattttaaattgccatccaatttacagtgagatttggatttttggaggcagaattaaagaatttaaataaggcatggtagcatcactactcagaattctgatattattccacctgttataaaagttagtcaatatagcggaatgacgactaaccttctcaatcgcttcagtcattgaccacccaagacatgccagatgacgacacaggaacacacgatatttgttaacgacgttcagccaaaacctacatccctggggctctgattatgggcgctcctccccaaccaatatagcttctaaccgctatgagtccggtcatggcctcgccgccatcatctctctgcgtgtctacgctctattatagtcgccatggttacattgtggtaccccctctctatttaagactaccaatttatttccctagtacgtccatgtaggcttcgatcttggaaattcagtgttaatcaaacggcttaattagattatttttattttctcgaaatggcatggaatcgctcttgaccccgcagcacaacttactattggtccaagcagcacccactctcaaccttacaatatcacctcaagatccagatgtagaaaaacaaatgaagtggtttctggttgccttttccaaagcaagaaatttgtaatagtgtatagacatgattatcaaataaccactttaatatacgaagaaaaagtcttagattcatataaaaaataaaaagtcttagattcgacaatattcgatagctggcgtgtcgttggtagactatacatgtataattattaaatagaaaagtattacaacttgcgagatgcgtgtcgtggttcccggttgctttttttcaaatttgaaaatttataatgtatagacatattattaaataacactttaatgcatgtagagaaagtcttagattcgacaatcttcggtagttgttgtgtcgttgatagattggatatgtctagttgtattaaataaaaagtacaacttgcgggatacatgtcacagttcctgctagttaaatattgaatccacatgctactataaggtaagttgtcacgagactaactttatgttcaatatatatataataaatttctaactggacggtcataaacgatctatgtgtcgagaataaactggtccgatctaacccaaaacctttaattgactatatccacaccactactctacaaaccaaattgaccgaataacatatggatacattatattttggattccaccggttgcacagcgtgtatgcatgcgtcgtgctgggtttgtgtgtgtggtcctatttcgtgctccatgcatcgatcttgtttttgtgcatgcaatgcgtggtccatgcaccaccatgccgctttttgaacggcggtctgagacatatacagtagctagataactataccagctatagctagctcagcgagatcgattcgaactcttttgaaaaccaagttgtgagatgtgcgagcctatatagcataaagtagtgcatacctatacgaatgcaaagctagagacgcaaaataattggctaacctatacgaatgcaaagctatacggtatatgcatgtactccactctctcctatagctagctactattcgatcgacaggtgtattggcacagtatcttttgccaatctttatttttggcccctgcagggttactttaattgtgcgcgtgattggtcggtccgtagctcgctgtagtgtgggcaccaccacacacacacactgtgtggccccccctgcgcgccctctgccactgcatgcgcctaagctaggaagcaagatccatctcctccatcgctagcttgagctgtcatttggccgcacgtctgcagatcgatcgatcggtttttgtggggagtagatggcatggtcgccgaccgatcgatcgacggcgagaccttaattcgtacgatcgatgcggcgccgtacgtacgtacctgcgtgcgcgccggccggcgacagttcgtcggtcgatggatggatggatgcagagcgcgagcggcgcgcgccgctcgtagctggtatagcgatcgagctagacatgcggcatgcgcgcgtggtaggaaacgatgtggagacggcaagaggagacaaagtcacaaagagagaccgatgtactatgcgtgtttgtgatgaccggcgtatgcggtaattgcgtatgccgtgccgacacgatagatcggggccgggccaagtgatgatcgtacgtaccttcctgagtcctgactcgtagtctcgtactagctccgtccgttagtcgggaaagtccaatgcatgtgacgtgcaagtgtacctgtagtccatttagcccctatttacttcacaccaaacttcccccaaactcccaacttttcattatatcacatcacatcaaaaactttcctactcacataaatttctaactttttttttccaaacttcttccccaatttcaaaaactaaacacagccttagtactgtatttgttttgaaattcaagcatacatcgcggattttaataacgtatacaatattgtattcctctgcttgtggtaacatatatactagtagatcgtagtaaagcatatttaattgcttagcctgtagatgataatatgatatgcgctagtgcttggtaaaaatcatgttctcattaattatttacaagtttataacgttgacacaatttctattgtacatattttaccattgtttttctaattatgaatttgtgaaagtagttgaaaatacaacaatatgaatgtatttttcataacaaattagtactactagtttcatttttggataacaaatattaatatatatattttcacatagtaggatttaaaatataaaacattaacatcatcattatttttttctgattctcatcgtgtgtctacttaaatagctgcctctcagattatggtctatttggtcgagctcgaacttcaaggaggtgggtctggagtggaacagcctaaacccagcttcacctctctagttcattttgtgagagcgctacacctagcttcgtttcttttttagtggagctgaaactgtttggctggcttccagctcctaacaaacccttagtctccagctcccacacactacacaaatgaccgtaatgtgacatcgacagaaggaggtgagagagataaaagatgggaaatgatgctaaactctcgagtggacaatattccctcgattttcatatcatttaaatggttatatatttattttagaaaaactagcaagatagataaatataagatgtatcacttcacaaacatataagatcgaatttaacttcctataattcataacataataaataaatttgactgtgaatgtatgttaacaagctatagtttagtttgttctttttgttgcaacttgtattggtagaatttaacttatatgttttagagtgatatatcacatattaatctatctatgttatcttttttttataactattcggatgatatgtgagaggatattttctcgagagtttaaaatctatttacaaagagggtgtactgtacgagtgcaaaaaaaacattatgcattattattttcatgtggcacgataaatactggtgtcggagaattgtcgtcgtccttcttgtcttcttatacgttcttcacctctctctattgccaacaacagtagccattaactgagcgggatatctaccccctttctctctctagatctctctgtcttaactgaagacatgcatagcactactttagtttggtcccttcaaaacatgatgtcttgtgtacaatgattaaaaggtagggccgctataaattcctatctctgtggagtgagccagatgtgtagtacccctatttggtacgccgcttatctctccacccacccaaatgttttctgatctggcagctttcatgtggcttgcctggacgtgcgactgtctgctcactagctccaaacaacgtttaagtgtccccgatttgagaactgaccatctcccgattttagcagcacatatactccgtaatctattggtctgtacatacattaccacattcttattgtctttggtactcttaacaaattccaagtgtgtagtattaaagatgcacatgcagtatgctcctttttttttctaagaaagaaaaatataacctgacctgaaacttataagattgtgtgggatgctccgattcttcaacggaaaattgataacttgtgcccttcgctttattcatatataactgtcgtcgtgggtcagatggaaaattgagcaagatgggggcctcccaaatcttctaattgggcctttcgcagcccatccaaagattgcccgcttcaggaagcccgcgatgccgcacgtcgttgcacccagcacccgtccgatgcggacgccccaaacgcacacgcgcttgccgatctagcgtagccggccgggccgttgcgcttcggcgagctaacgccgggcgcgccgagatccatccaccgaggggaagccgtgcgtacgtgccgaactgagctgcgtgcgcgagctcacgcggaggtaacgctcacctcgccagaaaacctggcgatcgcgcgcacgcaccgcatgtcgtacgggcggtggccgctcgcacgagcgcgagtcgcgtgccatccagctacccggtggtcccggtccctgccgcaacgcgggtctaggccgaggcggtaagacccaaccctgccatatctttgcggcgcctcctattccgtcaaggcaggccgcagccggcaaatccactgtgaactgatccgacgagctgtgtgcacggggaaacagggtgaggaataagttcactttaggtcccttaatttgtcaccgagtaggaaattcatccatggactgcaaaaccggatacaacgcatcccccaatttacaaaatcgtgcaaacgaaatcccttggcagtattatactccggttttggctgacgtggcaactatgtggctcctttgactaggtcttcatcccacgtggcattgacgtggcgcttacatggcaattcgatccgaaaaattgataaaacaggacctacatgtcagtttcacatacaaaataataaaaaatggtaggtccatgtagcccacatgtcatcctcactactcccctattctctctatcctctctctccttttatctctacccccctctctccgacgggaaagcagcggcgcgcaggcgctggccggcgggaggagaggagccataggcaaagcccgaggggtgagcctcctccctctccgccccccttaccgggcggtgagcttggtagagccagagccgagggggcagggatctgagagggaatggagagggagaagcggccgcttcccacgactcctttcctcccatcggtcaacgctcgcgcatcactcctctctcgccagccactgcgcgccacttctctcccaccggccactgtccgcgactcctttcctgctggccgccgctcgcgtctcctttcctacccgtggctcctctcttcctgccggccggcgcttgcatctcctctcccgccccggcgaggtcgatgaacacggcgacatccttctcatccacccgacctgctgctctacctgcggcctgccgccgctccatctcgcttggcctgcgagagagagaggatagagagaagagtggagtagtgaggatgacatgtggggacacatgggccccaacaattttattattttttgtgtgaaactgacatgtgggtcccgtgggttttattattttttcagattgaattaccacgtaagcgccgcgtcaagagagccacgtaggcgccaccgatagccaaaaccggggacaatagtgctgaaggacctcgtttgcatggttttgtaggtaggggatgtggggatgaatttcgaacttggcgacaaattgaggacctgatgtgaacttattcgaacagggtaaacccatgtcagggcaagctacgtgcgtgtgcacgatgacgaaggtttgtctgaaactctgaaggcggccacaggccacttattcaacccgcagttggttgctgtggactaccgaggcacccatttcagttgtaccatgcgttatggacttccacctgctcacggttcattgctagcacaaattttcgccggacgattactagcagaatttagtactactctgttccggattaagcttttggccaacttgcgggctttacctttactttactgaagcaatcattaggatccaattatgctttgcttccagcaaagtacaccttgaatagtatatacgaggtttagtacgtactttgatgtcataatcactgtagctagtagagtatccgaccgacaccagcccctctcgctagaatgttgcacacaccgagtactctgaacttacaaccgacgagcaacagattcacttgcttctcgttctgaattccgaaccacttctgcagattcacaggcctagttgggtagttgggtaccacacacgttactgcttagtgcttacttgcaaggttcccttcgagggtgtcctggcaattttccctctgatctgcagctctttactcttgttgtgcagttaccagatgaattgtagtagtagtagttagtctgcgtacgaaacaacaaagattgatatgtgcaaacaacttccacacaaccataaatatacatttcttgcaatctttacacactcgacacaagctcatcctgtcattcattcagtcagtagtcagtaggtacgactgaaaacgaagctatctccctgcacatcctgattcgccttaccttacgtttcaagtcaaagcatgtcgtgagaaaatttatcggatgtctgttcgtttgttcgattgtttgtttgttttctacgtaccaaactctgaagcgaaacgctcaaccaccagctgctgcaacggtgcttcaaattggacgagtggtcattgctgaaagagagagaacggcattgcgatttgcagcatattcagaatgttcatcagtggtgacagagctcgagacctcgatccgtatgtgatatgtttgctacttaatacagtagttagttagggattgcatcaaaagcagaaaacagaatgcaaatgtgaggttgttaatgtgaatctagcgcaggttcttttaggaaaaaagatggctagttcggaaaatgaggacaggccaaggagtaggcaaatatactagaaggacaaaacagagagatccgagcaagatatgttcgattcttgctctcttttctactctgctttttgtttctttcctcgattttactcgcagatatggatagcaagcaggtttgcaagtaaaaggtacaaacagacaagttaatcacggtgtgatacgattatgacatcttggggcatcataatcagtggagagcagatctttcgccctcaaatatttgcaaactgtagccctgaaacatccggcaactatctgacacaacagtttgaaaatgaaaatgattttgacagagcaccaccgaaaaattgactactgatgtatcaaggctcagcaacaacaatcgttgcttggtgatcattaacatcacaaccaattgaacaggagtgacaaaggataatgacaaagctgattcttgaaaatgacagcattccactgatatctctattctagtagtaattactaggaaaacattttagtaataattagcagtttttttccccgcacagcacatagcaaaaataagttgaattagattttaatacccttccttttgtttgtataaacttaattttatattgtacacaagcatatcgataaattacaccgttataacgactcaccgcgatcaaacagtgcacatctatctctttttctctaatttaatgtgtaatttctaaactccaattttgccatttggatgacacgtgaactttttactcctaccgataacagaagttacaacgtgttgctctgccagtttctctgtcagtagtgttcggtaatcatcattgtcactcctctcttgttacagagaccaatcccaatgatggtcaggtcagatgatcggcggcggcgacgtctcccagacgtcgacgacattctcctcgttgtgcagggcgaagaggcggtcgccgccgatcgagaagtcgcagatggcgccggcgtcgctgccccgcagcgtcgacgtcagcacgtggtcggggccactgaacaccgagatggtgtcgttggtcgacgcgaagagctggccgccgtgcgcggcgagcttcgggtagcacgtctcctcgccgcgcggcgccgccttcttcttcctggcggcgagcttgctccgcgacctccaccgcacgccgccggcgccgccgctgctccggacgtcgaggaacccgaggtcgtcgtactggttgatcacgcagagcgaccggccgtcctccatcgcgatggcgtgcagcacgtgcttgtcctccagcgacgccggcgtgccgacgtcggaccacgaccaggcgacgttcttcttgtcccggaagtccagcaggctgatgaaggaagagtccgtccgcgggaacatggtcgccgccatgagcgtgctcgtgccgtcgagccactggagcttgtcggcgtcgccgagcgcgcagcccggcggctcgtagaagaagtcggcctgctcgccggtggtgcagtcccagacgccgatgccgtactcgttgaaccggcccttgcagctcgcgaagaccttgcaccggctgtcgaaggcgagcgccccgggggtgtaggacctgacgtggcgatcgtgcgcgacccggaaccggtggcccaggtcgccggtgagcccggagaaggccgccacgccgccgtcgcgcctgccggtgccgggcctctcccgcgcggcgacgaggagcgtggcctcgtcgaggtaggccgcgtcgttgaccggcgcgtggtcgaggtgcacggcccggcgctcctccatcacccagttgtacacgcgcacggcgccgccgtgcgcgacgcaacaaccgccgtcgggcgcggcgcggacggccgtcccgtcgcccgcggcgctcccggccacggacgccgccagccgcagccggtccccgtcgaacggcccccaccgcgcggcgcggacgcggtcgaggagaccgtagtagagcgcctcgcggcagagcaccccgtcggcgacgtggggcggcacgtggagcccccccgtgcggagcaggtcgagcagcaccgcgaagcactccgggtcacggtcgatgaagtactcgtccgcgccaccctcgccgtcgccgtccccgccgccgccgtggttccaggaggcgtcgatcatggcgccgagcatggtgtcccggccggcgctggcgagcgtggaggccatcgtctcgaacacccggcctccgacgttgagccgcacgcggccccgcttccccttcatggcctcgcactcgcggggaggtggagagcgagtggcgcgcgcgacggtttggtttggttggggttggggttgggccacgccctcgcgtcgcgcggctgcagtggtgacgcggggcgtttttgcagtgggttcccgtataaaacgggctcgcgcgcgtgccgggccttcaggtggcgggcgggtgaaccggcggaggatttgatcgggtcgcgggagacgtcacccaaccccacgggtatcgcggccgttgctttcacgcgagacgggggggagtggcgttcggggttggggattacggtgggggcggcgcgaacggtggtggatttgggggacttttggggcgcgtggtggcgtcgtctccgcgactcgccgactcgggtggcagcgcggtgaacggcccaagtgagcgaggacggggtacgagtccttgtaatggtcacgtagtggagtagaaagttgtgtttgtgtgggtcggttggagttggactggcacgttgcacgcggtcggagagcccccacgatcccgaaccactccccgttctaccaatgcgcaccacggcactacgtagttccaagctttaaaaagaaatgaaaagctccaacattgccgagtccaactagtgctaccacccaaagaatttgtataagtataactacagggcgctaagggcaggtacaatagcatggtataagccagctataagcatattttaaagagataaaagaagagatagaagagcagcgggctacagatctgtagccagttgcagcacggactctaagacgtaatgtgtgtatgacaggtgaaaccatgtattaataatatacttcctccgttttataatgtaagtcattctagtattgcccacatttatatagatgttatgtgtgtctagattcattaacatcaatattaatatgaaaaatgctaaaatgacttacattgtgaaacgaaaggagtagtaagcaactattgtatgaattagctattacattggttatagatgatttggagctagtaattggctatactattaaacttgctctaatgggagggcggttcacagttagcccagttccggaagaccagcggatgcggaatttactggagaatcgcctctcgctcgtaatcccataaagcacggcctttttgtcatttaacttccccgcaaataaaaaatattggattgaacttttaaagagatgatatgcactaacctaggatatgttaggcacgtagctcaatcatggccttcgtttcttctggctgaattcaggcagcctcacagctctgcaaaggacggaaaagttaacaacgctacgctagctgaatcatcatcctcatcatcaaggataaaaactgggactcaaatggcacatcccgcacgcgttgttgccgatccaagcgaggcatgcgaggtgataggatcacccgggtcccggggcgacgaaaaattgtgcaaagaaaa

SEQ ID NO: 7785 - DNA, 8289 bp, Oryza sativa
tatgaagatatatagagtttactagtgtcaaattgaccagtaggggactgaaacattgcaaactgaacagtttagacctaaccccttgaccgatgatgcttcccagatgaccaacgaaatcataagccgttgtttctgaaaaattaggtgacgttcatcttgtaacgtgttagttgaccactgaacatcttttctgtcgacttggagatgggatagttgggagaaataatggaatagttgacctggttagtgtctgcctccgctatggcatgagatgagaggagacgacgagacgaccgaccaagtcaatactagttgataatggtcgtgccgtcatggacttggtagcccactagcccgaagaggaacaagccgtgtggcctcatgggtatgcactatgcagtaatctgaacctcaatttccagacgtttgtttccataggccatgtttagttcattggccaatttttttttaagtatacggacacacatttaaagtattaaacatagactaataacaaaacaaattacagattccgcctataaactgcgagacgaatttattaagcttaattaatctgtcattaacaaatgtttactgtagcatcacattattaaatcatggcacaattaagcttaaaagattcgtctcacaatttacatgcaaattgtgtaattgattttttttccacatttaatgcgtcatgcatgtgtccaaacatttgatgtctatttttgtccaaaaatttttgggatctaaacacacccatagccactgaacgaatgcacaggggccaattcttacatggactgttattggcttgttgttaccactgttaagactaaaatatagctatttctagaatacaaatttgttttaaaatgcaactatttcttcgccaaatcctctcatcttaaccaatctatccctatttaatttttctattactttctcttctaaatcaatcataacctttcaccattcatttatcctatctaattccttaattcctgtgaaaaatctaaagaaatgctttacatttaaggttgaagtggcaacatgcaatctctataagttgtgataactttttacgctggcctttatcgatgatataaatgattttcatccaattccaattgtaattaggagtggccctttaggtttctccttccattaaaaatgtacctattttatattttggtttttccaaataagttagttatatttgtagtcctccatgtatctaagatttaaatgaagagatatattaaatgtttgatcaaaactcaatgaactatcttaaaactatctttattacatgtaagataagttaatttctttttagttttagtaacaaagtaacatgtgcaactttttgaatgaagggagtagagctttaaggcttagccatacctctcatggataatgctggaagtgcagagcttagccaggccgtagtcagcttcaacatggttgcaatctgcgacagggagatcgctgcttccactggcatatataaaacgttgaacagaataacataagtacagaattaagtatgccaagataaacacaatgagacaacctgacagttgtgaaacaacctgcagagatgacagaaagcagttagcaataggcatgatctcccaaaagagacaatagacgaaaaaaaaaagagaagataatgtatactctactcgcagaggaatatgagctctgaaaaacaggatttcttaatggtgccaggcagggctgacagaccggcacattagctacaaaactcatttgctcatatggcctaaataaataagacatcaacaggctagctacaacatcatccgacacaactatgatgtcattggcctcttggcaagcatggggttcaaccaaccattaaaagttgcgcacttgcgcctaacatcacaactacagcatttttatcttgtctacaacccctagttaaaaccgctacatgcccaatcagttggcattccaataggtcacccgaccgaagagttacaaccacacagggtgcaatgttttaacaccttttgagactaagcgaaccttttgagtctagagagcgaatccatgtacaagagaaattagcgggtaacttcaagccttccttctgcgcttcttttctccagtagaagcgccaccagcggatccctaacttcaagccttccttctgcgcttctttcctccagtagaagcgccaccagcagatcccccctgctccacttcagctgctgcctcgccttctgcttccttctgcttctctttctcagctgagacattggccttagattcctcaccagccaccgcagcaccggcaacctttggctttcgacctggcttggctcttccttcacttggtttgctctcacccttcaaatccttgcctccgctgctagcctcctttggtttactggcactcttgttgctaccatcctcaggcaaatcatcctttgtcttctcagttgacttagtggctttgtcttcggatccttcttcagcttccttcttaaggtcactgccaaccttaggtgtctcattttcatccttccttgcagctttcccctttgatttgcttgaagttgccgagatgttacttttgggtgtaccattgctggaacctttcggacgacccctttttttgggaagatcgcctccaccactgccattaaacagaaacataagtctcagaaaatatgtagtcaattgtctacactgcttctttgattaccaaattaccttttaggtgtttctgcatttccttccttcaattgcactgagctccctcttccttttctgcccctaccccgtggcttcggggaacttgaaacaaccagtaacacaaatttatcaaacaaaataccacttgatgcaaataagtatgacaaattagtcacaggtttcacaattggaataactagggatgtttgtgggaatcccatttacttcacacctggaccaaacggtgttcaatttagtaatttttgagttaatttgcatggaaacgaattaggatggacccatgggctggcacaacccgacccagtcatccctagagaaaactaggaattattgggtgtttgtaaggaatttgctgaattcccaacacagtcaggacagcagacatttctctacagttctttttaccatggccaaattatgacaaaaaaaaacttagcctattcagcaagccaacatagcttataacaataggaggtgccaagcataatagaactcaagaaactggagagaaataaatcattaaaaaatgcactggatgctacgattgaaaaccagtgattgaatcaataaaaaacttgaactgtatagctaccataaatgcaaagtaaaaatgtgattttgaagttgcaggtatggaagtggtgtcaagataattcacttacatctcggaagccacatcaggggttttgtcttgttcctgatataacaactgctaattagtttaaaaaaaaggaagaggagaaagcagaatcacaacattaaatgcaatctaagcagaatcacaacattatgtgcatacctcactgacgaattcccacttttcatccctaaggagaagcacctctacatctccatcatcatatgcaatctaagctccaaaagtacaaaaaatcaaccatacaagaaaaacagaataaaacctttttttaccaagagaataaaacaatattttaattggcataagctcttcatgtaggtcatatatcccatgaaagcagatgatacaatgtacagggctcataccttgtgcctttttgaagctgtatcaaatgagtcaacaatgcccttgtaaaacctgcaaatatttaaaacaaaggacctcaaaattttgaaacaggatacaaaataacccaataaattgtaccaaagcaaaggacatgcctcatcaataatgagcaaatatattattatttgattaaaacatcaaacaggactaacctaaatactaagtcaatgttaatatatatacaccatttagaaaaagctacacagcagatttggaattagaacagcggaagaatagaaaggcataaagaagtaaaaaagatgagctagcaaatatgccgtgtgatgataatgtctatatatctggttagtttatatactccagtgtcaacatgaaacatggcaacaattgtaaaagatttagcatagagactaatgatcatatcacttacttcttgtcgtcaggccaccatacttggatccttgcaccaacaaggctagcatcaaggcctttattcttcctagaacgaggagtctgcagagggcatataaacttaagaataagaccaaaacataggagatgttaacaggtgtcttgagaaccaaacatcttcaagctcaactataattacgcttctaaaacattgttatgcattaagtgattttatcctaaatcacctgaataaactgggatccctattgaagcgtatttttttatcctaaatcagctattgaaggttgttacctagggtgtgcccagaaaatataatcaaatattttttaacacagatttttctaacacagaattaccagttttgaagttgaagttgttgcaacaaacaaatattatatttgagctattgcaacatcattctctacaagtcagattattaaacagaaatttagtaagcacattatcttttggcacaaaaagaaagcaacatgctaacttaaattacacctttatgagtaagcgatcaaatgaaatatgagcagagaaaagcacagcagacaggcaacagaacacagagaatcaactaatcaagaatgcatgcataatcaagtgcatacctcttgttcatcctcttgtgaccttttcctcttggagccattattgtcctggccttggctgcccttggtcttagctgaccccttggacacggactttggagagaccatttcctttattgagatagaacaaacagtacaacaaccagtgtgctaaaaagcaactgaatagatgctattaaattctatctgttttgaattaacatcaaagataggatcaaatcacaattgaaccacactaaataactcctatatactcagtgttatagcaaagtttacaagacaataacaggatttgaatcacaagcaactgtatcagtaaacaaaagctcgtaataccttgaaacagtaaacacactcaaaacatgtttcagatacacaaacatagcatgccagagagaaatagtattaacaaagactgaataatgcagcaaatcaatgctaaagacaggcagctttactaattatacaaaaaaattactactgacaagaaaattacctttaggctcagatccttagcagtatcttccttggagtcagtttcatccttctgtttcaaactgatcttttgttgcttttttgatgaccctgctccacttgcctttcttgtagatgacttggaatcatccttagatgactgcttcgataacttccctgttgaatcagtagtctcctcaacctttttcagacctagaactttctttccagcagccttcttctccaatgactttagtccaggaggtcgacctctttttgatttgaccatagctggtgagccatcaacacgttctgatgtttcagcagaagctccattggcaacctttgctgactgcttaacaccatcctttttctctgaatcgggattggataattccttgggattagcagctgcagattctgtgccttcagtaacaagattcaacatatcagcatcttttgtatttacagaacagtaaggttgttcaaggcttcaagcttatcctttggaggtgtccttaccattatcaactggagttgcaccactgccaatagcagtagtctgagtaacatcttgctccaactttgcaggttcctgaaaatagagatggcacggtgtattatcaaaagttcatttgtttagttgataaaaacagaaatgcagagcagcatacctgaggtagctcatcagaaatagtcctttcagaaagtttgccatcatccacctgaacattattaactcaatagtaagaatagatgaatccacatcaagagcccatgtggccaatttgttttccagtttcaacgataaggtgttgaaatgagctgtatattaagttctgagactaatattcacaccatcacaaagtacacccgtacactctatagactaaagccaatcacaatttcatcttccaagtgatccattccaatataatgcagagagcattaatgaattcaaggcgtatttcaaacatactaaaaaaattatacacataatgacctattctaacacctatgattatcacatagaagtctaaggtaaaaaagaaacatctctgaatattagttgctgcatgttagtaattcaactgaccacatcttttccagaaggatcagcatccatgtcttccttgacatctgaactgtcttcacaaattgttgcgataatattgtcatattcattcaaggaagtgcctttaagtaactgcagaaagaccggtttcagtttttcagagcatgcacctatcaccttctctgcaagttcaaaagatgcagcagaagtttcctggaaataaaaaccaaatcaattagatggtatctttttgtctgggtaggaatgtagattcatattgttgatgtcaagaaagttaaaaacatatatatgtaccttcagttcggacttagcatgcttgagcagacattctgcaatgggtatctcaacttcatcatcctcttcaattaccaaaatcattattgtagtcatacagtttgtaacattttctgggtgatttggtctgaaatatgagacaagggatttcaaattatgagtgtacatacaaagcatacaatgcagacattaaagtataatatctaacaaaaatgtgttaattatcaactggccaaagtagtaacacaagcaagttatttaggtaaaaacaatgtaatcatgaaagatcttaatattggcgatttagctcagactgatgactttaaatacagagtatataagaagcctataagaaaaacattgaataagatctgtgcagaacagaacagccaattgtataaaaaactatctgatattcttgttcttgaagaaccgttacaggtaagaactatgttaaggaaataaaattgactcatttagcattcttggagaacataatttagcaaaacttacttcaaacttatcatgagaactagcaaatatagatgaaattaagaacaaacgaagaggtacttacttcacagttgtgaagaagttgtgaaacatttgcagtatcagatcttcacactcaagatccaacatcaccacgcatagccggacctttgccacagtttcaaggattgcaactatccttcgaaacaaggggttctccatatcatccaatttctcaaaagaccccaccattatggaaaacacgtcctgaaccgaaagtagatagcacaggtcagatgtcaggatataggatatcaaaacaagatcatcttcatccgataagaaaaaggtataccttcatgacatcatcgtcatatggagtgtcaggtgcagtgatcctagttatctcagaaatacaggacaccacagaaagtttcacctcatagctagaattatccaacagctctttcttgatcaaagctttcattgctggagttatagcactaatcatgctttcagaaggtgcttgttccactttcaatatatatatttcggcctcctgcatgaacaaacaatcatgccaatcaaagatcagttttctagggaaccaagaagatcatatatgctcttaataaaactgtaatgttaaaggagtatggtgcatttacaggaatcaacaccacggcaaactccgtatatcaacaatccaactccatatgtcaacaaacacgacggaaaatactctagaaaaacaaatgcttgctctttgtgccataacggaaaatcaaacggattgcagagcagcagaaaccaaaatgaatctaaagcggaattccagtccagtaaaaatcacgactcccaaccgaatcaatcctcgcggaatggtatcaagccaaagcttccgaaccatcccgaaatcaaaccaaccatcccgaaaccacgcaatcaacaggattaataaaaataaataaatccaacaaacagcagaaccctgacaggagaggcaaaaaaaaaacgtttcaaagcgaacacaaacgaattccagcacagagagggttagagagactcacgtggatgagcttgagcaaggcatcgacgtc

SEQ ID NO: 7786 - DNA, 5736 bp, Oryza sativa
atggatttctctatagctatctctgcctctctctctctctctctcccccacacccaccggtccccttttcccctccctccccccgtgcgagacgcgatttcggtgcggtgcggtgcggcgcaacccggaggtgggtggtggagatgtttggaatcgggcggggcattttatgggcgcgacccggggaggggttggggttgggcctcggccgccaaaaaacgaacgggagcggacgcgtccgggggtgaggagggttagggcgaaaatgtgcgcgggtttgtgcgtccgaggtgcgccgccaagttttgggggtctagcggacgggagtccccaggcttgtctgaggcgatctcggccgtcgctggctcgcgatggagcggggggcagggtggatggatggctggggaacactgctgttccacggccgccgaaaatggcagtccgtaatcctcggcccaggtacatcctcggccctgtgacaataggagggagagagagaaaataaaaaaattgactcaccggagtacgcgcgacacggcagcggaggcgttagagacggaggcgagtggtggcggcgagagaatgaggtgagcgggggcagcgtgacgaggcggtaggggtgcgctatgaacgagggtggagtatcgttgttgttggtaccggcattggtggaggggtgcgggggcagataagatgggagagagtgtagcggcgcggacgggtgcgtctgaaggtagaagacgacgttccgagacgaagggtatatataaaggcgggagagaatggtgaccgtcggattagtgtgatctaacgatcattgtttgtaactgtacgacgtatgaacctgccataaataatatgcttattttgtcatgacgtatagagttacgctcgacatcagcccaccgaagtaactttttgtgaagaatgtgggacctagaaatattcaaatgctagattgggcttggaaaaaaagctaggcccaagtctgattctcttccaggaccgcatctttcacaatcaccaagcctaggtccccatcgacatgcatcatttggtttgctcgtctacacaatagattggagcgcgaaactttgaagtatatataggtcatacttgcaccattctttggtacacaacttcatcataaggccaaaaccatctgttgcttgacttactccctattgaccgatgatgctctcccacctcttggtctgcctcttgtatcacctcttccttcatgtggttagaacaatgtcctacctgactcctctattggtttacaacaccgcaagacgatagaacccttctaacctagtataaggcctctacgtacgaaccaaaaggtttgttcaaattaagaaacatttattggttcaattgctcgagtatttttgcgctcacattcacgattgccatgcaagctcaacttaaatttgcgttgtagatacaaacattgggagaaaggcactttttcgaaatggtgcaacctaatgtgcattgctaaatttgcaatggtgtacatatatcattatatttaatgagcccatgataaataatgcttctttggtttatcaatgtttgactctacataatggacgtggatgtggcacgccgtcaaatattgatgattagagtctagatgtagtattcctactctgtcgtgttgtgtatcataacacacttgaagtataggaattgatatatgtgtgttttaaattgcaaggtttcttatattccatccattcctaaatagtatacaaacttctagcatttgaatcttatttcaaaatataagattttatagcacagttcactgtactatttatctcatcaatcacctcctattcaaattttattcccattttatcccctacctaccctctcgcctccactcatctcatatttattgaggacactaaagtattttcctcttaacacagggatggaccaaaaatggaccaaggtctaggccatcccatcaaagctttggcccaatccatactatttatctcatcaaccacctccatttaaaattcattcccattttatcccttacctaccctctcagctccactaattacatatttattgagggcactaaagtcttttcctctcaacgcaggggtggaccaagaaatgggccaaggtgtgggtcgtctcattaaagctttggcccaattcacttactatttatctcatcaatcacttcctattcaaatttattcctattttatcccctacctactctctcacctccactcatcacatatttatcgagggcacaaaagtcttttcctctcaacacaggggtggatcaagaaataggccaaggtcggtgccatcccattaaagctttagcccaattcattgtactatttacctcatcaatcatctccatttaaaatttattcccatgttatcccctacctaccttcccacctccacccatcacatatttattgagggcactaaagtcttttcctctcaacacaggggtggaccagaaatgggccaaggtatgggcagtcccattaaagctttggcccaattcacttactatttatctcatcaatcacctcctattcaaatttattcctattttgtctcctacctaccctctcacctccaccatcacatatttattgagggcactaaagtcttttcctctcaacaagaggggacccgtaaatggaccaaagcccgggccaccccattaaagttttggcccaacaaagtattatatggtggaatttgaaagtgttctatggacctttcatcctgggcctcgggctgtggcatatgtgacacatgatgtatgtttgcccctatcttaatattaacctctgcttaataacctagaaatctttttattttgaaacggagcagcatgctctatctctctagcaacttacactaatctcaatgcaaagcacaatcccaaattattgataaatctctaaccggaggccgaaggctttctcttccagataggaattatgtttttcagtactgtgtgaaattgggattcggatgcttcgaagagaacgtagtactggcctagctcgacatgattgatgggcatgatgattggttagggtcattcaaggctttcatcgacaaatcatgcatgacacatcaatccatcttgtctggattgttcattaagggctggtttggtttgaggcctaaattaagcttaccaatatttatcaatttcaatagtgtttagtatctatttggtttgaagccaaattttgacatgcctaagaaaataggccatttcaatagtgaatttagactattttggcttcaatccaaacacaactttaccttaccaaaattattcatgccaaaacttgctaaaatttggcaccaacaaaatttggtaaggcctatttaggtcacaaaacaaaccaaccctaatattcccacaccttgtttagttccaaaataattcttcaaactttcaacttttccattacatcaaaattttcctatacacataaactttcaacttttctgtcacatcattctaattttaaccaacttctaattttaatatgaactaaacatagccttcatcgacaaatatttgctgctcctactgcaattggagacgagacaccgtgccttctcgaccaatgtgcttgaagttggagtcaaaagttcactttttaggccgagtttagttacaaattttttcttcaaacttccaacttttccatcacattaaaactttcctacacacacaaactttcaactttttccgtcacatcgttccaattttaaccaaacttctaattttagcgtgaacggatgagagcccgtagtttcccactcgatcggaagttcaatctcgctgcgtgtctccaaagtttgttggaacgtttaaatcggatttcctctatccgaaagattacaacttctgacagggaaaatctacagctttttttcgaattaactgaaaatccccaccttgaaagttcgttttgctcatgtgaagtaacaagcgcatagcagtaaaatacgccaaacaaaaatctaaaaatagatgatggccgagttagtgatctctaaatatttcaagaatccccaaacaaaagcttcgaaaactcaaaaaagaacaaataaaattggagcaaacagaactctctctcagtctcactgaactactgaagaacgagtaatactgcatgatctgaaaagccggcatactgacaaagttcaacctatctaattattatttattcatcattgatcagtacacattttaccaattaaaccatgaactaaaattaagcacgtgtaagagttcatttccattaattcctgtaaagcacagcattacaaacacacaatcacctcaagaacacactcacaccaaaagtccattttattctccactgctactgaaggcaaattcatactatagctatacatcgtcgtcctctgatccatccatcggccgctgagaatttctcgatcatttgccgaagagcgacttgaaccaccacgtccccttggtgtcggtgggcgcggcgtcgctctccggcggcgggtcgtcctgcggcgtcttgcgcagcttctcgacgtcgtacccttcctccttggccttctccagcagccgcccgtacacctcgtcgtccatgctcgtctgccggcacaggatccacaggtccttgcgccgcggctcgccgacgagcgcgtactggtagtcgtcgtcgacgtagagcacccagtagtcgccgacgacggggatgacggggaggaaggggggcaggtagaacttgaccttgagcttggcctcgtcgctggccgggtcggccttgtaggcggtgcccttgatgtagtcgcgcttcccgctgctggtccacgtctcgttcagcacgtccaccgtcgcgccgtcgggccgcagcgcgtacgtcgcccgcgtgtcccggccgtcccggggctggaagaagttgggcagcgacgcgatctcgtaccaccggcccatgtacctcgccacgtccagcccccgcaccaccgtcatctcgctcccgctcttcttctccaccgccgccgccgccatcgtcgtcgtggtgattgtgttgctgtgacgatcgatctagctgccaactactgatgttatctgtttgatatgaattgccaacttgagctgagttgagctaattgcaaggatgagtgtggctatataggagagggttttggcctcttgggggggttgggtttggagaagaactgaagaagctagagaggttagtatagaggataagattactacgtggagggctctggagcgcttaaaaacgagcgctttggtttggttgcttgctccttggggccggccttgtgctatacgtggagacttgcacgtgaagctaacttgcatggacgtactccgtacatctcttttactgtgtgcttttggcggttttctggccgttttcgtcggtaacttgggactggggttcaacctgaaaatctgaacggcgagtatcactgcaggattcagagaagacagtgatctggtttcacacattcccactaggcgctttccctgctacgagtacgagtacaaaccaccggaatgctcgagagcagtccagaacgacccctatggtgatggactgatgtgtgctcggcagatagctttggccgagtctggccttatttagttctaaactttttctttaaattttaattttttttatcacatcaaaacttttctac

SEQ ID NO: 7787 - DNA, 20439 bp, Oryza sativa
tttttatcacatcgtttttaatttcaatcaaacttttaattttagtgtgaactaaacacaccctcggtgtgataagcatgttttccttgctccccaaggttaaaactctttctagcacaaaagaggtagtagaagggtacagtctacggcatggtagattgccagtgtgaagcaccgatcgtaatcgaggcttggagctttgtccgtgtcgctgtccaccaaggtaagaaggtaagggtcttattgcttgcgctatcacttataccagtttgttgccaaaatttaaattttgaaacttttgatttagatgccttttcaacataaattccttcaatattggtttttaaattattaagaacacatatttaaaagttttattcatatttttttattactagttaataagccgttatggcttatataaagtggtaagcaaccaatgaggacctaaatcctattgcatcggatatccggaaacatgaacgtccttttcgttgattttatagcttgcttacgtgtttccatggggttccaatccttggatggtttcatggcttggttacgtgtttccatggggtagttgttgacgaaaaaaatcgaacacatcggcctgagagatctgcttagctccagtgcaggtccaaatcttgatgaagtgcgggcgtgccagtcagtttgatcctgcaactgacaagatatgcaaatagtagatcaaaacagccgatcggctgacaagccgatggagtagttctagccgataatagccgatgttgataccagccgatagcgatagggtttaagcaatcggctatatgtccaaagtagataatgatataaaggcaatcagctgatgatgatgtaataaaataacaacataaaccaatcggcaaataatgatatgataaataagcatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgttcagataactcaccgactgaaaccccgatgaaaccctgattggcaatcaagaagcaggctagagattatggttctaagcacgacttagtagatcaaacttaactgatgcagcactaagtatgaaaagaaacataatatctagacaatcaagccgttgactgatttttcagggtggtagatgcctaagctaatctaatctagcaacacaatttagccaataccggcagaaaccctaaaatgagaagcagccgatagagctaaattgatatgctaagactagattaacagagacatatgataaataggtaggcaaatataccatccaaatcagagcaatccaagaggtcgaatgtactgatgcagccttgaacgacgccgacgtagacgatacaattgcctggggccgacgaaacattggacttaccccttagccagagatcaaacaccgatgcagccccgcgtcaggtgccaagtcccgccggacgataaaataaagtagaaaaggtaaaaggtggcgatgcgccgaattgtattgattgtagcgatagattacatagaccctgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctcttcgaactcagtctcttctggataagctttctttggtagattagtttccttaaccgaatatagcaagaatccgacaactgacgacttgacaactctcatcggctaatctcaggacttcgaagccgatgctgactctaaaccaatgactactccgggcttaccaaatttcactgttaacagtagtagatacgaaagaatccagaaagtcatcagagtaagcaacacctccgttttagattttagaaccgcaatccccttcatttcccacaatcatgtttgtgtacatgacacatgaattgcacaacaattaattcaacaatttagaatcgcaattcctacacctctctttcaacagtttagcaccacaattgaatgttcagtcattgatactttcttcgggcaacagtgaatgccttctttcctgcacccttctttgaccccactaggagcttaggatgaccttcaaaacattgagcctcgcaatcttggacagtggcctgcatgggcacattagcaatgcagtcataaccaacatttagcaatctactatatgcaagaaaagcttttaatgatttgaacctcgatgaaagttgtgttaacaaggtacattttgtggtatagtcaatcaagcatatgcaaatatttagataagtttggaatcgaacaccctatgaccaaatgaaaatactaattttgaagcattttttatatgataggaaatggtattaagcatagtgcactagctttcttttacctgcactgcccgatgatcacatgatctcgttccctcacacgaaagcatggggaaattaatgttcgcattgatattagggtgtctcttctcatacctatcgatggaaatggaaatcatttttacaacatcatattatgtgactacgtacccaagtgaaaaaaataataattaaaaacaatgtagacttgcttgcctctaatacttcttgacaaagtgaagatagttcctacttcctacaatgatgatagtcctgttcattttagcattgtgtcgtgttctagcttgcaataatgcaactactaattgttaaggtaccggtgaatgggcatttcttatcaatgtaggttcttagaacaagcaccaaattaaggacatgtaaaacttaattaagttcaatataaatttctactccaatactcactctatcctaaaatataacaacttttagctatgattctagacgaacactagttcagattcataactagaatttttcatattataggacgaaggcagtacattatataggtaaaacacatcaagaaaattactagcaaaacaaggaaaatagacaaaataattactataacaacaacacaaaaatgaatgaaatcaaatgagcttttagctagatttgtcaacgatgaaaataatagtcacaatttacaaatgttgaatgcaaaaataaaatcttcaaagttaatatctatgtttagaagaacaacgagagcatacatttagatgaaactttgagaaagaaacacgagcacaaatagtcctgagaacaaactagaaagctatgttgcacacaattattgggagtctaggaggcaacaccacatcaatggcgtgacaactaaacaaaagtttatataaaaaaaataacaagcagtgaagaaggatagcgcaacttcaaatgagaggccacaccaatggacagttaagaggcattaattcaaactcaaaatgaatactccatccattccattatacaaggcataactgttttttttttcaaaagttctataatatagggcggcagatgcagcagcaccactccgttagtctcgtccacgcacatgcatgcattgaaggcagttgcatcggcatctctttgaatcccgtaattctcatccgcgcatgcatgcagtaaacactattcgttagtttgctttggttgttttaaagacccctaattctgcggtaattataggagcttccttggtttttgcatccaaaaaagttacgccttgtatagtcaaatggagagagtactagaacttcagatatagggtattagatatcctaggaagaactatagcatattttagttcatcaaagaaaaaaaactctcaagtgagcatcccctgcaacactaagtcactagccacttgatatagatcacacttacaacccacaaaataacaacatcaaatttgttgaagtcacataccctatatgatgtctaagaggaccacaattgaaaaggtatcaagccaaaataacttataaaatacaagaagcgaagtactccctccttccacaaaaagttacacttattactttatcaccaatactaaggagaaattaaatcatcttgcatatatgtaacaaagatcaaggagtatatgcacacatgcaaccaatcagtattaagatgactcctcaagtttagttcaaacatttaatttatctcgccatttaagttttggatgcatagagactgcaaatacgaacaacttatttggaaaaactaaaatatgaaatatgtctaaatcttacatgtagagagagtactaaagaaattgaagaggctatcaagctcttgtggatagaaggagtattgaagaaaccgaagattttataaaaaatgcattgttttccggtttgaaaagtacacataagatatataataaaaaacaaaggggacctcaatagaaataatcgaggagttcttgttattatggtatagtacttctaacatggcatataaacccatacattcaaggcaaaattatagtagacttttaggctttagcaaaaacaaggaaaataatcccagtgcccttatccaggacgtttgtatttccagttctccacgctccaaatgaaaaaggaacaatttgtcttttgcgtgtatggttcccactttcccaggtccactacaaaaccggggcaagtccgcgtctcacgaccaatggaaacgcccattaatggcaagcttagccccccgcgctaatcgcctcctcctactaattccttgcgtctcgcttcggccaccgcccaccaccacctcctctcgcctctcgcccccgcatcgccgcttcctccctcccccacctcacgagaccgttttttttcttttttttttgtgttaccgccatggccgccgcgttgacccgctcgtcgtccgtccgttccgccatccgacggctcggatcctcccgcgccttctccgcatccgccgcggcggccccgcgccgcgacgcgaggggggcggcggccgcggcggtggcggtggctgccgggtcggggctggggatctggctgctgccgccgtcgccgcggccgctggcggactccgggcaggcggggaatgaggtggcggcgttcggcgacgtcgcggaggaggaggagcgggaggagaagcgcaggttcctgttcggaggtgagggcatttgatttttgttttttttattgttcatgcgtgttgttttgggttgtaatgcgggcgatttttggcgcgtttatggcgggggagagcgactgggtttcattcccattgttttcgtcgatactaattttgcgtgaaaagcgaatttgtccagtagtattttgctactcggttattcgcctctgaaaaattttaaatccgctatttcccaaacggcacgatgattttcgtcgcaatgtttcctcaaatgtagactcgtatcgcagaagggtgttcttcaactacgagaaaaggattcgaacgcgcagccctcttaaaaaggtagcgaccaatgtgccatattcagagcaattttgtgtatacacaacatgacatgataattcttcttggtttgtgtagtaataattgtgtggtgtttttactgcaagatctttgaatatttcgcgtccatccggaacccagagggtgaagtttacatgttacccgccgatttgatgagggcggttgtccccgtttttcctccatctgaatcgaaaattgtcagggaagggagtctcaggggagagcgcaaccctggcgagctacactgtgccccgtctgaatttttcatgctgtttgacacgaacggagatgggctcatctcctttgccgagtaagtagcgactcactgatttgtgtccttaggcgtggtatctaatttcagaaccagacagaattgtttgcacccggcacaattattgtcatgtagtgatttacagaaaatgcaccaggttctattggcaagtagaacagtctgtttgctagccatattgggtttgaatcctcccttaaacacattgtgtggaccatacattaagttgccataagcataacgtcattgcaactaataatcaccaatgcttagatatgaacattttggttaatgagtgccactggtatggtatgacattaactttatatgctgctctattgttttattgaatgaaggcagaagtaacttgatgaatttgctgaaactgcttgccatgacaggtacatcttttttgtgacattgcttagcattcctgaatcaagtttcaacatagctttcaagatgtttgaccttgaccacagtgggtaagctatcctccagctcctcgacctggttgtaaacttataaccaaatactgtgctcttcagatctatatgcatctattccttaattgtacaagcaccttaaccattttcattaaaaaatgtatttcacttacaaattttagtttgaagtgtacttcattaatttatactaactgatgtttctttaattatgatggctgcatgtatattctatgatagcatccctacattctcttctcttgaatggacttgatcataccgtgtatagagcttacagattaccagtatgctactatgctccattgccaaacccccattcatgatagaaggaccttacagtcttacacacgagacctaaggaatagtccacccatacactaactatatatgtgcagcatcattctggtataatcagttttcccctatagcctatgccaaacctcaactctaggagtcctgcaaacaaattaatgtcattggtcactggcgaatgtatatcaaattctcagttaattactatcaacattgcatgcttgcaaggttgccgggagctaaataagaaagatttgacagccctaatctattcacttatgcatttttcatctaatttctgaactttattatttgctgaagcctttaaaggtactataagtatactatccccttttccctaggatttacacaaggataaattgaatatattgttgtttacatgtgacaattcatgtgcagttaaatttgtggtccagaaaagacctgcttttatgagcatgttcaatcatctcacttgttagttgatggtaaagaagggtatggacaatttggcaattttttttaatgctatttctttactctaatctggcatttgaatttcgcagggaaatagacaaagaagagtttaagaaagtaatggcactgatgcggtcctatcataggcaaggagctgcccatagggatggtttacgttttggtcttaaggttggtcagtcagtggaaaatggtggactggttgagtacttcttcggcaaggatggcaatgaacagttacgctatgataagttctccaattttttgaagcaattgcatgatgaggtgatttttttaaaaaaaattcatcctttgttccaataacataattatggttccgaactatcttattctgaatgcaacacatgagagacttgaactgaaagctaaatattttttttgtactttcatcctttgtttcattaacatcattatggttccgaatgatcttattgtggatgcagcatttcagagacttgaactaaaagctacttcctttcccaaaataagggattttgggtggatgtgacacattgtctgtctagattcatagcacttcgatgtgtcatatgcacccaaaatcccttatattttgggacggagggagtaaataatttttccagactatctaatcacataaggaagtaaaggagggtaggaaataacacctcgacaacccacatgtcacatccctaatataattatacaagcacaacatttgctgaatttccttgtttttatattttgtgatgtgttgccactgaagaacaacactatgcaaaggtcaaagtccaatgcctgtacattcattgatttgttttgtcctagtgtaattggagaactgtcattgtgttcttgctctaaagcagcatttcagaatccatcgaaaaccaaaagtgggatcaacaaagaaacataaagttgagattataaaccccagaactactataccacacccaatgtgttgtacattttatagaatgccccagtacaacataggggtaaaaaatttacttgctgtgtatttgtgtagcgggtatacgcgtgattaatctgttattgcctctggtccggtttgtcatcattgtatatacttgatatctcataatttttcattcaattatctgcagattgttcgcttggaattcagtcactatgatgtcaaatcatccaagacaatatctgtgaaggactttgcattatccatggttgcttctgcagatatgaatcacataaacaagctacttgacagagttgatgattttgatgattatcctgatctcaaggatttgcgcattacctttgaggtttgaaagtttgctatccagatattccaattgtagtacttgggtttaatgtctctctttatcatcataattattacctgaacttcaggagttcaaggcttttgctgatctgcggcgaaaattagaaccatttgcaatggcaatcttcagctatggcaaagtaaacggtttgctgaccaagcaggatctaaaacgtgcagcaactcatgtaagattcttcataattccgtttatttccttttgacataagatgtagtctgaatcagctaatgttaatgtaagtcttaagctattttggactatcactggcttgtttcatatttccagccctgtgctaactgaacagctaggtcctaggtcttgggagtaggaccttcccaagacacccacataattggctgcattttctgattgactttacaacattttttataggtttgtgaagtggacttgactgataaagtggtggacgtcattttccttgtgttcgatgcaaaccgggatgggagccttagcgcagatgagttcttgagggcattgcaaagacgagaaagtgatattcgccagccagcttcttcaggtttaatgggagtatttacctgtttgttgaactgtacaaagtgttctcttcagcagactgtgatctagtaagcctcttgataacccccaaagtcgtcctctgttgcccttggttacgacactccttttgatttcatatgctatacttgctaaatataaaatttcagcagcataattcagcttgcataaggttcgagtttgtgatgtttctttgccatgcgcaggtgctggggagcgaaaacgaccacccactggagttctgcaaacacgattttgctgtaaatagtcttgcttatcaaagttaccgaaacatgtagcagctgcaaataacatgtttcgcactaagcccaaggcttcgctgacagaactctactccactaatgtaaaatgaacctatgacatggaacctcgttaactgtctacgccttgattcagttactatatccttacatgtctacgtttggatatcaatcttgttggtaatgactaaatatgcaaaaatgaatcggtgataattgtgatctctatttggtagagaagctttcggtatgggctacacgacttgcaacaatatacatgatgttgagattaaggggcctaggttgttactaccacattttgtgcctaccgagtagtgactagtgagtactaaaggtctattgggaaaatataaagtgtggacatatgttgatatatttggtttttgcctttttgcaagacgttcctcccaagtaattgtccctttaccaacgaggggacctcgatatcccctcgagggatgaaaatagcttcccctttaccaagggggggcaacgagcatgctgaaaaacactttactatctatttttgaacataccgaaaattaaaaattaatgatgatatcgtcgaggaaaaacatattacacacatgttacacgcagataaataatcgacagcatcgactgatcatcagtaggggagcctgacgttgagccgcctgagccagatggagtggagcaccatgtggatcatgtcgaaccggcgcgccgggcggtggagcacgaagtggcgctgcgcctgcagcacccgggcgcgcagcacccggtacctccgctccgacacccgccgcaggatggccctcagctccggtatcctcgccgccggcacggccaccgacatcttgccccagtccagcacgtcgccgaacggcggcgggtagccctccgagatgatcaccggcacgcacccggcgaacacggactccaccaccctcgggctggccacctcgaagccgctcgggcacaggcagaaccgcgcggcggccatctgcgcgtggtagtcctcgccggcggggaggtactcgtggacgcgcatgtccccgtcgccgtcgccgtcggcggcggcgccgcccttgttcccgatcagccagtgccgtaggagcgattcgcggatgtggccgtgcctgccgccggcgaagaaggcgagcgtggtgcggttctccggcggtagccccgcggtcgggcgccggaggacgccgtcggcgaggtttacctccggcagcgtcgcgtccttccgcggcctgaacccctccgacgtgttggcgttgcacagcacccggatcgcgttgccgtacagctgccggtgcgcgctggtcaccatcggcgcctgcgcatcaccggccaacttagtttcagtgatatgatcgagacacaaattaattaattcttgcaggaacaaacttagagtgcttaaatgttgtctaaataatcataatttttttaaaaaaatattaaaaatatagattaatgtgaatatatcactttacaaacctacaagttcaaaaattcgaattcgttttctataagttctaacaaaaataaccgtttgaattcgatttctataagttctaacaaaaataacaaatataactgagaatatatgttaacatgttcaatttaatttgttgtttttattataacttgtagaatcgaaattaactttgtatatttgcagtgtgatatatctcatattatctatcttattatttttttatatttttataattatttaggtggtaatgtaagaatcaaaggatatcgagggatgaattaaaaatccatctccaagtggtccatacgtacgtacccagtcgtggcaggagacgatgacgtggtcggcgccgcgggagcggttccagtaggggtagcgctcggcgacgacgcggacgtagtcggcgacgaggccacgcagcggcgcgaggtcgccggtggcgttgaggcggtagacgtagtggacgaggttgcagacgctgatggggaggaggaaggcgtgggcgtcgtcggggcgccgcgcggcgaagcggctccgcgggtcgtccatctcgtacatgaactgcccctcgatggagtagatgtcggtgcccggcccgatgtgcgccaccggcggctccccttccctgtacgtccagatcttgaacctcctctccatctccacgtagctcctaatcgcaaatgcacatcggtttttgcaacaacggtagaggagtggatcgatggatcgacggtgtacgtacgtacctgtggaatgcacgcgcgttgcggtagatggcgccgcgcggcacgtagtcgtcgtcgcccgccgcggcgacgaccgtggaggctgagccgcggcggcggatgctctcgtcggacggcggcgtcgcgcgagccgcccggcggatggccgcccgggaccgagctaagccggcctcgatcttgcctcgcgtcacctgctatacgcaccaagccaccgatcaatgcagcgtgattttgcagtgaacattttccattcgcgtgtcacgtggcgacgtgcgcgagtaaattaccttcttgttgattggtcgagcatggacactcgtcggcggcgccttctggggttcgtccgggacgtgccgtagtgagtgctcgctgccgcggccgtcttggatgccggtgccggaggaaggagcgggcggcagcgcgacgccggcggctacgacggcgaggagtgctaaggcagtgagcggcacggcgacgcggccgctctgctccatggcaatgtttgcaatggctaagttagctgctgctccactcgtttgaattggcacgcgcatgtggccacgtttgaacggtaggccgcgatatatatatatatatacgtgttgcgtgtgcttgagttgactgatcccgtgatccgcactgtcagctcagttcgttacaatcgccggtgcctcctgagtttacaaaccttcgaaaatgtgcagcgacaacggcaacctatcgtgatctgcagctgtgccgcagccattgtgcatttgtgccggactggactggactgtacatttctgctttggtcatgttcagaatcttaggacgtgacggcctgatgggcagcgaaaacctgcttaccgtcactgctcctaacacagttgccccgcctccatgcgttctacgagctgggaacatatactgtgcacatttcgtgcatacgaattagcaaatgtcacagtaaaaaattagacacatacttttaataatgttatgcatacatgtgaaattttatcttcaaatttattatattttaaccataacaaaaaagacaattctgacagatttttactcttaaaaccgtcaaaattttcattttttttatgattaaaatataatgaatttaaatatcctccctctgttttttaatagataacgccgttgactttttctcacatgtttgaccattcatcttataatttatgtaattataatttattttgttatgagttgttttattactcatagtactttaagtgtgatttatatcttatacatttgcataatttttttaataagatgaatggttaaacatgtgagaaaaagtcaatggcgtcatctattaaaaaacggaggtagtaacactttacatatatgtgcagtactattaggagtagatgtctgtttttttttagatttgctagttgatatgtacggaaatcttgtatacataggatatgttcacctacgagttggaggtaatccatacattgtgccccatcgttcattccgtcgccattgttcccgtatccaaatgttggtctttcccctgtcaacggtctaagtgcttctgaatagcataatagtacgttgtccaatttattccttcagttccaccctgcatgctattagtctaataaacctgcagtaaaacagagcaaatgagagacagagagccaatgcggaagaaagaagaaacccaagcacaatgacatcacaaactgccacagaaaatgcggcactgtacaccacactacacataagcatcccacaatggcgaggaagcgcaatatttacaattttgttccttcccgtcacgccttggagggtacacggagtgaaggaaatacaagtaattttttcagtacttgaaaacgaaaagatcccgataaacggagcaggaaggacctagtaaatgctgttgagaatagtcccacattgaaagtttagggggagtggcaccaacttaaaaggggaggggtccctcacctcatgagctagcttttggggtgtagaaaggctttctcccggttgggccaacgtctcccggttttaggccaacaaatgctaccatagactttacttattaatctggcttcaatccaggcccttgcaaagctatctacatgaagccatccagatgattatttacaggtgatcatgtagtgtccagctactcgggtcgaacgcttatcaggttggggagcaccgtcgcctgcagcttcttcacctcacttgtcgtgaccctgcaggaatcaagcgacagcgagcgcaggttctgcagatccttcaggtggcggaggccggcattggatacacgagtgttggagacgttcagcgagactaaagcagttaagcctgcaaaccgggcaatcatgtcatattgtcatgtgataacagcacagatagacaacaatagagtgggcacatagggacgtcatatttgacacggaggaataataccagaaatcagctccagggttttgtctgtcaggttaacgttctgagaaagattgagttgcttcagagctttgagatccttgatattcttcactccagcatcagtaattaacccaccgcagacttcaagagattcaagattcttaaaaactgaaatagcatagatcatgttagctgatgtgccacgtgaacatataggattcagcagatgataatcaatctgatatttctgataatgctgctaaaatcatatgccactatgcttataagacacttatctatagatatgtctacttgacagggttcagagggagcaaaatacatttagtaccaagtgtattgcctagtaccaatttaccatggtacagatcagaccgataaatattggacgaaaaaaattgcaagctcattttgttgtagctaacattaataaatccattttgtattgacattgatgtagcattgtataatgtagttgactcttcgaggtacacaggtacaaccaagtaatcaacatagatactttctagatgattctaagctagccgaagaccaaattcagagagtcgtctcaataaaatggacgcaattatgcaatttagtataataattctaaaattgaaatagtttcagagtatgcccttacatctgaagcagcttgtgccatagtccgttatcctagcaccaaaaaggtccagatgagtcaacccagtgagacctgcattacctcccaaggatcaaaactaatataaagtgtcattgaaattaggatttgcaactactcgctgcatgttaatagatcaagttacatatgatcttgcaaaattacaccaaaacccccacgagatgcaaggtatcaaacataaataaaaaacaaggcatggaaaaattcagcaaatgccacacaaattcataatcagtgagatccaaaacaaagttgcgaagaaaaaaaaactgcagctagcagttagcgccaaccaatactgatcattattatattagtgcaattcgtacaaaagaagtatcatgcattaccaaagttgtagcatataatacatacttgtaagtgctgctaagccaacatcagtaatctgccgattgtcaagattaactgacttcagtgaattcagtgcagatatcttcttcataccggtatcagtaactaacgtaaacgagagattgatgctttccaaattccgaaggcctgtaaaagtttaatagctttccaatcaaatgcttcaaatgcccgtgcaacgacaaccaaatacagataataacaaaaataactgcagaggatttgtgatgtagcaggttgtgccagttaagcattataatcggattgagaaaactgtacaaaaatcgttgcacaacttgacaagttttctaagatgatcagacataacaaggatacgatgagagcatgtattaatcatttcacttttctgaacattcactggttgcaaacatattattcagtaactgttcacatgctagatactacaaatctacaatacatgcagtaaagagattaagaaaataaaatgataaaaacaatcacaagatgcacataaaactgtagcattaacacatttatgttttgccacttgccgaaaacacttcataaaagtaatcttgtacattattcatgccaaagatgcagaataagtcctattatccagtgttttacaacatgaatgacattgcatggcacttaactgctaaaaagggttagagctagaaatattattgttcataagtgaaaacagaccagatagatgctggagtccactgcttccaacttcggtgtcagatagctccaaacttttcaaaagcataaggcctacacataacataaggcatatatagtcacagtaaatagatcacaaatgcaccaacgagacaatgataataattaataatcagcaaaccaagtaatgctcttaaacaactgaatgtacaatacacagaaaagcagttataacaggtacaggctgacataaatactatagacacaaggaacaaagtgcggctgacaactgtatcgtactattgaaaatcacaagtaacaagaaaattaaactctaagctattggcttcaacatgttttgggagcaaaattgaaaaggtaagtttttttttttttttgaaaggtgaaaaggtaagagtgagcagataattctaacaaattatgtaagagtattgaaaaatgaaaatgattaaaaactagctcacctctcagatgtaataagccttcatctccaaccttgcatgagtccaagtttagagattccaaattgatcaactctagaagcagcaaatgttaccagttagctacccaataatagttgtgtgactttaaagtgatatttcagtttctatgtacacaacacaatgtaccacaaaataccatgctctatcttctttttctctccagtctatgataacattcttgagaaatatatataacatatcaatcagtataatgcctcttttattccaataatttggcattgaaagctcaaaccacaatcaatttgccaatttcaaaattgcatggttaatattacgaacttctaccagaaatgtcactgtttcatgataaatatcaccaagttcatttctccatccaaatatatttttaaaatccttacaggaaatattcactagtgcctactggctaacataatgaagccagatatattgcttaaacaacagagaaaaaattgactgcaccacttatatttcctgcataaacatccatattcttaaatgtaaataaagttctaacaagaacttagtcttacctttcagatgtgctaaacaatcatctgtgatattattgaaccccaagtttaaaaccttcaattttttaagacctgcaaagcagaactgttgtaatgaatagaagaacagatatgcagggcataaacttttcgagctggtgtcaaccaggtggaaacataatattaggtaattctgtcaacaattattttcactagagttcacgtcatcagttattacaactgccagtgtataacaatgacaaaaggttccatggataattatatcttgaacatacaaagctcacaaaacatccttccagcttttatgcaaacatcgttcaatgcccccatatttactactcacctgaatttacttaaaacatgtatgttggcattattccagtttgtcagcagttggcattacaattaccttgaaagttttcacagccttcaccgtatatgccacaccgactcaaattcaacaccaccagagaagccaatcctacaaaaggaaatgacacacaaggttgtgtttttatggtgttctctagatgcaatcaggtgctttgaaagaggtgaacactgccaccaattgtagtatcccaatacactattaagaaaagttgcaagacctgatatagcttccaaacaggcagcagtcactggacagccctcaaaattcaactgtgttagcttggacaagcctagagaaaacaaatgacaaatagaaaacatgagaagctttagataaggtcagaggtaaacaattaaatggagatcatgagtacacccataaaacgcaaaacagaaggatgactctttcgtcttttggttgttcaaccattaaaaatgaaagatcaatgtcctaatcaagaatgattaaaattatgggcctgtttacctctaagataagaaacacccagatcagtgattctacaacaagccaattgcaattctttcaaatttgtgagatctgcgcaaaagaaaggtgcttgtcagcctggaaaggatgagataaagagtgatatatattccttatagtttaaaataacaatagctcaatttctataaaaagtggagcttaaaaagcaccttatacagttatactatgtcaagcaggaatatcaaaggaaataaatatgggatcccaataaatatatgtgctgttgttacctgataagtatttgatatctgaatctgcaatgttgttacaatatctcatattgagtgactccagattcctgaggcctgtaaaaggataaatgcagccaatataccaaactatcaatttctaggcagttgaagttgcaaccctgacaggattatgacattcaggtagggaggggaggggtgaaagccaaaaggactacaaaaattcaatttagaattctacatacccacagtagtaagcatataaaatgtgatgtttaggagctgaggtaccttttaagtgaacaaggccaccatgaatctttaggcatcgttcgagatcaagatttaccaaattaactaaattagcaaatgcttccattgcttcagcagtaataccatcgctgctcttgaaactgagagatgtcaggtttgaaagacctggatatttaaaaggcatgaatatctagttcaacaggatagttaacatgacaaacagccaaaacattcaagaactatacaaggaagaaactaatctatctaataagcgatcaagtgggttaagtttctcaaataaggagtttaattatatactaacaatctgttccaaaaccatctctgttgtaatcatataatcttaaggcactgctaaaagatttaagctcatgcttaaagctctccaagatgacccaaattagtcctataagagcatgtctcagtaagtagcatgttactgacctgacaagattcctaggccatgctctgagatcatatcacagtaattacatgccaagctttgcatgtttggacaatctctaagaagatataacccactatcagttatttcagagcaagaaatgtcaactgataacaatgaatgcctttgagaagccactacttccatccaagcatcattcactccaggatactcccccaaatcaatgtcctgattgtcaaacgtatgcagtatttgttatcccacggagaaaaactcagccttatatagacaattatcagatgaccttcccaatacaaaagctaattatcaattacgcatgctgagaaaattcgacttccaaataaaggaagtgcaattaagagcctgctcttaaataaatatatagtttgatgaaactggttccatttgttactttcttgctaaagtataccagctcttcttttcttttttttggtgaggaataccagctcattgttattgtaacatcattcttttcttgaagtcttgtaagtactcatatgttacaagaccaaattatgtgtcatgcctgtaagcatgaacaatcttacctgtagtgcacaatcccgaaaagtttcaagcaatgtctccgtgagacggttcgacgctaccaattcattaaaaatctgctggctgagatccctcggcaatacagaaaaactagaatacttgttaatatcctgcaagtaccaggacgttaaacaaaaggcaagtgaaaatggcagcatccattggtgaaatcaaacacattagacaccaaagtacctcgcaggctttggccacacaaagctccattagagatgggcaacgaccagggccctttccctggcccttgcgggagacatcggaattgctgcgtggcagtgtaagcagcagccatttcaagctgctggtctttgagaacctggaagatgtctggaaagagtcatcctcgtgcactaattggcttctcttccttgagcagacagcacccattataagtgtggaagtattgaacaaaacaaatcacttcgtctatgaactccaaagaatctctatgttcagacacaattttgaccatgaatgcaacttgtaaccatctgtggcctagtcaaaatcctgggaaatcatcgaataacttccattccattctgccacatgaagataccatagtgttactgctggtggtttttttacaattagatgaatgctcttagataaagatcaactttatttaaactattttaatcatgcatcgtactatgtgttccccattcccaatgacaaaaaaaaatgtcatactaaaatagaaacacatcgaaaccatacaggcgtccggtttttgcgcgatcctatcaacagaacaaaatacacttaaggatcatcggttccattcagaacacgaacaccagaaccctcgctaagtaaagccacaaaaaataaaatccttaaaatccaaccgaattaacagaaaaacctcactcaatcgaaacgcaactggacccgagcgccgatcagaacggcgtcgtacaacctcaccgcaaggccaaattactcccccagaaagctagcggataaagttaaccccccgaaaaaatctccaaaatcgagtgaagaagcaacagtgcccaaactaatcccgcatcacccgcacacgcaacagaaaagaaaatcccaaaacagctgcgcacggaattctcacccacaccaccccacaccggagctcgccaccgagc

SEQ ID NO: 7788 - DNA, 735 bp, Oryza sativa
cataatacaaattgcgtctaatttaatactaattatattattttagaatagaaaaggtagcattttataataaataaggattttgttcatgtaggtacatggaaaaaatcctttatattcaggtagtgatcattatcaacttatcgttgtcgctagctcgctccaggcgtttcgatcttctgaattgacgagagagtacgtaataatatagctcacctgttgggaggaaagaggggaaatgccatatcaatttcatttgaattatgttcggattttgccggaatcaagtcaaaggcagcctaatctcagtctgacgcaactttgggggagtattttaggtggctgcaccatcggaaaatttcaggtcaggacagcaacgagttctccagagagttgctgacgtgcttgctccctctaggagtcaacgacccaagcgtgcatatatgctacaagtagtataatacacagtagtagtaccgcacaaattttgacaatttaatcatttacaaaaaaaactatttttacaaatgaactgctgccaaaacttattttaaatctgacccttttgctcaacgctaactcgtgtggcgctgaatttagacacctcagcgtcaaatagcatggcgctgaatgtacgttgacacactgacttactctctcatccaccgtggcacggcattcagcgccagctgacgtgacgtgacgctgaggtgtctaagtttgatggactactgt

SEQ ID NO: 7789 - DNA, 462 bp, Oryza sativa
tcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaattccatagtgtccaaatgatatgagaattccaaagtctaaagttataaaaccacctaatgttgcctaattaatcagcgaagcatctacctaaattcataccagtggaaccaggaatagagtacccactagttgggg

SEQ ID NO: 7790 - DNA, 539 bp, Oryza sativa
cttcaccatgtttgacaaagtattgaccaatattccagattgattgatcaaagcatggtgcacggcatagtcaacctgatcctgaaagttgttaaactgtaactgcgccatattgccatcctgattagagccaacaccttgatttccttgagaaccatctgcagcacccttatcactcggttgagccacatcacttggagcttgtttcacttctctatccttagaagaaccggtcccagggacatcagcaactacctttacttcatatttctgcacaactgtccccttgcgggtttgcatgaatgagttcaagaataggttacgtgcttgttgcatcattgcttcaagatccttctgctgatcaggtgtcaacttgtccggagtgatattcacgatgttgccttcttcgacttcagatagacctagcttctggatcttagctttaacagagcccggttcaccagccgaagacaacgatgctggcggcttctcatccatgaggaaaactctgacttctaatcagtcccaccgggcatgcc

SEQ ID NO: 7791 - DNA, 687 bp, Oryza sativa
ctacaggtttgaacggcgagaccgtggagcgccgcgtccgtcaagtcgtgatcaagcggccctagcaccgggaacaacttccctggccctctttgcaagaaagggggcagccgaacgcgaagccgtaatcaacgtgagtgtactcagcgacccttttgccttttttcttccggggatcgcactgtgacttcatgtagtgcaggctctccctctgactgatatcatcgggccgctcgtggaccatcaggcggcggcgtcgctgaaggaggacattgccaaggaggcatccgatgttgctgccgctgctgtcacaacgagtggcagcaacgttccgagaagagggaggatgttctcctccgtgctcagaaatcgtcgaaagatgcccaccccctcggtaagctctcatggtccttcatcgcgtagttggaaaaccttgacctcacatcatgctcgttttactctaggcctcggatgcgtctccgccacctccgcgacggcagcggcttgtgacgcttggtgagaagtaagtggatgaattcgaggttttgttatttcgttgaactctcgcatcctgtcttgatggcagcctttcatagggcggcgcgggtgaaagcagcgcaagatggatctggaggaactctagcgcgtctccggccgtggcctcgacagatgtcgtggtcgtgccca

SEQ ID NO: 7792 - DNA, 148 bp, Oryza sativa
agcttcaacgttacgaccaatctgagttgaaaagcatctgtggatcatgcgttgataagttgctcctgcgttctttaatccaaaaggcatggtgatgtagcagtaggccccgaagggcgtgatgaatgaagtcttcaagtagttggac

SEQ ID NO: 7793 - DNA, 592 bp, Oryza sativa
ccaaaagagttcattactgacaacggcaagcagtttgactctgataagttcagagaaatgtgcgaagggcttaacctaaaaatcaaggttcgcgtcggtcgcgcacccgcagtcaaatggggcggccgaacgtgcaaatggcaagatcctagaagcactaaagaaaagactcgaggaggcagcgaaaggcaaaatggccagaagaattgctatcggttctctgggccctccgacgaccccacaagaccaaccaagtttagcccgtttatgcttctttatggcgatgaggcaatgaccccagcagagctaggggctaacttaccaagggttatgttctctgggggcgaagaggggcgcgaagtatcgctcgaactcttggaaggggtaagggtcgaagcgctcgagcacatgcacaagtacgtcacaagcacttcggcaacttacaacaaaaaaagtttgacccacggagctgatgcctggtcatcttgtcctaagaaagaagacgaacccagtagcggttggtaagcttgaatcaaaatgggaacgaccgtaccttatcaaacacaagtccaggacgggatcttttcgccta

SEQ ID NO: 7794 - DNA, 353 bp, Oryza sativa
aatttgttcgacatggcaggaggctgcacccaaaatgaagtggtctgaacagaagatcgagttttcaaatgaagaccaccccaaggctgctgttatcccaggacgatatccgatcgtggtcgaacccactattcggaatatcaaggaagcgtgagtccttattgatggcagcagctccatcaatcttctcttcaccaacaccttggacgcaatggggattccacgaagtgagttgacacccaccgatcaaccctttcacggattctgtcacgtcctgataaattcatcccgaaataaaaatcattttctaaaaggaataatggaattaattaaaaattcgaaaagaaattggc

SEQ ID NO: 7795 - DNA, 707 bp, Oryza sativa
  unsure (1)..(707): unsure at all n locations
atcaagaacccatttttgtgctttgttgctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaatttatgttgatttaaattactgcattatcgctttatttaaattcccgcgttatcactgttttatctagccatgcctatttacctttgttatgaccttattattgttattgttattatttccttgttcaccctagaataaacaaaaccccaactagtggacactctactcacggtaccactagtatgattttagatagatgcttcgctggttaaataggcaacattaggtggttttacaactctagactttggaatattcatatcacctggacactatggaatggttggattattgtggaattggattcacacctccccctctattcaaaatcctcaaaatggttttaggctgggctcggngtgcatggttttgatagtagcgcctcggccatataaggaccggtcttcgggcctctgttgcaaagcactaccgtacttccacatgtctagtgggtaaggcttagtttgtggctcagtctggttataaacaaaagtacacggatggagatg

SEQ ID NO: 7796 - DNA, 530 bp, Oryza sativa
gagtggctaaagacccactacccctacatacttgagaaaaattacccacctatgccatcaaccgaacagatagctgagggcattatagactttagccattcaaacccaacaatccatgccttcaataatccatacaaacaaacaactcacagcttattctatgcctgcttattataatccagcttatagtaatctggcttaataatctatattataataatcataagttgaaacaaatagggtctaaaatgataatccaaaattagcgattaccgaactcgaaattaccagaaagaattaggtcagggtgcgtcaggcggcacgaccgcatgagagagagaggtgaggcgtcatttactcctctcgttcgttgcgattggcgattggctaggtccacagtaggaggcgattcaagattacgaaccagcgcaactgtgcgaaccggcaaaaggcgtaatcgaagctataacgacaagaaaaataacaaattttcggaactatttagattaccaatttacttattaagttgt

SEQ ID NO: 7797 - DNA, 244 bp, Oryza sativa
ccacccatgccgatataaagcatcccctagtcgtcctctttccgttaccccaagtcccaaccgagccgtcgcccgtagagttgccgccgcgttgtttaacccgccgccgtcgccggcgatcctccggtcgcgtcgcgctgccgctagtatcgtcgccgctgccgtccgtcgtcacagtcgggttcgtgaggaggaaaggaatcccgtccgccccttcgcagccgccgaaaaccgccggagcgtc

SEQ ID NO: 7798 - DNA, 398 bp, Oryza sativa
caacgagaatcgttcccgacatcgtgtctcttcacggcgtcgcgagaccgaagagcgaggaggccgctcaaacggagatcgacaccatgataatcgtcacacccgccacgaccgcgacgatcacgaacagcggacgccggaagatactgttcgaggacgccgacatgacggcgatgataatggggatcggcgccaggacaacaatgctggacaacgacaggactctcaagaacccgaacgtcatcctcggaatcagacaccggagccgagtgaccaatcgtcatcgtcattcatctttttcttcctcgtcatcgaatagacatccacgaggacatacgatcgctgataaccccccgcccccagtgccgggtgtagagctttcaaccgttccctacgtg

SEQ ID NO: 7799 - DNA, 13674 bp, Oryza sativa
ctgagcttatataggagtagtattaccaagcttactgttggttttgtgatgcgcctcttttatagtggttttgctgatatctgaaagttacaactctccttgctaggtgttgtccgctcggcttgggcgtaaaccagaggatataatcaagttggatgcaaatgaaaatccatatggtccacctccggaggtgagtttcttgtaatacccaaacaagagtagcatctacctctaatacttgaaacaatacattcttaagaaacagtagtttgaccatgtcaacatgaaccatgtgttataagaaattaagaatgaatcctaataattcaaattcaaaatagtactagcatattataaatcaattcaaagtggcatattagaaacactagctatctttgaacttccaacagaaaatttaacagatctttgtatgagcatacgaagggctggattctcattgtacataatttataccttctctccatctaatgcatatctcttttatacaggtagctaaagcattaggaaatttgaagtttccctatgtgtaccctgatcctgaaagccgtcagttgcgtgctgctcttgctgaagattctggtcttgaatctgagtacatacttgctggatgtggtgcagatgaattaattgatttaataatgaggttagcatgtagcttgttttatacctgctttttgcacgagatttttgtatccgagttgagtaatagcctagttttttttttaataaaaaagtaatagcctagtttgaatggtgaaaatgcagatgtgtactcgaaccaggtgacaaaattgttgattgccctccaacttttacgatgtatgagtttgatgcgtcagtcaatggtgcacttgtgatcaagggtaggtagttctttcttgagctgtacttctatttactgagccttctgtaatgtcttaattcggtgttcacttcttatactgtttgacatgccagttaccaccctctaatgtaatcctgatttgaactcttatgtagtaccgagacttcctgatttttctctagacgttgcacagattgtcaaagtggttgaacaggaaaagccaaaatccatatttctgacatctccgaacaacccagatggcaggtacacctttctcatgcgagaatggggctgttttggttgtatgttgtccagattctgtatcttagtatttcgctgaattacctcaattctatttttcagcataatcaatgatgaggatcttttaaagatccttgatcttccaatacttgtagtgctggatgaagcatatattgagttttcgagtcttcaaacaaggatgtcatgggttaagaagcatgataatttgattgttcttcggacatttagcaaacgagcaggtctgtagtttctgtttgcctttttcttctctggtctgcaccgggctatatcctctgaaaaatccaaaaacctcacccgttttctcatagtactgcatggaaatcacttatctgtactagaatttctatttttcgttagataattttttttagtgctgctgcattattatgtgatgtccagacattgctaagggagcatttaataaaataatcaattcttcttatgttgccaactcattttactgaatcatgctaatttttagtagttactagcatggctttgtctagctgattcattgaaggcatttttgccacacaattatgaaccaaaaatgacacctcattacaaattattgataatgcaggtttagctggacttcgtgtgggttacggagcatttcctctaagcataatcgagtatttatggagggctaagcagccctataatgtttctgtagcagcagaagtttcagcctgtgctgccttgcagaacccgacttatttagaggtatgtgctctggaaacatatcataaataaatttttgtttagtaatttggcatctgctaactttgtgcttctgttgaacatttcattactgaaggaagtgaaaaatctgctactacaagagagggacaggctgtacgatcttctcaaagaaataccattcctaaagccatttcccagccactctaactttattctctgcgaggtcacatcaggcaaagatgcaaagaaaataaaggtttgcactgcttgttagtactccctccatttctttttgtttgaagttggttagtttgaaattgaactaaccaacatcatacgtttacagaggtagtatatgttactcccttcgtcccagaatagaaacatttttagcatagtgtcaagtcaaccattcttaattttgactattaatagcaaaaaaataaaaaaaagatcaataatgtaaaattgatgttgctagatttatcattgatcaaactatcataatatgtaactctttttatatttaaaacattttattttgatagatattattggttaaagtagcatctcgaagactgtgtcgagatccaaaaatgcttatattttgggatggagtacaagtttctgctgtattttgttgtggtacaatgtaataactgcttctgttgttatattcttaggtggtaaaatgtcaacctggaagtcaaaatatagttattgtgtctaagaccattactattcatactttgaaaggaaatgctgatgatttagtttcaacaatataatgcctgcagcatcattcacataattttgttcaaaaacaattttcaggaagaccttgcgaagatgggagtaatgatccgccactatgacaagaaggaactaaagggatatattcgtatttcagtgggcaagccagagcataccgatgcactaatgaaaggcctgaaagcacttcaactgtgatcatcccatctgtttgacggaagcactgaagcacttgcccgtggtagtgcactagatgcagtctctcaatggaggttgcatcaatctaacacaaataaggtgcatcctctagggtcgattatgtctcaataatacactcttctgttttgaccagtggcgttttgtccagcatttttgtgttggtcgacttgggtttcttctcaaggtgattgttcgaagcaagaatttgtactgccgtgccctgattggaataaatatgagcgtaaaagtatggcaagtctactggctagattgtttatgcaccttctttttaaaaaataaaaataaaaatcttcagacattgcaaatcccatgtgacatcacaaatatggagagtcatgttcaattataatttttcagtgaggaattgaagcacatactccctccttccgaaaatgtttgacgctgttgactttactaaaaatgtttgaccgttcgtcttattcaaaaaaaaaaataagtaattattaattctttttctatcatttgatttattgttaaatatacttttatgtatatatatatttttacacatttcacacaaatttacatttcacaaaagtttttgaataagacgaacaatcaagcatgtttaaaaaagtcaacagtgtcaaacatttaggggaggagggagtattaagctattgccattatggttcgcaacccggtaggcctgaaaagggagcatcaccgcatctgattatccttttcgtgtcctagcgaatagcgaggctaaacgccatcaaaaggcacaagttctttccatgtgagcagaagaaaaaagttcgatgcggcacaacatttgcccatacaacaccacaagcaaagcaaagaacctcccggagggcttcatctaaagcttcttccatcgccttcgtgcaggcgcaccaggagttccgcagttaacaattaatatcgaatcccttatataacaattaatatgtttaatttgaaaaaaataagggcaatatcataaagttagaaaaataggagtaaaatctctgctaaagttgaaaacatggataaaacataaccaccacaaatatttcatagctatattgcatttttgaaacacaaaaactaaatgcaattacaatacaaatattcttaaatatgagggtccacatgactaaaaccattgtcgaggacatatctctttaatacgggtgagggtcctgtaccataatatcacaactggtatatgggtcccaccctcctattgtccacacgtcagtgtctataatggtagtgccattatagtagaggatgtgaatccccttactacataacggtttcaatgggtcaaaacaaccataatgacgaaactgttcacacattgtgattccttgtgcattagctccgcacactaggttactttgatgagagctatgttcgcacaatgtgatttcaaatgtccttttgtgttggtgcctgttttatcttatgcctaatcctatttcgcccttttgtatgagattgagaggtttgctgctttcatctagttgttttcacctattggtgtcatattgtgtttcctttgtaaaaatgggtaacccccatatcatgactcttccgtatgtggctttcaaaaaaaaaagccgggccgtgaggccttctctctaaaaatacaatgtgatttcaagctacattctaagccaaagcttttatacctttaatatgatacgtatatatacctttaataatctcggatacaaaataaatgtacaaggccacacatcatgtattgtaaatacgataagtagaataccacagctatcaaaatttataggttgcaggttagtacaaatgacgcattccccgacattccatacttgctcgtcatgcagcttcgtcgaaaagcctccatggaaatctcctccaaatcttcgcaaaagctttgccactgtgcctccatggaactgcaaacctgcgatagtagtacaacaaatgcataatttatccacttcaagccctgggaaaatcccatattacaaaagggtccctcccttcttttcgatgcccataccgcggcttcccctcctcctcaagatcgccgccgcgaccgccgccggcgcgttggcgctcattgtcgcggcggggcttccgccggaatgaccccgtcgccttccttccggcggaaaatacgcgacgccgtcgccgccttcgtggcgagcaacaaggacggcgtcttcaaggggaagggcaaaggcgaggaccccgccaaggccccggcgccgtccgtgctgatcacggggttccgcgcccacggaaagagctcgctggtgaacacggcgtgccgcgcgctcgcggccgagaaaggcccgctgctgctgcgcgcggaggcgtcgccgccgggcggcgggtccgacggcacgcggaaccgccggagggtgaagccggcggtggccggggatagcggtgacgcggggacggacgaagccgtggtggagcttctggacgcgcctccgctccccgaggcgacgagggccacgagagctgacatcgatgcggcgatcagcggggggaacccggagtgcgtggtgctggcgctgcgctgcgacgcgcccgcgaaggagcggaacgccgccgtgaagcgcctgccggagatctccgccgccgtgagggcgaaaggttagtctgctcagcttcaagaaggttctagaactcggcaacttagcaacagtagcattgaagcattattctcaatatctcatttactatgttagtagtattccttttgcgcgtttgcgaaaaaaaaaaactatgttagtagtataatttttcgtagatatctcggatgcttagacaatgctatattgctatgtccttagaagaaagaagatgatgcgatttcgcatcgtccaatgtaggatagttgtgaattgtgattgcttaaagaaatagatgcaattttctaccatgtaggtaaaaggcaagggatggtaatttctgcaggtttggtttgtggacacttgatggttaactagattgtcagttttgaatagttttctgatagagatttgctatcatttggactggtcccctggtgtcatgttgtcatctttatgttcaggtgtgaccgtcagcagttaccaaatattgactgtttgatggagctttttgtgttattaatacacgagcacagatgctgtgctgatatatgctaatatgcatatttttcgaaaccatgaagtagtgcagtatattttgtctataatgtcctgaaagataaccctttctgatccaaacttgtgtagttgtgttagaatcagggtattgcaaatgttcatggagattcctttgtttctctctttcttccacatctatgaagaccttgctattaccatattttactcagcatatgttagcaaagatgaatatatttgttgacgagcacttgttaacaggtctgaatttgattgttgtattgactttcaagaaggccatgagatcagcaagacaagctgaagagctcatacgagaggtttcattcagggcgagaacagattgtgtctacttcatcgagaactacacctggaacaataatggtcccaaccttcgccatcctcctgtcatcaagaacgactttgagacacatttcacggttctgacaatcattcgacagtgccttgagttcatcaaattaaataggagtcaatccaagcgggaggaaaatggtgagaagggtaattcaggagatgttaaaggtatactggaaaaagtcttaacagcaaatgctaaatcttcaggagaacttagcgttaaacctgcactggaaaaagtcttaacggcaaatgctaaatcttcaggagaactgagcgttaaacctgcagatgtcaaacctgttctgactgttcaatgattattactgaaatgtcagagcaattcgtgcgcacactcaatcatcacacatttgcataggtatgacttactgcagtactttgtatgcgttgtatgaggtagtttgctacactgcacaaagtgtatgttcattcattcatccgttctgtatgatgttatataggtctttttatttgggtgtgtggcacataactgatttgttggtattgccatcatctagagacataattaaagaaagtgcctagaaaaaagcaaagtggaaagcctcttgctatatatcatcgctgtttaacatcactccatacaactctaactcaccaatattatatgatagcattacataggataactttatacattatagtcaattccactataatcaagtcccaagatatacttataaatatatagagatttggacgaaacatgaataaaccatcaatgttggctcttccttattctcttcaaccgatcagttcagccttcagaaatccaggcaccaacagtagtaatctgaacccgagagtgccaggagttcttctgggctcatcctctctagctccctctgcctccaggctgggtagttgttctgcgtctcacctgaaccggaggcgtagtctctcgggtgggcttgcgatctcatcctaatgtacagcctcatcgctgccacgcaatcttcatagggatcctgaatgccagtgtggatatcatacctgcaatagggattcaaggatagtatcttcaacattaataatgcaaagtctaagagtctatagagattgtacagctgacttagcaagtttgcatacccaagatatgcctgtgtaaggtactttagggagttgctcagcttgctagttttcatcagtggtgggtactttgcagtatccctgaaaaaaatgcagagataaattgtgtcagcaagggagaaactggcaaggtctaatttgcagcaaattaatttgccttgtgctgctgacctgatcatgaatgccgggtactccagtcccaggcgctcaagttcatgctccaggccatggccaacgaggatccttgccctcccagagctccttggccgtatcttccatagtggctcaccgttgcacaggatgtcctggatcctcctctgcacaagcttcagtggcattgcgtccctcaagtactccggccttatcccagtcatttcatacctgaacagaaacatcataaatcatcccctcattcatcatctcataaaactatccatcgatctatgcctttaatttctactgctagtttctatagcagtatgtttattgctcggttttccattatgtcttttctgcttttctggtccgatagatctacacatgcgaacaatgacagctaaaaattgtactactagctaacactcagaaacatcatcagtaataaaataatggatcatctcctatatattttacctgtagtttgtgacggtcgtggtgggtttcacataggtctggaagatgacgttctcgtcctctccgatcaggcacaccctcgcgcagatgtcgagcgagccatcgcttcctcctccgaccatcttacacgccatggccaccgcacggcctccgtagctacccctgggcatctgcatgcaaacgcaagaaaaccacgggcaaattcagcaacaagccttgcaaactagcatgcgcagtgtaactgaggtgagaggggattacataccggggcggcgcgggtgaactggcaggtggaggcgcggtggtatctgacggcggcggcgctgtcgaagaggttgaggcagatgctgcagccgcgggccgcgaacacgcgcgcgcactccaccttgggcaacggccctgcatgcgcacggcgtacgcgagaaaccgtcagataccacgcgaaaactccacaaaaactagctcgttgcatcaaccgagcaaattaaaaacggctacttgtgtactcaccgatgaggtgctcgcggagggactcgagggagcggcagtgcttggcgcagacgccgcagcggggctcgtgggcggagtggaacgacaccttcatgtgctccaccaggtgctccatccggttgtactgcctgtagcacgccgcgcatttgttcctgcgagatcatcattttcattcatcgattgagttcgatcgcgtctttagaatatcgcgagcgaggcactatgcacgcatttatgaaattctgattctttgcaccggcaataggggataagaaagttgaaaaggtactcattcattcgtgcgcagaatatgtagtatcatatatacatgcatattcaaggtattgaatggaactagctaggacaagaaaaaaaagggtcctatatatctagctcgatgtttagagcacgagaagaacgtactaccatgcatgattaaagcttgattaattagctagttcatcacacaccagtcttgcatgctcagctcatcttgcaatactactgtagtaatggcattcagtttgtgaccatcttacctcagggtctccgaggactccctcctgctgtccatcatatatagcactactacaactcctgctgatcgagaattaaggtttctgtctctagttgctcttactgatcggtcgaccaaggtttctgatcgatcagttgtctccctgaaacctcgaggggcgctagttagctaggttggtgaggacggtaggcaacatggagaggctatttatagaggcaacaaacgttgaaaggatggaagaaccttcacgaggaagaaggaatgacccctgggaatcaccgtcttgtcgtcactgctgcatgcattctgaggaataagcctgcagtttatcgtaatctagctagtttagtatgggatatatgcttcctagtatctaaggttcctttcttgatctgtctttaccttttcttagggacacacagacacctaggctccttaagtagttgtcactcctaaaacacttttaacacgttgtttggagactttagttaatgacatgtgttaaacagtgcagcatcaaaacccagccttcaaaccttcacgttggaaatgctacatttgggacaacatgctagctagctagtgcaagtgtgtgtaactcatcaaggtaaagcacatatatttacattctgttgatcgaaaatcgggggcaaaggtagaaaagatctgaaaaattaaccgcgcagaattttatctccccatcggtcgaaagcgggaaattctggctgtcgctacaacgtactcgttcacattctttcagcaacgatatgtaaattcagacgccgattttttcttttccccggcctctagtcatcaagtgtcgactcgatcggtcaagcgactcatgaaaaatatataatctaggttcgctgttctgaatcttgtaaagaccaagttgcgcgacggcgagatcagttttcgatcgatccgccaaggtgatcacatcaggctgcagtgtatacgtcgagtccgcttgcaagcaacgctggtcacctcatctgtcgatcggctatacgtcgatgagaagaggagggagctggcccgtacgtgtgcaactgtgcatggaggaggagaggaaagcacagtggcattgaccgtgtgcatcaggtgcagctgagaggagtggcctttaatttgccctaactaatggagtagcagcaaccagcagctagctagattgttctgtgctgtgctgctgtggtttgatcgatggatggatctgtataggttgggttggtcatggggagggaaaaggtagatattcccggtcaaaaagatggccgtggaaaggggccggggtggggggaatgagatgagcgggcgacggcgacggatctccgggaaagagagataggcgacgaggagcgagggctccatctctcgtttctctccgtcgcggattggtggcgcgcggggcgaggtgggccgaggagctaagccccggcccgcccggaattccaccgatcgagagagagagagagagagaagccgcgctagtcaaaggaagctcccgtgacggagacggggccggattccctgtcccccgcacgggccgtcgcgcgcctgtgcatggtcggtcggtcgatcgctcgcccgcgcgacgtcgaccgcgacccgcgcgctgcggtatcggaaaaatctcctgctgcatgcttttcactgcaatcataggagggaggaaggtagatagcccagcccggccagcgcctattcttgcagctgattgatcaccatgcagcacagttcttctcttcttacgtatatactacagccgtcctaaaatattactacctataatagcgccgtgtttagatacaaagtttttcttcaaactttcaactttttcatcacatcaaaacttttctacacacacaaatttctaacttttccgtcacatagttccaatttcaactaaacttccaatttcggcgtgaactaaacactccctaggtaataaattaaataacaaattaatctggactcactttgtccaaattctcgtattagaatttattacatgagaacattttcggagggggaaagtatctctcatgtcgttgatgcttctcttccggctagctccacaaggtggtgggttagacgacctgggttcgaagcctctccccttctaatgatttgatattagttccttccctaatattcacgtcttttgttgatgcttctcttgtttgtcccacggatgcttaatttaccgagttatttgcagctccatttcgataagtttggacttaattaacttgtgatatattctatcatggcaaaaggaacacattttagattctccatgtcctaaatcctctaccccgccatccacaatctggcatgtggctcgcatctgtgcatcagacggctatacttacaatgacatataaattttatgagtttttttattaaaaaatatacatctaaaacagttttaaaagaagacaccacgttcattgtaaaggttagaaatttcaacattaaccagagaaaaaaagtttacgtaagaatacaattttgaaataactgaaaattaaaataaaaaaagaaatatcgaaataatattcaatatgtataacacaatacaagattagttgcaatttaatataaaaaatataacttagacattacaaaaatataaataatagtccaagtaggaatacaacttagaaataactaaaatccagaataaaaaagaatattaaaagaagagaccatatggaacacatcacaagattaattaaaattcgaaacaacaaataaaataaattctaaaattagaaaaatagatattttaaataggaatacaatttagaaataaacaaaatttgaaataaaaaaagaaatattgaaaaacaatccatgtagaacccaacacaagattaactaaagtttaaaacaaatacaaatataaaattagaaaatagaaaaataaaaataagagttcaagtagcaaaacaatttaaaaataacaaaaaaataaaaataaaacaagaaatattgaaacatagtctattttagaacacaacgatggcaaataacgacaaagagatgaataacatacaagatgtaaagtggtagaatggtggcggttgatgggaaatctaaaaactataaaacaacacctcaatgatgattgggtatgattttaagaatcacaatgatggttaagaggagggatagtggcaggccatgaagagtagtgtcatgtgtcatggtggttgacaggacctctagaaagttgaaaaagggacccaacgataattacattcaatttttaaaattccaacaataaacaagatgagagcgggcatggttataaaggagtatagttatgaaatttgtcgggtactctaagaacttaaaaatgagaacctgatgagactgatttttaaaggtcccaaataaaatgaatagaagttatgtcagattgagcaagaaaataaagctggcaaaagagtaagggggtgaccgatggtgtgacttttaaaaactataaaattgaatacccgatgatgataatattcgtttttaaaaatcttaagacaacaagatgactatttagcaaattttaaagaaaatcatatgtaaaattttatataattttgaatgggtgcgccatgcaattgcgtggaccacccaactagttttttagttacaatgttatatttgtcaggaacatatcttgtatgcacaaacttcatgtgcacaccccatgcataccatgtcacaaaaaaaatctagaaaaaaaatcgtgcatatactttcaatagtgttacacctatgtgtaaaatcttaatatcaaattcattatattttagcggtataaaaaaatctgaaagtattttttgttgctatttatgtagaatgaattcgaaggcgggactttacacgtaaatgtaatattactgaagtacatgtataatttttaatacattttttagtgataattgttagttggtatgcacgatgtatacacgtgaaagtttgtgtgcataagatacaccatatatgtcactatataaattttatccgcaagctctagcattcactaaaggagatgtacattaatcccatgtggatgaggtataataactgcgtaaatattccttccgttttagatcacttttcactatagaatttaaagtttttatcaaatacttgccatcctcacattacaaagtgagacgatctttcatctcctcaattcatcgatagctttgggaaacgattaatggaacatagttaataaggtaacgatgtataggtgcggaatttgctagaaaaataagaataatctgaaatggagggattagaatatatagttttgacttaaagttaaaaaaaagagagataccataatgctacaattttgacttttacaggcgctagccagtgcatttttctaaaactcccctttttaattgaatacatttttt

SEQ ID NO: 7800 - DNA, 947 bp, Oryza sativa
caatgcactcgtgaacactgaaacacacacacacacacacacacacacacacacacacacacacacacacacacacacatatatatatatatatataggacactcatatggagcaccaaacaaatttactatatatatatatatatatatatatatatatatatatatatatatatatatatgtatatgtatacatatatatatgaaggttacaaagtagagagaaaaaaaagagacaaatagatatgcatatacatatgtatcacatttccttgtgttttttctttacagaaaggtgtattctgtttttttttattctgtatgatagccgtggtggaacaagaaaaaggtggcagggggaaagaattgccgatgctgctgttggattgagccttttcgcatctaggcaccctacgatgaaatagtggccttgtgtggcagctaaaatttctaataattgaacagaaaaaaactagcgaaaatatctttaaaaatgtttgtagcagaaaccaatgctcgcaaaattgttcttgcacttattattattattattattattattattattattattattattattattattattattattattattattattattattattattattattattattattataaaaaaagatgggattagtccatatttatcgcgaatatgaatgtggtagcttttagataagcgaagtggagtgactaccttccacctctatatcaactataacatctgtcctaaaataaacaacctagtacgaaatgtgacgtatcctaaacaatgtatcatatttagtactaggttaattagtttattttgtaatggaaggagcaaggatgagtgctaggcattttatagttcatataccactaagaaaacaataaaagagcaaacaaatatatgttaatattgcccgaaatatagtaaagtataac

SEQ ID NO: 7801 - DNA, 1899 bp, Oryza sativa
atgtctcttgcattcttggatacagattttcaaagctatccttttctttttcatcgtcatcttcttcctcctcctatcggagaatcgattttatcgagattaaaagtgaattatccggtctttcgcattatagattaatccctttttataataaaccagctggtgtagtgtacacggtttacgatcgaacacaagacctcacaattaaaactatacacccttatcactgtactattaagtgtatctttaaatgagtcatatgagattagcctagttaaatggtgatattgacccttgatgagagtgtgcgcattttttttctcttctggctataattcattggttgtatagatgttgttggtagggtcggggggagataggcgcatggagcacatgtgtgggtgacttttggtagttgcgaacgagaaaggtggtcaatgagtatctgagagcagatcgaagacggccgctttgttccttctggaggccatcatattctctgtgccttcttttgtcctcagccaaaagttttgcccgccaggatacccttgcctgtagttgtagcataatagctgaaggtgaaggatatatggattgtactaaacgcaaaacagttttaaatcacacgagccgagctttcgtggtgtttgcgatacttagaaataataagaggtggagtaatatgaacggttgatcaagagagggtaaaagttactgtaaataacagtggagtaattaacttataaaataacatattttattttgattggatcaaacaattggctgcatttatcggcattgttttgtagaaaaagaactgttagtctttcgaggcattttgactccaatatattttgtatcattcgttgagaaaatgtaaatccacccatacaatttgtctccaaataaatttttatcattttctaatatttgcatgtatttgtgaaaggacatgtagcctaatggttacaagagcctcaatagcacatgaggtcctgggttcgactccccatgggagcgaatttttcaggatttaacggcgctgtgttttcagtggtaggcgacgtacccatcgatagcgaagcgcctgtggtgacttgtcaattctccaggatttgccggcccaatcttcgaagatgctcatagtggtgagttctccaggatttgccggcccagtcttcgaagatgctcttcgaagctcatagtggtgagttctccaggatttgcaggcccagtcttcgaagatgctcatagtggtgagtgcgcgtgcgttgtgagtcttcgaagatgctcataagggtagggtttgcgtgtgtgtttataggggtgagtgcgcgtgtgttacgagggtctgcgttataatgtgtaattctaaaaaaaatatttgcatgtatttttgtgcggtatcacaaatttaaattaagttgatatgtgtgttcctatataaagtagcgaacgcggcaactaaattagcccctaatttttagcatgcgtacatgcatgcatgattaagttggaaacaatcggcgtgcggagtatccaggctgctgccacggcggtgtcggcggcctagctggtctccgggcaggttggtaccacgcgccgtgacggctcccacgtacgtcaaggtcaactcctcgtccacccccagcgtccagctggcaccgcgaccgggtgatctctcacgagtcatgagaggctgagagcggcctacctacgctctcggtggtatttgccgatcgaccggatatattggccgcctctcggattgcggagagagccagagacgtgttgaactgattaggagtaatcaaagggtggcattttttaagctacagtttataaccgagaaaaacaaacggatataagagaatctggctattccagtatataactaaa

SEQ ID NO: 7802 - DNA, 11484 bp, Oryza sativa
agctccacataaaagtattataaaataaattagaaatgtagagttttgatttagtatgctccatgactcaaatttagacccaacttcataaattaaatttagaagctgaaaccctgccaaacaggcgctgtatgttgagtgcattgtttatttttggaatgattaaaaagaatacacatcagtaaaaaacttgataattatatattgaatgcattgtttattctccaaactgtagtggttgggatttaaagaagatcctacgttaactatcaatttctaattcttatttcaaatttcaagttaattaagttaacaaaatacaaaactgacagtcaagttagacatcaatgtaattctgaatttattattggatatattttaggccatgtttagattccatcccaaaactttacatcctgtcatatcgaatgtttgaacacctataagaagtattaaatataagctaaaaaataactaattgcacagattgcgattaatttacaagacgaatcttttaagcctaattgctccatgatttgacaatgtggtgctacagatttgctaatgacagattaaggtggtgtttgaatctcctgtttcacgcaaaacgaggtgttaataacgtgtgattaattgagttttagttattacgaaattgaaaaatggattaatctgatattttagaataactttcatgtagaaagttttcgcacaaaacgcaccgtttattagtttgaaaagcgtgccactttaatccaaaatttaatccaaacttttcaggactaacgaacggggcctaattaggcttaataaattcgtctcgtggtttacggacagattttgttattagttttttattagtgcccgaacaccccatgcgacacactatataatatccgatgtgacacctaaacaccccctcaggataactaaaaaagagtcttatcaatttgaatatcatgtttcatttaacacaaatagattatcataaattttaaaattaactttaaaatttaaaattgacaaaattagttctagagcatcggaagttgtcgattttggttttatagcatcaaaagttcaaggctcattttgatagcactgaagttacctccgttatttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacacagtatgctggctccacgagctcgtcatgtaatacgtgagccctcacgagctcatccgcaaaccgctgtgttcatccgcgcttgctaggtgtgatctatccacgttctagctttgcccggacagcgccatcgtcgatcgatctcgtctaccgcgccgccatggccatgctagagcttgttcaaatcttgcgtgctcaaccaggtccatttcctccgcggccgtgccgcttccgagttcgtccgcgtgcactgccctcggtctcccctagatgcgtcatcctcaagctcatccaatccatgaacgcccgaagtgtcattgtccagctcgtcgccggcattgtcgggtccgcacggaagcaaagccctccagattattgtcggcgcccttgagctctctccgacatgctgccctcgatcaagctcatccatcggccctcaaattcgccccgaagcaccaccctcgcgctcgttgcgggctcgcctgagtgccgacccgctcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgtcaaccataggagggagagcgcaggaggaagaagatagaggtaggatggggtgagccgacggaactgctgacggaatgctaaaaatagtaacggatgtagttttcagtgctattaaagtgaaccataaacttttaatgctatagaatcaaaatcgaaaactttcgatgccatagaaccaattttgcctttaaaatttggttgtggccgtcaacgaagcacttaattagtttaaaaacatgttgaacaaagaaatgccacaaggtgtttacgaccactttctgattgatcaaattcacgttatcagcccagttcataccatcacattttaacgagaaaacaaactgactacttccgacttttttgtttccatcggttcgtcgtaatgttttcgacaactacttcgacttccagtagtaaagtcagctttcctttgtttctatcttttttgtttccataataaaatgcattaacaaattcctacaacacattaaacatgcactgcaacacaaacagaactattttggttcaacttcgacgatggcgcttatgagcagtaaaaattgaatgaaggtatgttacaacgacacttcacttctggcctacgaacaatgcagcctgaactgctttcatttcaggttgctcctaacaaatgatcagttaagcataagtgtgccacactaaaatcaatcgtatggtgtgcctaataactgttgagagacctatatgatgattcctaatgatgcatggggaattagatcctagcactgcattgttgctctagaaaaaaacattgctatcccttgctaagtgacgccattgtaggaacttctggagatatgctaaggattggactgctccgttaccattttctgccccactgcaaactcaatacacacgtcctcggcaattcttagcaccacaatggcaggggcatccatcaccaggtagcaatttttgtccatagtcataggccaattcttctcccatcaagatctggacaacagtgaaacaacaattagcaaggtacgtataacgatgtaggatgaggtggtcaaaaaattcttacatcctggtttgcaaacaaaccaatgtgcgcaagctgacagtctttgctctccaccgaaactaaacgcgtactgagatttggggaacagctgcaatgaaggggcaaaagcattggttccagaacaaatttatcccgtagtaagatgttcccaagtactccttccatcccaaaatatattaacttctaagttaatatattttgggacagacataaaatagtccagttacctatgattaataaaacgggatacgttgccatatcttgtggcatcaatcacgtatgcagtagtccctgtagtctgaactctttccctgtcaatctgagaagtgatttcaaacaagtagctgctaccactttttgcctccctgagatccaataattttcttatcagtttctgagcataataataatactccaaatgttcagactatagaacaagaacagcgtgaaaccagaatgtgtgcaagatgaaaatatagtttaggcagagattgggcatttaggcaagactgggcatcataatgaccaagaaaattcaatgaagcttacatggaatgcaccggagaaattccaatagatttctagcctaaataaaagaaataacaagagaatcatcaaacctttctacatgtcttatggccccatcatccttcatcttcaaaacctctccaatgtactcacatacaaatgtgccctgtggaataggttctgcggctctaacagcccaaccctgcagcatttgacaaaacaaaaatatcacttgtaagcaggttttatcttgacgtcaaaggtaaggtgcaacgctcaggaaaccaaaaaaacaagtggagaatatttcaccttattctcagttctgaagacttccaactttaccagcagtcctctctgcagtactttattctgacaggaggcatcacaagtgcatgatgaattgcactcatatataggatatccttcctgcaaatttaacaacacatagacatcaaattatacaataaaatgatgagaaatgaatgcctagatgatggatatctttgaaatgagctcaagcaaaaggtgtacaaatactcagtcagacattatctgcagacctgaagaacaactcaatatcaatgagcccaaatcccacgcacatcccttttgacattggcagatagctattggaattagttatgtcaccataaaagatgaacgagataatgccaccatggatgtaaaggtcaaatcacgacaaaataaagaggtttgttttttagatgaaaccgttgtatgcgataatgtcaccatggatgtggagcctgtaaattatggttaaagaaccaatctactattgtttctgcagctctccagaagtaagtttaagggtgaatagcaacagaaggcttttgatacagctatgggactcagagattgcattagtaattaaaacaggttagagtatgctatacacgaacaccatagtggataaggacatccttaataagaacatataagtggacatgatattgagctcagggagatggcaacacacaatgataggtatttatttaatcgcagtttaagctaaatttcaaaataagatggcaaacttcttgagaaaaatgtagtgtgcttgcatcataaagaaaaaaaaggttgcattaccagctagtcacagatatcaaggtatcaatgatcagatcaatggggctgcgcttgcttgtgctttggattaatccaaaggtgattttaaattttagatttcgatttaggattaacttttaagggttatttcatctctttcattgcccagctctatgttcatgactgttaagaagacaactaaaaaatctacctaaaattattcttaaaagccaagcttcaaaattcgaaatcgctttggatatcacaaccaagaacagccagcacaactccattcacaaatactggccacttttgactactttattggttcacgatacggaggacatgtcatttttttccaaagcacagcttcacattttgctcttatttaatatctcccatcctcatcccatttgtggagaaaagtggacaagagattatttattaggatagtttggtcattttggagaaaacaaatgtaagacttcccttgcgttggtcaaaacccacattcttgaacagaaattgatggtggtactagtgcacatttctgttcatatttccaatgttcctaaagccatacatgctagagtacttgtcaaaaaaacatgtgtaggtaaaaatatacgccagtaacaattattacctgcaaaataactttgctattttcatcatatgcaaatctaccacgcataggtacaccatggagatccactaggttctcatagatactatcaaagaggctcacatgatcacattcctcaggactgcaatgggcatgagaacaagcacacccaaccatagtgttctgcaggtaagcaacttattagaagactaagttgcaggagacaaaaaagttgcaatatataaaaaccaaagaaaaatagtcttggttcctttcgttcaattaatatgcaagtttctgttcatcataaaagcaaaatccagaaaatacctctgaatcaacaagagatgaatccatcaaacgctttgtgacgtagtggaaaccttgccagggcagagaattttcactttgcaaaatttctccaggtttcatatatggaaattcttttgcatctacatcaatggcacagacaactggaactttctccctgccaaagctaacatcttcacaaacaataaccatctcattcttaagattccaaccaaagtgctctgaatcaagaacatagtggtattcatccatgccccatatctcatcaccaattggaggactcatcacaaaatcaacttgggtaggctgtaaagggagcaaggaattagaactagacctggacttgcaacctttagggcaaaagaattcttcttgatgccaatcaatttggatgccaacatcactacaaagctttgcagctttcacaaatatgttatcaggcaagattccatatttagctttcaatgcagcacgaaggcttgtcttacagcaaacagaacgggcaatagacagaatatcaaggttgcttgggtggggtcttgtcttttgaatctttgaaaataaagtcaatgccacgtctgagcattggaaatccagtaacctaccaagggtggtggtctcagattccacaatgtgtgatgtatccatagatagatccaagctttgagccttaaaatgtttctcaactccagaactagtcctcttcttcaatgagccggatggtcttaaacttttcttgaaggctgaataatagtgccgaccacggttaaactgatacttttcacgtcctgaagggatatcactgactgtacctgagtttgtatgagcaacttgatggtggtggccaagatctggcaaaagatcaaacatcatcccacataatctgcaggtgaacttctgtaaaccatcatccttaccaaggttatggttatcataaaggagctcatcacttgccctttctgttcttttgatagattgacccctaggtcgtcgagggacatgatccagaaggctgaaatctcgagaatgatctgaaacaatgtgctgccataaaagatctgtgttcaaaaagttgctgttgcacgatatacaacgtaagagtgtcgaatattggagatactgagcgccatgtttttcctgcacgtgcctttcgagaactcttctgttggtaaatgagtccatgcatacagcacaagaatagcctctgaaaagccaccgcacttcttttttgtgaacctctgtccagtgtaatccaagtccttgatcatcagagaactcctgagaacatattttgcacttcagaccaggtgaaggatgtgtcccatcttcacgtaacaccatcactgatccatcttggttctcagaatgcatttgattagagctatctgtaccaaagccccaaacatgtgaaagcttttctctctcactagagatcagttttaacaaaaattctccaacatcaggattttttgacacttcagctaatatctggggcatatggtcactaccaagacccgggcgttggtgagaaagattgtttctcaagaaccaataaagaaactcacatgcctgatgtaagcacagtttttctttccttgacgtgcaacacttcaaaagattgataaagacatctttagagatgagtcgactttttccatttctggcacgtttaaggaacttcggtatgtgcctctcacagtaaagtgtgtgtcgtacggcataatcctggcattcagcaatattgtcatgagagcgaattccaatgcaaatagaagcatctaagttagagttttccatggaagttgacatggggtagcagagatcagcgttctctgacacgttaactttatcactagttgtctcaacagccatggttggtgtcactttcatgtgcacagcaacctggaaattatttgcctgctctgagcctacactacaagttgcatttgaggaagacatcttctccacgcttttctgtgactcttcccacttacggccctcagacgaacttaacaaactatctgagctcattgcatctggatttgtttggaagcggtgctttttacaaaagataaaaccatgctgggctcgatgcttgcactttctaccaagattagtcatccccccacacagtggagtttcaacagtaagtgacttatcttccctagacgaatggtcagcaaaatgcatactttgatgcacacaacagtaaatatcaccatcgtttgcccacctaccacattgccttccttttgcttctatatatgcagaacactgccgagaactcttgaatgaatccaattcatgtctgacattgtgtaaagcactatttggttctccagtgtcctggacaccagaagtactggggaaggcagcagttttattctgatctcttgactctaatggtcctacagcttcatgaatgatggagatactggggaggttacttttgtttgggtcttcacttaatgtgttgaggttagcatcatcctcttgtgaaaaatgagcttctcctctgcggacttcgagtttggaatgttttatacgagcttgttgatccatacctggatcatcataacaattgtgttgttcaaagttgccagcattgccaactggatgagatgaaaagaactgtttcatgacttcctgtttccaagttttccactcggggactaattcaggctgcattggtgcattccacaattcatgaaccttgtcccaaagaatagcttgcctaagttcctgtgtggaaagggtctttagcaaggttggccaagctttaaatagtgtgagaaacagtagcacatcaagtgtaacaagggaataatcaaatagtaaagcacgtgtagtgcagatcatttccattattccatatattatttcatcagtagcagacagacacatagttagcttcaagaaagtcaaactacataacaaggtcaaatttctacaataaactgaacaacttatctctcctatttggcactggtgatccacttgctttaacaaagagtgccacaatgtccaagagacaatgctttggaacaacttcccaagtgactacaactgggtcactagcttagtaatcaaacagaccaatatccatatgatttcaagacagtggtttgaaatcttcaagttcgatgtgcacaaaaatacactttcatcttagccaagaaagacacatacccaaattaggaatctatttcatgccatctgcatactattccgtccgctaaataaagaacagggtaaaaaaggataaccccattttgtagcaaaccaaacaaatgatcccatggaaacccaaattcagctaggatcacaaaaactataaattaacacatttcaggtgaacataagccacacaagcggactgtatgatgagacaagaaagtgagctagccggtgcaaatcatgagaaaatattatgacctactgtggtcaacatttatacagcccatgcaaggattgcaaaagattattaatgtgacactcaataattaagtcaacattatctatttttacattaaaaaaaataccacaacatttcagttcatgctgaaaaagagaatggacatggcagccactttatttgagatgtgctagcttgaacttagtctcacgactaaaaactatacatgatagaaaaggaccagatcatccaaaaacatattaactactcactccgctaaccagcagaaacaactcatacaaactaaatcaaggttcttataaaaaaatggtgaaacctagacaataacagaaatccatattacctcggtaagaatttcaacggtctcggcatcatgagcattattgcacttttggctccacaagtgaaaagaattttgcagccaatgacaacttgtgtagtctggaagaatcatctgaaattaaacagctaaggtaaactattgccaagaaacaactggaagaggctattgcagaatcatacatttatcttatttctgtaatatcgctagatggcgtaaatttgatgaagcggatgatctaatgaacataatactgcgcagaaatatttgtataacatttgacctcattctcatcaataagatatacaacctcgagccataaaaccaatttcccttttttcacaatatcatgtcaaccataaacaaaattgaaatttgccaggataattatcatccagtgtatcctttgggattgagcaacctcccaaccaactgcttataacaatgatttagcttttcatattaatgctgcaaaataattcctattaggcgttgtgtcaaaatgtacgtctcaattttctggcatagttatgtacactagtatcatggtagtaacagttcatgatatgtcctacaaatagataaaataaaaaaaggtacacaaattaactttgttctatccagaatgtgcatcagtgataaaagggataaatagcagccagaaaggatatcattcataaaacagtgagcgaccaagaaatagagcatcgtaagaagaacaaaacagatataaaacttgctacaagaaaattgaaaggaggttccatgatatatctttaaggaatagagtgcttagatttacattttgaagtttgacaagcatcttcccaagatcagtataatctctacagcaagatgcttcccgagcaaactccttccaagttgtggccatccgagcattctcaactacagcctattaaacatcagaaagactgtcaagacgaagtcatcggtgctacaggaataccaatgattcatagaagaaatagcagacctctgtatgaagctcgtcactaaaatttagcatggaaatagcaagtttctgcatgatgaatcgtcgaggaatactcagatccttcactagctttcgccatttgcgatgagttccattaaccagtggcagaggatattcctcaattggacggacaagtagcatgtctacccaagaataagttcttgtacgggggaagaaaacaatgatatagctcttcctgccatgtgttggttttgcctttagagtagataaaggacagtccactctaaagcattgaattccagtttgccattttcctctccactattttcaaacaaaagggaaaaatgatagttcagagaaggatcactgaacagttgtgagaaatcagcacgcaaaggagtagaaaaggtaggaactggtgaatggctgatataagggtccatagccaatcttctgaacagctcactgatcagaaaatccccttttttctagaaataaatgatattcaagtttttatgcttatatgcaactcatatacagttatttaaattgcagaaaactggttgttgacctcagaacagtgatataaatgaatggaatgaagtaataaatagaggaaagttgaagtatttttctttcagtaataaaaatcaaagacaacaatacatcagagaacttagtccaagtcatacataaaatgcatatatgtttatgggacagagagagatcaagctacgaaaattatgtaataccaagaaatgcctcgacttggaagacaaactacctagtaggaacgacccttgaaataagaaaattacagctagatcgaatctcaagcattggacagcctttttctctaggagcaataactacaactaaacaaccctcgagtgatatcctatctcttcaaactagcacagttatacccaggtctgctaattcagctaaaatcgtgtataaaacaaatgcttgtgtattttccagaaaattttttaagtttcagaagattacaggacttggacactcaggtgttatatttagacattaaacaattgatattgacggcaactaaaactaggactgtatccttttctaatacaaagttgagtacaaacctagcgtgtatgttactccctccgtttca

SEQ ID NO: 7803 - DNA, 21737 bp, Oryza sativa
gggctgaaaatgctactacttttttctataaacttggtcaaacttaaagcagtttgatttgaccaaagtcaaaacgtcttataacctgaaacggagggagtatgtgacatcaccaaattaacaatgacccttggatcaatcaaatcatccaatccaattattaaacatctcctaatataattgatgatattgggacaaacggtgcttgggtttggacaccataacttagctttgaactaattatgttcttaacaaggttgtcaagttgtaaagccaggtcgagtcaggtggtctttcaaccgacttgctgactagttccaataagttgaagagcagtcttttagactactgccacattccttcctacttgggttgttctactgtggttcgctgctgctgatgcccttaatctatgagcatggcaataaaacagagataacagaggagcccaggaaaaagagggagcatataaggaaaagatagaaaaataaacgcacgggagaggtacagttgttgcttgtactactactagctgctgagcacgagagcaaaatagagagggaagagaacaggaaatgaaaaaaataaattaatggatgagaggagaggaccctgagtcatcacctctcgagcttatcctctgcctagcggctggcggctggctatatatgggggaggaaacctaacagctccgccatctcccttgaacttcgtaataacggtcacagatgggtcattgttgctgccttgcttcactacatcttttgcagcaaccaaatcaagacttgggctcgtggccctcaagtcattcttcctggtaaactacttgattggccatgactgagacacaacttaataacataacagtggctcttgaaaatttttaaaaaaatagatttcacaaattgaaagtgtagcaaaaattctatgttatgcctattgctactcctgagggtccaggcaatccaatctagttctttaaaaaatctagaaactttacggcacccacacattgtgttcttattaaattcacaagaaaatctatgactagatgtagcaaaaaatttatctccacggcgtatgtaaaggtctcaacaatccaatatgttaaatattcagccagattcatatagttaaaaataagcaaatcgtacctttacccaaagtgcaacagtctgatcttctgcaccaacatttcctgtattgggatgaccacttctataatgagtattgccattacaactgttgttaagaacaagctgatccatgttgttcttaggtgagacagatgtctcattctcttcctgtggagaagatattttacgtactggatcaatgctgcaagctatttctgacagatcttgaagtgtgcactgcaattctttctggactgcatgacattctaatgtatcagttccagctttattacttaccatatcagatccaacttccttgttccctttgacttgttcttcagtaatgtccttgtcttgagaaggctgagcatctccattggactggcatggcctaagtacagtcactatattggcaggtggatgcgtctcttcccgagaatgaggtgcatcctgattactaacactctgttgattgacgtcaacagacgtgctttgaggggcatcattttcagtgcttagactcaattgaaatctaacatcattgaagtatgcatcagaaccattcatctcttttgggggctcggcatgcatcttctgaggtaaatctgacaagttagcatgagacttttcagaagaaccatccaggttctcatatatgcttgttcgagaacaattgttaacttcaacaggcttgcagctaactgtctcacttgcaggatgagcatcagaaccttgccacccatgatcatcatgtgacaaggcatgtgtcatattgtaggtaataggtgttgttttctccaaatcattctgtaattggcaatctacttgcataacaggagggtccatcagcatttctttggtatgttatgatctgccaatccactatgaaataaggcaggactagcgtgagcactgaaagaacaatctcctgctggtttgaagtccataaacactagtgacttattcaacacctagaagaaaaaaaaaaggtgttgtttatagtatgtacattgtacaacagaagtgtgggacaacaaacaaaacaaactggaatagatcaaaccagacctgtaatttaaacaaaatgtcaaagacggtgcagtaattaaaagaaatattgcattccactgcaaaattcccgaatccccttgatgccatcactccacatgtcagtgaaacaagggttggctgatggcatataagagaccaagagattttccaatggaaaataaggaatttccccttatcattaaagataatatgggtaatatgaatatgtggattgcccactgtactatatatgcatcgatacatttatttggttttgtttctcatcctaatttcttaggatccataaactattaagagtttgccctgaacaaaacttgctctaccggacagtagaaggtaaagtggatagacaccataataacaaatagcactgcaattgtttacagtacgtaataaaaaaaacatattacagtaaaggtattcaggaatcaggaatacatgcaatcaaatgataatgcactaatagttagactagtacaaagatatggcacattcctctggaaagtttaacaatgagaaccatagcaccacaatatgaacttaacagaggaaacaatgcttgggtttgaactatatggcatgaaatcccagtcccctaattttcacaaaaacagatgaagcaaaatcacatcggaaatatgaggagttggttaaacgtgtaaaatcggtgcgaatacgtgggcattgttgcagggcgggtcggcagcattaactctacccaactcatcaaaaccctaacggcttgtttcaatgtgcaggcaggttctcgcggcagaggaaaaaaatacactgggaattcaagcgcccgtacgaccctcaccacagcaaccaccgcttcctcgggcgtttggtcgatgaaactaagatccctaaacgtattagtgcgcccagcgacccaaaccccccaaaacagcgcggaacgtaaccgatcctgcgagagagagagagagagagagagagagagagggagaggaggagaagcgagagatttactcattcaccctccgcggcgaggcgcccgcgtaagcagcgggggaggcggcggcgggtgcagcagtccacggacgccgttggcgggcgcaggccgaccggagcgctcgcgcaccgagggggggtcgacggtgggtggggcccagcagcgtacggcgtcgagcggggaagtcgggcggcggcggcggcggcgagaggaggtggaggtggcggtgggcggtgggcggtggcgacggaggaagaagggtttgcggcgtggcctggctcggcctgcgacgtgaggggagggagatggggggaggaggaggtgggcagccaggcagcgtgcgcgattccccccagtaaatgggaaatgggagagagaaaaaaaatatattgggggaattagaaattttcaccgggttcaccggcccgggccgcgaatcccacgcatatgctcctgcgagcgcaccgtgtgtccccatgtggcccgctcggctgtttgggccggacgagaccagacggcggcggcgcggcccaacttaaacggtcgcgggcggcaagtatcccgtgatccggcctcgtttcacgcgcgggcgcccgtgcgtggcccagcttcccgcgggcggctccaacgggagtagaatgtgtgtgtccgctggtgcgcacgcgtagcggaagacggaagctaagcgctgttgctttggaacagagaggattccttcgtcaggtaaggaccaacctggtttttcagccaagatgtttgagctgatcccgttcgttcctgtctgctgttaatcagctaaagtacgatcaaagttgctcgagtgtgagatctttacctccttttgcatacaggagtggatggaattcagattaggtgcagttatacgtgtaactgcaagttaacgacggtatataattatagccgtatgttttatggttaatggttcagattcaacgctaccgtaaacctgtgatcagtgctcccatgctatagtatttcgctattattactccctctatttcacaatgtaagtcattttagcattttctaaattcatatcgatattaacaaatgtagacatatatatgaacgtgtgaaatgctagaatgacttacattgtgaaacggaggaagtacatcgctatggctagaacagtgtacaatctagactgtccgatttacattcaatggtacccgctactaccgctcagttgcaatcactacagatgatccagattcgaaattataacatgccaaccgagctttacccagtttaacggtcgtgaccaatagtatatgtgttttctattcgttgccgatgtacggtggatgacgagaaaacaaatgaagcgacgcggctgtcacggcatcgcgacaaccgaccgtgtcacgatcccagctgcgcatgcgaaactatcgcgcgccgatactactgctactgctgccggtacagcacggccacagatcatatactactactacatctctctcgccttacttaacactgtctgtctccagcaacatgtcaatagcttaatcacacccccattaaaattaaaaaaacgcactaatcgaagaattgaccagccaccacgaactctatcgtgactggagaaacgagacgttctcgaggtggttcaggtgaacccatccaataggaaaagataagctatagctcgccggcctgccggtgatgagcaagtcttgcctaccctgaaacgttctcctcctcctcctccctacaaaaatccacaatttgcgttgcggatgatgccttttgtttgtttgttaattgcaacatggcaaccttcgtttctgccgttccatcgctgtcttgccaaccaatcgtccactctggcctactgctgtgccccttcttctctccggctaacaaccgagaaacagcagagacaaaagcctcttctcctctttttaagaggaataacagatgtagagacagagatgagaaagaaaagggcaataacatatcgatgaaaagatcttgcaatcatggcaaaggtatttgttttaagtataagagctgtgctgcaaaatgaagcagcatgtcggtcaagggtttacaatctcggagagcacaaatctacaggaagccgatttttttttttaaaaaaaagagggggtactccaaaacgaaaaaaaatatatttcattttggcacttttttttacctaattaaaatattttttctaaattaacaaaaaaatgaaaaataaaaatcaagttttctgatgaaatagtttcgttgtttcgtgctaggggggggtccaaaattctcaatttcttgtaccgagattgcaaaccctgtagggattaagccacattatggacgtacttagaacaaattaatcactgatgggaatgatagtagtatgataccgagtgggttcgcattctttccttgtctgtctctctgcctgtggttcatccgttccctacttttcgttagacggaacaaaccaaccagcgatcgatcgatcgatcgagctcgaaatgcggtggtggatatatgttgccagcagatgcgacgtccaatttcaacgacaagcgttttcgcgagctcggcggtgacggcttcagctcaccaacccaacccagcaaaaccgcgaaaccaaattaacctgcaaccccaagagagaaaaacacacgtcgctcaaactgaataagaccgttatttttgttgacacatcggtcgatcgttcggttcgttggtgcccatcggattattatgcctgtcaatgtgttatgcatatgccatatcgtttaaacacattatgcaattctgtagtatcatttattgaaaattgttatgcgtacgataaaattgatacgattttattacaatcctatcttgcgtgcgtacaattggaccacgaaaatacgttgattgtaaaagattttatcgtgtgcatagcagtgctcgttatttatttgccagtagctttgaatttttttgttctatactttgcgcttaaacatagctttaagagaaaatgaccatgttacccttgtggcttagcggcggtcatttgcactaatatacaatcattaaggatgctgattagccacgaatggattaagaaacgcttaataatggaactactagtacattttcacggcccgccccagtcgagtgacagtcacgaggcacgcgacacgtaaataaatacggagctcttaattacgcttcgtcctcctcccctcccctcccccctctctctctctcctcgcggctgcaaatcgagaggaagaggaagacgagaggagaggagagcgcgtggcgtcgagaggaaaagccggagccattgagccgcaggcctcctcctcgcgcgcgagcgcggccggcatctccggctcggatcgagcttgaaggtacgcgttgttccatccgtggtccctccctttcccgcgccatttcttgatgggacacgctgtagattggagatccatccggggattggtttctttccctccaatttgacccgccatgtttcttcgggatttctttctttcgatgcgtttgtgcttcgctgatagtagtagcggtttgtttccaggagaaattggggggcttgagctgaaagatcttggtacaattctcccgcaaaatgcctggaattatcgtggatggagttgtcacagaggaggcacaaaacgaggtgaactcctcgcagaacaaggacaattcgtccgccccaagatcgccggtggcttcgaaaagcatgcacagcgaggcgctggagatgcatgtggagggttccggcgccggggagccatcgattgagcagctctacaacaatgtgtgcgagatggagagctcaagcgagggtggatccccctcgcgggagagcttcggctccgacggggaggaatcgaggatcgactcggagcttcgccaccttgttgctggggagatggaggccatgaaggtaattgaggaggaggaaggggaagggagtggtaatgccgctaatgcggtaaccgcagctgagaatgggactcccgtcaaggcgatgtcttcgaattcatcgaagaagtcgtcgaaaaaggctgcgaaatcacagcttgaatctgagtcttctgttggtcctaatggcaaggcatccaccgaggaaggtgaggccgaggtcagcaaacccggaagccgagttggccgtcgacggaaagctagtcctaatccacacaatgggactgaagatgctgggcttaataatccagaccttggtccatttcttcttaagcatgcgagagatttgattgcctccgataatcctcgtcgggcactgaaatatgctcttcgtgccaccaagtcattcgagaaatgtgctggtggaaaaccgagcttgaacttggtaatgagtttgcatgttgtggcagcaatctactgcaacttgggaaagtatgacgaggctgtacctgtactacagcgctcccttgagatccctgtaattgaagaaggtcaggagcatgctcttgcgaagttctctgggtgcatgcaattgggggacacctatgggatgctaggccagactgcgctatcactgcaatggtatgccgcagggcttgaaattcagaagcagacattgggggagcaggatccaagagttggagagacttgtcggtacttggctgaagctcatgtgcaggcattacaacttgatgaagcacaaagattgtgccagaaggctcttgatatccacagggagaatggtgagccagcctcattagaagaaacagctgataggaggctgatgggtcttatctgtgacacaaagggtgatcatgaagctgccttagagcatctggtgatggctagcatggccatggtggccaatggccaggaaactgaggtagcatcagtagattgcagcattggtgacatttatctctccttgggccggtatgatgaggccgtgttttcttatcagaaagctcttactgtattcaagactagcaaaggggagaatcatgcaacggtggcctctgtttttgtgcggcttgcggatctatacaacaagacagggaagctgagggagtcaaaatcatactgtgaaaatgcccttaaaatttatcagaaacctattccaggaacttcattggaagaaattgctaccggtttaactgatgtttcagccatttatgaaaccatgaatgagcatgagcaagcactcaagttactccagaaggccttaaaaatgtacaacaattctgccggtcaacagagcacaattgctggaattgaggctcagatgggcgtcttgcactatattttggggaactatggagaagcttatgactcattcaagagtgcgattgcaaagctccgcacttgtggtgagaaaaagacggccttctttggtgttgccctgaaccagatggggttggcatgtgttcaaagatactcgataaatgaagctgcagaactgtttgaggaagctagagctgttctggagcaagaatatggaccttatcatccagatactttaggagtgtacagcaatcttgctggaacttatgatgccatgggaaggtaagctccgtattgattcttgatcagttttttattttttacggttaatagactcttacatcggtagcaaagctgtgaatatggacatcttcctcatctcgcagtatatcttggacttcggcaaattaactgctagcttttcatctgacttttgttctgttagacatctaattatcaccagccatctagataatattttttttccaattaaaatttacaaaagcaaagggtccctggtacagtttatcttaatatcctcgatgatttatcacaatgtgaacatggaaatcaatatggtttgttctcaactatggcactgataactgctccatgtgaccattcacacagtatattggtgctctttatgccctggagacagtagcggtgtgtagactcttatgagtgccaattcttttatgtttgtcgttcgcaatttgcatcttccagcttggacatgattggtctctttgtgcagccttttgcagcttcaattgaattgagctgatattggttgttataaagtgggatcaatttaattgaagtaggaccatattaagacaatctttaattgcatgtagccagctgctctgtaaaagaagagttgcaaatactttatcctcttgctttatcctgcccatttgctttcaattgtccgtgtggaaacttcatgctactttgtatgtcatgtggattgtcagctttataatattctttataattatgatgcaagttttgacctaccaatacagctggcttcttgataagaactaacaccctagtttaattggctagatcagaattctgaagaggcatagcaatctttctgagatacttcttaaaaactactaatgagtatctaaagggaaaaaaaatgtatttcacatcagcttgtttgctcaatgcgaaaaggtttttgatttgtttcttagaataacatgttggtgtacctgctttcctatgttatccaggctggatgaggccattgagatcttggaacatgtagttgggatgcgcgaagagaagctgggcacagctaacccagacgtcgatgacgaaaagcggaggcttgcagagctactcaaggaggctggtcgggggagaagcaggaaggcaaaatccctggagaatctgctcgagaccaacccatatactgtcacgaagagaggtacagttgcagcatgaggcacacactgctttgcgaggagaagcttgatgcaagcatgacgctaaggtgtatcaaattgggctgtttttcttttttcagatttggtgagaggggtaattgaaaataggatttgttttgagaatctagaaatgtcaaatgttctgattaattgttgtaaagttgcaaagtatgattcgctaccacttgttccctgctcatggctcttcaccgtgcttgggaagtaaagcgctgcttccatgctatacgcagctgagcttttataactttatattgtagacagtgtgagactgaacagcttggttggttgatattgcagcagatatcatgcataataaattgtacaggcatattacggttcaattttgattgtaagatttctgtttgcaaaagctaccagctacgaaagtgtgagccatcaattggatgatttgatatgtgaagctgaagttggataagaggcttagacgcatatgagttggaaaaaacagtagcagtagtacccaaaagatctgtgcaaaaagttataccgctggaacatcatgagcagaaaaaaacttagtaaatacgaactgctgcttgatttcagcgaaaataagtttgaggagattcgctgagctaccagcatgatatgtttctaccgaaaatacaagcttctgaaacattaacaatgcagcctacccatcgtaatcattagttatcacttagtgctaatacttgatacgagaaacttgaagccgcttttgctcccgaaagagaattgtctagtgaccatacttctggaactcccactcgctgttgtctgcatagataaaatagaaaagtaaggcacggtgaacgagcagaggtaacaaccacaccaattaagtggcattttccagggcaaccaacctagagggcacacttgacgggtcttgagccaacggctgatgcagtggaagtggaatgcatggttgcaaactcctgacacaacaaagatagattgttcatcagtacatggatagttgacttcacagctcgatttaattcactgcgaaaatgcaatatccactaaaagcaacacaaaaagacgagaagaatccagttacacggaaagaaaacaaagttccataatactcccccaggagagaaacttcagtattataaatatattgaacatagcatttgactgtgcaagtcagtattgtttaattcaaaacaatacttgaacatataatccagagggcacacagaaggtgcaagtgtacatatccctaaacaacaacatgctgtaaacataagatcagtcaaagtagattaaactgtgggcagaagaagaacatattaacatgccgggtagccaaggaagatccacacacaagaatctcatacaaatatataaagcaattgtagctaaaagcctttgatgaaaatatacaccactaacttcaactagttccagatgcaagaattcacttccatcaattgacacagctaacatgaacactcacccaccctccccaacccacattccagtgattctctttgacaaatcataggaactaggaaacccagacatgaactgtattatcatatttgagtttcatgtgtgcatagttcaaggtataattataattgaacagtagatggttaatccagaagaaggtactcctagccagtagccattcaattatcctatcataactacatacttctttatgaaagataaattcaacatattctacaagggccatgtcacgtccaaagctaactgcgacatattatataattatagacttagataaaaaaccaagagacaaaccaatatagcaaaccatgcataattatagtacaaatttccaactatgaatataaccagtacatataaaagaatagaaaagataatcacattgcactcatttgatacatgtccagtcaaaactactccagatcacaagaacttgcaattatcagaatcactaataataacatggtattgcaaatcacatgatcagcaacaaatgatattatacacgatattaaaaatcatgctctggtaccaataaatgacatagaggcggcagataatgcaggatccattaaactacaactcaattcaccaatactccagagcatgaaaactagaagcattcctcaattccagaacgaaggattcaaaatagcgtatagcaaaacagatgttaggattttatgaaattcgagagaaaaacattcctagcagcatataaccagtcttgggaaagcacgatccccagattctgataaatcattatcaaatgagcaaaccaatgacaaacaacacaaggcgacgtgtactgagagcacagtaacaggttgacacatggattaatttgactcaatcgaactatgaaatcaaagtcaaaactaaattcagaataaacagggcaagaccggcttcagctaactgaaaccatgcaattcatggctgaatcagcacttacatctactgctgcatcggcacagaattagaattaacgggagattaagaagaagcaatgttaccccaagcgacggtgcactcctcgctggtggcgctcgcctggttcgcctggcactcgatgcctacacaacacacgcacgcgcacccgcgtcatcacaagccataccaacaagctaagaagaaaccctagaatctaaaggaacagcagatcggagcgggggcgagcggaaggccagcggcgcgcgtgctcacagaggtccatgatgtggttgcggcagatggcgcagttgtccacgacgatgtctgcacgagaagaagaagaagaagaaaaccgcgacggaatcgcatcagatcgcacacgagaaagccaacaagcgagacgcgggcgccatcggcggacgcggacgcggacgcttaccccaggcccagagggagacagcgttccacttcttgatctcgaagcgcttgcccttcttggccccggaggaggaggcgccggcgatggaggggggcacggccacggcgacgtcgcccttgtccatggcgaaccctagggtgggaggggagcgcgaggaggaggagtagattgggacgagacgagaagcgaccgcgaggagagagacgagaggtaaaatagaaaagaggaggcggcggcgcagagtctaataaaggcctcagtccaagcccttgtaggtacagtattaacgggccatcaaaagcccaaagtattaacgggccatgcttgggttcttgctgaagatacagtttttctcttaattctttttggtgcatgtgtcatgtgtgagagagtaaatttattttaaatatcacaccaaggcctatttggggaggattatttgaatcacctagtgagtactcccttcgtttcaggttataagacgttttgatttagtcaaagttaaactgctttaagttgaccaagtttgtagaaaaaagtagtaacattttcaacacaagacaaatttattatcaaaatatatttaattattgttttgctcaaactaatttagtgttataaatattactatatttatctataagcttagtcaaacttaaacaatttgtctttaaccaaagtcaaaacgtcttataacgtgaaacggagggagtagtagctagttgatgagaatatggaaaatttgtgtttcttatattctaacttctattcactcagtttcaaattacttatctcgttctagatttttcataagtcaaccatttgaatatttgaccatcaatttctacaaactcatttagcttagcattattagatttatattatattttcagattgaccatgagaaatacttttatgaattataattcacgtgttgttgaactacacggatttttataaactaatggtcaaagatatgcatatttgacttaggacaaacctaaaacacgtaatttaaaacaggggagtaatttattttttgagtgatattttgatcatactttgttaaaaatattacaaaaatataattatattgttacccgtggtagttcacaattgccaaatatcctgaggcagacgagaacgataataatcgctgattcacgtgtgaccatgtgaggttggaccaacggcgtgacgtcaaagttcagacgatagcatgacgaggtgcaaaatcaagatccaactgtacgctgacagcagagctgacttgctaaatatcactaggcattcccacacacaggtgacaaagaagacaacagcaattccagtaaaatgactatgctcttttcccacgacttgttcgacattatatcgggattactagcgtctccaaaatttattgatactgggggctttccagtatccattacagacgatattgtataactctacgctctttagtacacagtttttaagcttccaagtaacttggcccgagtatcaagactgctctgttgcttgtgctggtatatgagtttatctatcttgaaattgtaaaatctatcagatatggtccccatgagaccaatgatctgagtgaggaccgtctatagctcgcaggagaacatcggtttggtgtctggactgagtactgaagaatgaagatccgttttgagacttcttggctttctctggttcttggttgaacttggtggtgagctttttaaagcagcatgtcgctgcctgattcgcttcggttagctccggttgaggctcttgaacaccaaatagccgaaaccgccaattgtcagggcaatgagtgggcagatggacatgtccatttccaggatcccgtttctgcggactgcatttccttggcgggtcaaggccaaatgctcatgaagcaagctggtcagattgtcaagctgatgtatcacttggcgctgacctcttgatatggcattaatctgcgaaggaaacagaaagtccaccaaaataaatgtcaagattcatacagaaagatgagtcatatctagaaaaataggtagtagtcagcaatcatgtatgaagtgttctttgttttgaaatatgattttaacaggaaaaaaacaaattcatcagaacacagagttttttttttggaatatgattttgacataagtaacataaattaaatacatcgggaatataaaatcttcgagacattatacagtacaatatcttaaaaaacatgccactgaaaaaaaagctttcacagcctttctgtcagcaaataaaaatggttcaaatcacatcacaacatttttgtgaagccaaaaaatttggagcatagaagtatgtatagttagcaatctaggcccgatgcaacatgccaagatcaactgttacaactccactgttttttatggatacattatttcactgcataaactacagaagctgattttcttcctatatgattggaagataaacttaagttccatacacttccctgtttatctattttcatgtgagtctaactgactactaccatgattctattctctatctattgtttctcctctcaaacaatagtaccagtagctgatggcccactaaattttcacttcagtctaaattcacttatttgaatactgactaaattaatacagtgacttgtacaaagtttccaattctacatctaaatttcaaacaaaatctgaaaagtgtctcgaaaataatagcaaaaaaatggacccatcataaccaatctattggtgagatttcaagtttgatgaccgaatctggttctggcatcagaaattcttttgaaaaaaaatactgttggcctttctgcagatgaccaagccatagttttagtcaatgattaaggtgaaatggtttgggagaatgcaactaaacacatggctgtaacacagactagcgaagattatattatcagatgatgcaattttaccttaagtatgacttaatttcaacaaacccacaaatccaagtggaaaagtggggggacaacacctcatgtataagattataataacagtaaggcaaatacctcatccacaatgggggactccttcaaaagttggttcgatgatgacgaatgaggtatcagggtaccattgcccaaatgagaaacaaagagatttgtaggtgcagaaccattgcaagtttcatttggaagagctaaattttgctgactggtcgatgatttctttattgcaaatttacagttgagttcttcaactcgagaggtgaactcgtccatcctctcattcaacgttgaaatctgttcggatagctgagtgatagcaccctacaagcagcagcaaacaaggaggaattttgagtcagtgttatctatgtcaagtttttcacaagaaaaaaatgttttaattagtatggtagctataactaatacaagtattctagaatgaccacctgattaattgcaggaggttcaggggctcgcccacttccaaaccttctgttggtttctgtcaatttactcaatttcacaatatttttatctccatgagttgaatatgaatgagatagaccactgcacagaatccacaaggtaacatcagcgagcttgattcagtttccatggtttcaacaaagtatagcatttcacaaaaaataaattttgagcagagatgacatgaagaaaccttttcaggtgtttgtttctcttatcagcagaaacccgagaaagggcctcttttggacttgaaaccagctcatcatcaatgctgagctttgtcttgagatcttctggtaatgcctgcatgtaaacttatttgaaaccaccccaaaactaagaaatacaactagtgctctagtaataaggtgagaagtgtgtatatatataattatcaaatacataccataacatcgtttatcagtttctccagctgaatttgttcaatatatgtgcgtggaatataagagccatccagacctaacttctccgctacaaatttgacatgatttctatctcttccttgcacctaagaaaaagcaacataatattttatgcatcttgttaacaagtggatagatacaaataataataactagagtatcagtcaagatgtgcacagagaaagatcatgttgaaagagaactgcaatcaaatagcaagagtgttcttacctgtatataatttcggttaagttgctccaaccaatcaattttaacagttgccttgccatcagaaaacacacgactctttctcttcagtatagctgctatagtatatcccaatgccatcaaacctccaagaagacgaacactgacttcaaacgtaatccttggtgatatgataaaaggattatcggtcacccactccttcaaattatcaataacacaagttagtgaacacaaatttcaaaattattgcaaatacgatatgataataaggtatagcaaaggagtatatatctaagctaagtagctaactgctgtggtagagaacaccataagtcagcagacaaaattgccaaaaacacggcagttacaaagctgctagtgaatgcaaatacaattaagactcagctgatctttcccttactatgctcgttatgcaattaattttttttgttttatgagctacaggtgcaactgttgtgaaaatattctagtaggaataagatgcatatttctggaacctatgagcatggcactagggaacaactaacaaagtggatataaaataatgggccagagaggtaattcttgtaacaaaacaaccaactatatccatcacacatatgcacttatgtagccattgcaataaattgcatacctcaaacatcagattatatttcccttccctattcctcattctcaaataagattggcatgattctggatcttcgcctggaggaagcaaatatatatcataagtttcttcaatgctttctgtatgatcttcaccaagagcaactttgatgtcagtaggtgttatagttcgtggagactgcaagagtacatttccaaaagttaggccatctagataaaccacaagacaagtatttattagtattaaaattatgctattggtgaagagatcaatgatcagccatcttgccaaaacatggacactaaaaggaacataaataaggagtgcttacctttagaatgtacataggattttggaaccctgagaatgggttgaacttgttgattatttttatatgtgctgtctgcaagtctggctcaatgaaagccttatacatcggataaacctgaaaaatgccatcgttcatcttgttaaacaacacagatggatgaaaaagatactatacatacaaaatataaattgcgaaatgaatgtttggtttgtattaagatcttttgtggaaacaaaagataggggaaaggcatatatagggtcaagttcaaaaaggtgaagcaaccgtttcagatatctgatgaattatttcctcaggctcctggccagctctctgtatgtccctcaggaccctcttcaccaggtcaaaatgaacaccaccagtgacagaaacacgtaggtccaatacagatcgtaacttttcactcaatgcatagatgccttcaatgataacaatcctagagctagggacatcaactgttctgtttgccataagaaaagataacataaagacatatgaccatatatttacaatactaaaaagtgacaaactgggaattattatttaaggacaaactacctgtatccagtccggcagctcatcttgaaatcatatattggaacctgaactgatcttccctccttcagaccatgaatattttccaacagtgtgtcgtagtctgttaggcgtggatctgttcaaatgtcacaaagatcagacatcactaactcagttaagtagttagttagcaccactgccgctcccaattgaatgcagctccaagcaatcaaactcactaatacttcgattatatcataaggcacgtacaacaatcatactattatcagggcatacatatgcagatgcaagaagtaactataagataatgcattcagatgtatgcaaagtattgttctgtgcttattaaggaaatctttcaaatgtaaaggaagttctgtccaaattacgggatgataagatagtatgcgaagtgcttggaacttaggggttaccatcaaaattgccatcaactatgcgacttgcatcattgtagttatccattgatatcacagcaacaccgggcatgaaattgagcaccttctcagtaaacacagtcttcccggccccagagggtccagcaacgccaacaaaaatcatcccttcattgtgctgcaccagaagctggcaggcacggatcataacaaagaagcctttctcaaatgacaatggatcaggaaagcggacgatttcgtagcgatttgtgtccttccttttcaccaactggacctggtcccgcagaaggccattacgcctccttggcgaatcagccatggaatcacttcggtccattcaaaggctgaattcaagaaaacacagtgacttacaatcattaaccttaactatcaagaatataacaacattctaaactgaagtccagtcaccaccatagtagaacacagtaaaaacgtgtacgaatgcaacaccatctgtcgaggtagtagtagaatttcttaacgatcctacttgttcccactaaattcaatcatgggaggaaaaccagacaacaaacagggtatggatcctgcatctacaagggattggctcttccgtgtaccacatggatcgcactacacaactgaaacccatggaaccgacctaacgtggcgcggaggcggcggagtgatgactacgagaaaaaccgaacacattcagttcgattccaaccttacatgaacgccgccccggcccgcgtgctcctacaaacctgctcccctcgccgtcaccggccgtgcgcgcgagcacgccgcgcacacaggggagaaggctgcgactgatttccggaagcagtggtcgaggccgtcacactccaccgcgccccgcgaggaagcgaggcttcctccgccgccgcgcgagagagagagagcgagagcagaggcgcccccgccaatgctaaaaccgcacacgaatcatccactagcaactcaactctcaaacagattaacaaaaccaccttccaaccaaccaaacccccccgcgcgagtaatctatatgcaacagggcgcggcagaattgtacggaatcgcagcagattaatcagggggaggaatcgcgaaaaaggaaaaaaaaaacccagtagtcagccataccgagatccccggaggaggaagcgtctggagactgcgccgccgccgccgcgcgcggaggagtgggggctgcttcggcggcgcttcgccgcggcgcgttctgggaaaaaggcggcgcgcgtgggggtgagggaacggaagggttgagccgaggaggagtagtagtagcctagtaggaagaaacggagaagagggctctctctgaagatggagagggcggcgtcgccgtcgatccaaaaagcgctggagatcagtggaaactaggagatgaatcaaggttaaaacggtggggccatcaccatcggcctccctctcccggttttatataggactactactgctactcctacaagctttgatcatgtacgccaaatgcagggggtggcagctgtagtattttgcacgtatttctatgcgtattttgaacgcagagtttggctaaaaaggtagtcctcggggagtttggctgaaaacgtactccagtttaaccgtgacatgtgttaggtataatatagaggtatcttttctcgtattttgtatttgcacgaatcgtgtaaagttttatcgcattggtagaatatgactgtgtatattggacacggggtttggttaaaaagcatgtaacacgacatatctaggcgtaacaaaatgtctctttgcgtatttttcatgtacgaattatgtaaaaatattgtcacaaaaatagatcggactaacaattttatattgtgtatatatactaaaagtagaatttggtttaagagtagctaacatgtcatacagtgggcgtaatagaaagcctcttttgcatgcttttgtatgtatgaattgtatatagtcttgtcacataggtgaattagacttaacattttctgtgatacatgagatcatgttcatgcatattaaggtaataaactatcatgtagactccgtaagatatattggccaaaaatgacgagtcatgtaccataaattatagtcaaattaatatgttgtctcaacgtttgggtttttgctaagaaaagtgaagagcgtacgaagaacggatataaatcataagagtcatcgcctgctcactagacatgcattacgtcattgtggattttaaggaaaaggtaattaggcatgtgcacatttgttgaacaaataaagataatcttctaatacacaaaagctataaaaagaagtacatctaaattgaaagatatgataattaaatacatgagaccttaaaaaagcatcaatcaaagaacagcccgaatagacgatgcgcaaaggttttgcgtgttcggggaaaaaagaaagaacaccccaccaaagagaagacaataggttccaaagtctacctcaactcttctctcatctgatgtaacatggttatctacacatttttccccttagcagtcctttatgcatcttttgttttcaattaaaagtaattcatgaatcacatgtttaacattgatattgtgtttatcatttttatactacaacaataacacattcacatcatacattctagaatgttataaaaaaatctgagccaaaacaaaacaacatccaatattttagtcaaattgtcaagagttataaaacaagttaaatgtcaaactggaaaaaggaaaagagaaaaaagatatcttgggctctcaattttagt

SEQ ID NO: 7804 - DNA, 5698 bp, Oryza sativa
agtataacatcaaagagaagaaacttattaaaactatcacttttttccttatttatataccaatctcattaattcacgtgcctaattagaagtgcaaacacattttagatacaaaatttaacaacccataaaataagtaatttatggtactcattcattatttgcgatgcgatcatatcaatccgaatatatgccattgatgagttggatatgaatatatatgcattcatgaacatgtgcaactgagctttttccagaatgatcgtattcattaattgtttgctccacaatagtaggctgtatgcaggtggagacagggcaaaattttcccaggacagctcaatgctcaacaaaaatgtgtaatctataacagcttaccattttttgcgtctggtctgttgtatttgttactcttttcgaactgtacctcaatagaaagacacccgctctgatgtgtgtcctctaaaagtatatagaagctttttttttaaccaggaaaatgtttgtttgcccttcctaaaactgtcttggaaatctttccgctatgaattcactttactccattttaaattttataaataactcccgtaatattccaatatgaatgagcatgtaaactcagttccatcaaataattctgagcgctcccacactaaacaaaattccgaaaatatttgtttgcattctccgaaagggcagattcccatgaactccgctgacatttctttacgttggatgtgatgggcctatgatctcaggccatcaaaaatgcagattcctttgctattacccgactagatgcaaatagccaaagatagccgaaaatcgtggtagatagacacatggaccctacatgtttattcagaacagattctcccccaaatccctaggaccaaccaatggcccggaccaccggccatcagcgatggaaaatcctaaccctttttctcctcctctctgcaccgtcaactgggtcagagcaagcatctagcggtgcattttggataaacgaaaaaagctctcatgcacgcacatcaaaagatcttcacagaagttgtccccatcggatagcacgaaagtttttctatcaggaaataaaaagtcgacaacaacgttaagcatatctatggcaaatcagcaacctagcttactagcctgggagaaaaaaaatattccaatgatttgccatagtgatctcctgaccccttttttatattcaggccgagtttagttccaaattatttcttcaaacttttaatttttctatcacatcaagactttcctatacacataaacttccaattttttcatcacattattccaatttcaatcaaacttttaattttggtgtgaactaaacacaccctcaatagtgcaaatgccaaagaccactaattggtttctacttgggcgacagggatttgtggcgtctgtagattgttttagtggaattgataagatgggggcatgagggcatccctgttgcactccaagcccatatgcatcgcagcttttacaaggcataggaatgtaaaggatggaaatacaggaagcctgaggactgaggagtaaaatatttttgcataggctgattcagtcacaaagcaacttattctcgagtccttgaccctcgcattcaagcttgtcggagcttataataaggaaagaaaagctacaggtacaacagattattttgactcttgtggctctcatcagaaatctgaaatagaacctctcacctcccggttcaagaaccaaacccttgtatcttatatttgcgcctcacaatctgttgttcttcatcatctctataaattcaccaaaagctgtaaagcacaagaaacaggattagtaaaatcaacacttaacagtgataacacaagttgtgttggtacaacacttttctctagaagtactatattgttcaaggaaatgtacccaagtcagaatcatgcggcccgggtgaggactctggatggtactgaagagacaaaagtttcatcttagggtactgaaggccggcacagctattatcgttgagattgatatgtgttactttcaccccttctggaagtgactctgggtcaacagcataattatggttctgcagagaaaaatacggtaagacaattgcagattgcacagtagtaaatgcaagtatgacaagtaaaacaaaggggaaaatagctaagactcagaaatatgaattaaataaaaggaaaatagcaaggatgcacacatttctcttggtggaaaaacaacttctaataatacagagttacaaacaatactacctgactctcagctgatttggtgtatatgattttagtctagaaggatagacttgctacttcctccgtttcacaatgtaagtcattctagcatttcccacattcatattgatgttaatgaatctagattaatatatgtgactagattcattaacatcaatatgaatatgggaaatgctaggatgacttacattgtgaaacggagggagtagttgattaaattggatatacctaacagcttaaaggttcaaattcattactctcagaagctccaagttttcatcaggaagtgtcacagcgagaagtccagcacctctcccaacaccagtaatacggaaagcctttcaggaaataacataggatagatctataaatcaatacgtaacagaaaagaactataatggatatcaatggtttctagacttaaaaacttaaaacagcaatcctacaacaagtttctatacctctagttagacaaaacagtttattgtactgaaattcaaacggaaggctatttccctcgagagtcaaaaaacatgaatcgcattcagtatcaaaacagtaagaagtcaggtcaggaacaaacttgtgcacttatgtcgacacgtccacttcgaaggtcacaaacaggatgatttcctccatgatgaccaaacttcattttaaatgtcttcccaccaagagcttgcccaatcaattggtggcccatacagatgccaaacacaggaaccttccctattatttcttgtactgtcttcacagcatatggaactgcagctggatctccaggaccattgctaaaaaacacaccatcaggcttcaagttaagtacctcagaagcaggccaattggctggaacaacagttatcttgcatccatatgacgtcaaacgtctcaaaatattgtgcttgattccaaaatcgtatgcgaccacctaaataaaaggaagctaatgtttagatatgagattcatctgaagtgtttcaaaaaagagaaagggaccaaaccaacactgacatgaaaactttcagtcgattgacccttcttgaattcccactctgaatcagtcttgtctgaccattcatatggagcatcgcatgtgacaccactaatcaaatcaacacctgcataacatgaaataccagatcttgttttataaccagtaacttgaatagtgtctaaatatggatggaggcaatcaattttgccaatacactattctaaatgatatcattacatgtcaatgctggtgacacaatattcatcataaagtggacatgaaaaatactccagatagttactctaatagatcagtgaaggatagcaagcatcataaccatgtgtccatgtcataaacatatgaaacttcaatcgagttaacaatctgcttgaccagcaaaacataataatattcctgaaccagtacgcggttaaataataaatagtccacgttaatttcattaagcctagtactatcatgtttgcaaggtaattaattattttttaagacttaagagtaaattgcactgttcaccaggtagaattatcactttgcactgagttcagcacacactttcactttaaaccagagtagatcgaataagtttcattttgcactaggttgcttcatataactgaagggaaatcttgtcaaatcttatcaaaacgttttttttttaatttagaccatgtttcatgaagtttcatttagatttcatgaaatttctatatgtttgatgatgtatcctggtgttaagcgaaacttatttcgatgcacctggtgtaaatagaaatatgtgctaaacctggcgtaaagagaaacatgttacaatctaccatgcaaagtgcaattatatttattaaaggagacagacaattattcaaggacattactgcttgaagagagcatagcataccaacaattttccaattttttgccatttccaacaactcatcatcggtccgagattgatcagtacttaagacaccaattagactaccatcttctcgtaatctccgtgttatggcgcgtgtgtccacatcatctgcatataaagcaaattgatggtgtttattgttgcttttgttgtttgtcggacatagagagcaatgtatcaggtgacaatacttacatattcccataatgtttctcttcatcagatactcttcaagtgtttctgtgcatcgccagttggatgtactacagagaaagaataccaatttaacaacattaggtggttctcttaaagttccaattatgtcaaccaatactaggaaaaaatggtttaccatatgcttagattccttatgatcagaccagcaaggaaacatcggttcgattcttcatcatctgcatgagcattctaatttgttaaaacttacaagctattgtggaaatggcatcatatcatgattattgactaatagaaaagatacggaccaggattaacaccagtgtttccaatatgtgggttggtcatgaggacaaattgaccagcatagcttggatcagtcaaaatctcttgatacctgcagcccatttgatgaggttagttgtttcctgttgtcaataagcagtacgcgcgtctcaactatttgatgaggttagttgtttctctatcaggaagaacaataagcacatctcaaccacaacaggaaacaaatgccatcactcaaacggttagttgatttaccctgtcaaagatgtattaaataccacttcaccaacttgtgttcctgaagcaccaaaagacttggccttccaaactgaaccatcctcaagaacgagccgagcatcgctgagcttccatggtctttgcactgcacgaagaatccaaaaatggtgaaacagtattcatcatcttcttaactgtggagcacaattgcctaatcgcaaatccgtagcagaaccctgagcacgtattccgcgctgcgactgcaaaactagagcgattcgaatcagctagcgaaaaggcaacctgactcacctccatcatccaccacggtaccactctgcacgccactgacagcctgcacacggaagacaacacaaaacaactcaattttcgcgcggataaaacaaccatcgacagacgaagctgttgatggtgtatgacggattcagtcttgcaatacaacgggactaaaactatggcgaaggcttcacgggaaagcacaaaagccagatataccaatcagtacactcctcccaaacgataggtaggtaacaaggccccgccggcgaagctaaagcagcaggagcaatccactcgcgctcaccttggcagcacggacgccgaggaagcggccccgtttcgcctcgggccgacggtgcgaggccctgaggggacggcgaccgaccgagcggcggcggcgcgtgggctggccgcggacgggcgcaaggaggg

SEQ ID NO: 7805 - DNA, 1686 bp, Oryza sativa
  unsure (1)..(1686): unsure at all n locations
ttagtcttcatggtaacgcctccaataagaacattatatttattgcataatccaagatcaagagattgctccccaaatctcaaatatcattcttcacggaaatgtttttagaaatagaacgccgttcaagttgacgtcattgccgaaactaactaacaaatgtcaatagtagcaaatgactagatcaatgaaacaaccaataaagaccaatcaccgattacatatccatcaagctaccatatacaatctttatttttagtgtgtgtgttttggctgggtgcatcctaattatgcagaggtcgaaagtgcgctcagtgctttttatcatcttgacgtaattggctgagttcaataaaaactttatttatctaaaacaaatatggaggtcggatattagggaaagctatacctccaccatcactaatcaccactctacatgctactttcttgtagtcgcatggttgtgtaccaatgctcttcatgtggaggcatcaccgccgatgccccaaatagatgacgtggtcaaatgaatgatcagaaccgtattgatggatcggaaagacactaccaaggagactcattttaaagacaagatctggaccgacctatactgatttttcgtcatctcggttcaccatagtgaaaaaaatgactactggatttgtgggtttctgaacctcaggccccaggccatggtttggataccaggggtctagatccatctctagacactattgatgataaggctatctaggatttattttttcaccaccgctatgaggcaggtgccgctggtggcgaggaacctgcctccggtaacatcagtcaaaagtagagtgcgacgaggtgcctcgaggcgtttttggttgttgtcttggttctccatgatgtgctaggttgctagcgagatgagtagctctcatctttgatcctatagctagataaatcttagaaaagggcaaaccaaatctcccctaagaaacatttcttctttgaaaacataaatgaattatattgcctcgcaattgaagtgaactaaaggacatgcatgaatgtgttttattccagaggcatggaaaattttgtaaagaagtatctaacagcaaatctaatgcaaaaatctaagttatacgaaacagttgtcgatcttatcacgtgatcaagtgccggataatgtaactggtgatgctgtcgtgactacacgtgtgggtgactagttggcatcgttgtcgagcgcatatgcagctagcctcaaatcagtaatattcctcacggcggaaaatagtaatattctatattttccatggagatatacaagctttgtgccccatctctctctctatatatatacatatgtgctaactttgagaagattcctagctcgcaaaagaaacagattcatactctagcagatatgcctagcgttgaatgggattccctgctgcaccttcgatctaaagagtaaagaggtgcttcaattcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7806 - DNA, 19509 bp, Oryza sativa
tagttgccaccactatctacaagcatcgactagaaaacatccagagtcatgcacggcgatcaaatgattctgatgtatcaacaccatgcctgctgacagaaagattgcctttcctgtcacgttaggaagcaatcaagcttatgcggttgcatgtagcgtctgatgaagcccagaatgttcaggttcaagagcagagctgctgcttcatatctcccaggtaccggcatattgctgcagcaaacacctgaaatggttgcgaggtcagttagctgaatccctttatttgcatccgaggcaagctttttgcaaaaactaattccagtttggagccggactaaagcattaaagtagcactgcaatattctcttgcactgatcgagtaggaagcatggaactactcaaatgttttacaaggatcatctacttaccattatctgatcctcttgaacccacagctggaatctgcatcacttgaaccccaaaggagcctgggccagcaacagcaaggcacagctaccagcagcgaacacatctagtatgaatcttgcattaaacagcttctagcttgattggtgcttttgtaaaaactgataaaacaaaaggtgcttcctctccaggatggatggttgtgggcacaattgtgtatccttttggataaggctccaacactaattcacatgatatctcccttgagttaacataatctgttccacccactgattcatgcatgtagatattgtaagcagcacggcagccccgtgtcttgagtatcctcattccaatgtaaaacatagaagagtcatggctagattgatagttccggaaaccatttgtctttctagaaaaaccaacaccctggcaaagcatggaatttgtttatatcaacatcatagtgaaatctccaagtacattaacattcaggatggaatatacctgcgtaagggtaataaatacatgtacaggatacagtgcatcccgtcctgttactctaagccggtactgaggattttgatgccatgagtcataatcttggcaaccacctgcactataaccacgccattggccatggacagagtaacgcatctcgggtggataaacacgacagacatatattgaccgaaagtggatctgaaaatcttgccaagacatccagaataccccattctttgactgcaaaaacaaatatgggtagggtcaaaactgcacacggaaataaagttgggaaaatatattttgtttttgtaggtacaatgccttaagctgaaatcaacaaactggaggggtgacaatcaacacatcggtttttttctcattctattttaaattaaactgtagtgtgctcactcaagagcacagtcaacgagataagcaacagaccaacaattttatcatgctaaaaggaaccagtatttggtgggttcatctattaaatttgacgcagttgtgtatctttctaatcacaattagtggaataccagctgttcaagtacacggtcacagagaagagcaagtacctgtggaacatgcttaagtttgtgcttcattcgctcagtccactcttgtgatgagtctgaccacggaccattccattcaacttcatttgcccacggatttctaatttgcacgagcttatggccatcaacttctcttacctgtaacatacaatataaatttgtctagcgcaaaaagaatgggaactaagtgattgccaaaagatacagacaagtcagagcaaacctgcaaaattgagtaagcatgtccctgaacaatgccacttgatgaaatatgagcatccgagccagaaggacttccagcaccaagaagaaagccctcttgtttaaaatgcaacaactgagaccacaatcttccactagcaagatcaatctgcgcttgggggctccgcatgtcaatctcttcaccagctcctcctgtgagatccactagagcatcttgcacaagcccaccctccaatgcctcataagagccatgaagctttgcataagctttttcaagaatggatacccacagctcattttgctttctactagtagcaaatgccggtttccccggagactcacaggggatccaatcatcaaccaccactgccacccattcaccctagtaatttacagaacattgaaatataagctcagatcaaactggtcaaagatagttcttcacaggacaatctcaagtcttttttgtgttggtgggaaatactccctccttcccaaaatgatcatcatatatgtttgtgcaccaagaccaaggataatttaaatcacatcaatcaagacaccatacacacattctcccacaatgcatgcatcgatcaaaacaccatgccaattacacctagcatgcacacattctcccatgctgcattaattgtattctgataaaatccgcgtctatgcggttatatgatgatcaatttgagaaattttgaattccattacatgatgatcaatttgggaaggagggagtaatccacaaggtctggtgaatatgagctatttatactattatttcacttttatcaacttacctttgagtttcatcgtaaaatttacaagcatatactgcatatgtaagttgtgcattagtgacttgttcactcatggttttcaatgttgtttatgcagggcataatgcacatgtgtaattgtatatattgtgtcattccatttgggaatttccctaaaactcgagcaagataatggtatgcattatgttcttcatggtggtatgccccttactagggtctcgcaatgttagcatttcagaagacgttggcattcttatatgcaccctatggaatatgaatagcaaatctaaagtcatgaatcccatttttcttaattaaagcatataggttgtaagcctatgtataaatatatattagacagctctaacaactgtttatgtatttatgtagtatcaacttgtccaaattaattatttcgaactagcggaatttatccaaactaaaatctgcaagtcaaggtttcactgagcctctaacagcactattaggtagcacacatatccaccatagctctagtaacttgtggctgttgtattatttctgattagaacttctttcccacaatgcagaagaaaatggcttgttgatatatgttgaacacaaagtaacaaagagaatcaacttgcagctcacaaatctgttagtttgcttaaccaattcaactttgatatttaactctgtatgagactaaaatgttaaatctcaccaagatggtgtgctctaccaatatactttaccaaaggaacaacccaagaaaatggaatggaggacagatgggtcagatcattgaatacctggatacagaatctgacagtgtaaatcccttcttcattatactcaggagtgattataacttcagatatacgggccatctctgtcaaaactgcaacagcgctcaagaaccaacagtcgcccaaccgaccctgaaaagaacaatcggacaaattggattgtgtgtcatgtataggaagatggaaatgtataaagttgaaattctagtataggggaagaccccacatcagcacaaagcaaaatctgcgtacctgacacacatctgacgaattcacagaaccagaaaataagcacggttgtgaactgatagatacctccttcgcaatatcagaaggcctcatccactcagagacaacctaaactcagaaacacagatgacagatcaatgtcaaagaccaagccaattcttagtgcacaagtcagaaactcagccagttcttagtgtacaagtggtagacaaatgcatgcaatagtacctgcaattttagagatgggttcatcggatctacaaacagagatcgatcatccggagggaactcttgatcagtaaaatttctctctcccttcgcaataagagcctctctaacagccctttcgacagaaagcatgcgctgattgacttcctctcgtgtctcaaatcttggtttccttggtcttctagcaaaggagtcaatgtcaatagctacagaatcacgcgcatgacgtttcctaccactggagtactgtccatcccattcaacgtcctcttgatcatatagttcaaaatttgcttcttcactttcccagtcatccacctgttgaaacaatattagatgtatgaatatcacatgcataacttcataatcccttccatttcatggctctcaagaaaggtagaaatgagtaattgttcaggccttgttcgtttaatccctcccaaaagaggatttggaggggatttgttccacacctattgtgttgtggaatcattccccctcaatccctcactattggggattaaacgaacaaggccttaggagtttcatgttcccttctaattaatgaaataaaagcaagataaacagtaggaatagattggtcgaaacaagaacttgcccttgcagaataacttccatgccaagcatcctcagcagcaagatcaaaaaggccatattcagcagaacagatggctgtatgcaacatagcaacctcatcttcagtcagacatcttccccatagaaaagcatccatgatctgcatctttgagtctgatccctcgctgtctgacctaccaaaggcatctaagtccgtgggtggcctagcaccaacccaaatatctgtcccaggttcccagatgccattatttctaggcaatggcaacgcattctgatatccatcgtagactccgtctatgaaagaagttgcttcacctagatcagcatctatagtcacagtgacaagatgccacctgaaaattaacattggttacagtcaggcattaccaggaaaaaaaaaagttgatgaaatgttccacccaaaaagacatgcgacaagtccatgtaagactagtatttcgatgtgaatctgaacataaacaggttggctctcttgattctttttttttcatgcaaaagaaacagcagttgtcacgagctggtacctgccatcagcaatacttgatgcaccaatattccactcttttgcaacggttgtcatcctttcacccttagtcaccaatcgaagaccaacttggccagcttccattccctgttctgaccctgccaccaagatttcccagcacacttttttctggaattctgttccaaaaagacagactggacctgacaccggctgcaccattactgcaatggagaagctaacttttttactttcacaaagacacaaatcaatctctccacaatgacgcccagtactccttggttcatcatcaagtatgcaaacagtgtctggaatgccagtctgcacagttcgtaacaagtaaaagatccaaagagcatcagtaaaaaagtaattacaagaactgcatgtataacatatggtactaaatttataaacagaagaaatgattccaggctattacacgtaactaactgtcatgcaaaaattgatgctttgtcagataaccaactccaaaatggatggcaaaaacagataataaatatccaaagatgaatatgttcagttcatgcactcaaaaggtacaccatgagaactatatcatcattaaggtgtgctttagaagttgataaaatctaatgattacaggaacagtaacagaacctgctctgctcgccgagccaattgtgcctttcttatgtgacgagctattgacgagaccctgtcccttgcaaaagaatcttccagagcagaatcaccacccacagctctgacagctgctgccatggctgcagcatccctgcttccagcattaggaatagaagatagcagtgatatttcaagctccttccattttcgttcctctctctccaacaatgccttcctcctttcccttcccttcccttcttcctcgcgcctttgcatcaagacctcctcttccatttctttttcccttatgtagctgaataagcgaataagagaatttagatggcgggcacagaggtttacagggttgcagatagaaacattgcatacataaaagttttaacaataacctttcttgaataagttcaaaatgtcttcgatcttcaggcatccatttcttgatttctttggcacttaagtcagaaagacctatgctgtccagaaaaagtctaagacgaacttcatcctgaaacaacagacatttccaacattgttacagattttaagaacaaaaaagattaggtgggagtagtcccaaatgcatacctgtatttgctcagctttggcagtcaagccaagcagaagaagtaaataaccaccaaacttgtcccacatgtaaacccattcagtatcaattgcttcttccaaagccaaaatacgtgcatgggcacacatattcctccgataatctacatctacaggggatccaatcattaaacaattcttcactccacaaaagaacgatcctcccgtaatttcttcatttcttaaacgatctctcagcttcatgacatcagccctaggaagcacaaaattcccagccctgtccaacgtaatagcaggatctccaaccaaaagagcagcagaacttgcggatctctgaggcgccgagtaagtcccagaaatagcatttctcgtctgattgcacacaaagcatactattaacaatacagaaataataaaaatcagagtcataataatctcattgataagtactggtcctggatattggagtagataacaccagcagcacttatgtaagtgtcaaggctgacaaggagtgggaacatacatgattgaacttgatgcactagattaagaaaacatagttctgatctcagcgctagatgctaagtggtaggcttactgaggcaggtttaacagaaaagtatgcaagcaagaacagcatttacctatgttacgcagggatatgttgaatatctgaataatacaaatatacagcaaacttactttgttagcagaacgtgacattgcttgtacaactgtatccttactgagaaagtgaacagcgtcctccagcatctgacaaaaatttcacaattaatttaagaaggatcaagaaaaaagaggaaataaaggagtgtattattgccattggtattggcacttcaggatttgccaaccaatgtgccactgatgtgagcggctacatgtggtggagttgcaactggcaagtgctgaagtgcatatttttgggtgacaaatcctagattttcctaagagagagctcatttcaataatctgctgattttggataaacagaaatactaaccttgagagtcaggcatggtcgagaaacagcaaaactgaaggcaattacaagagtgatagcagaaatagcagccccaataaatggtggattcaatattagactggcaatgacaccccaaacttcagtagccaatgcaatcccatacaagataaggaaggcataactgtaaatacagcaatgttagggtgtgtgctcagatgacaatagtacttctaaaaatagcatagaagaaagaagttatgagttatgaccaatcctggtcaaaggaaagatatataagcatgtagaattagaaaggccatatcctgatatccgtacctaacatttttagcagagtctgcatgggcatcataaacataaacaggtaataccctcggtgaatacacgacaattggtggtgatagaaggacctgagaagagtacagtaaattcaatattacaagcataactcttgagataactcacaagtagcaaaactagcatgagatgttcaacagaaattatcttaaacatgtagctaacttaagttaagaaaaaagatatgaaacttacagtcaatgctcttcctgtgagaagaaatagaaacgagaaataacctatagatgccccaacgaaaggtttctctgcaaaaaatcatcagctgatttaagctatgtgcataatatgggaaactattatgtaactcggagaaagaaaaatagcaataacaggttgaaaagcatataagaagatgtagtcaccctgaaataagcccatcaggaaagcagccaaggcaaggagaaaagcaagggagcaaacaagtaacatttgtgtccttgttaaatagaaattgttagatgtccagtagtgaatgaccccaatagcaaattcaaggaacaagatgacaaggaggcatgcaactccaacctgcatagcaatgacagatcaattatgctgtctcttatcacaaatgaaatgaatattatgataaatttattttgaaaaccaagccacaaactttacttacagtccaaggtctaattgtaacaattactgcagatattgcaccaagcaataacagcactcccatgccaacaaataggtaaactccacgggaaatcttccaatcatcatccttcctgaaattatttgcaatttcatctcagaggagcagaagtatgcaaggacgtacaaataataaacatggtttccaattttccataccatttatacatcccagtaaacaacgagaacacagcaggaatgcaaagtaatggaagtaaagctgccaggaaatcagccttcagaggaactccatcctgtcgtgaatttaccactccccagtaggacacaccacaaaaggatacaaggacagctgcagaaagtcaccagtcaagtgccagttatccaaaagtgtgatgtgctctatttaatatgcaatgagaacggaaaagaagagtagaacatacttgcaaaaaggccaacacatatagctgatgaaggtgaaaatcgataagtagcaaaccaagcgacaataggtatcaccccagtggcaagtacagcaatcgttgatgataatgcccatccaagatacatcgatgttgcatagggagaatagaaactctttttatcagcatcccatcccttgtagcccaatgcatctagaggttttgctgatactattgcaccaaggccaattactgatgcagtgaaaacagttatgctgatggcaaacagagcgcgctgacaagaagataacaacgatcagtaacatgaaaatcattaacaatgctggaaggtctgaatgcgttctacactatttataataacattagagaggtcaagaggtatgtgctgtaaaacagagcctgaattcttttcagtaggatagcctacaaaacaagattttatctaatgctgataggaatcacaacaatacagtgaaaattgattcagtaaacatattcaggcattcatccagaagttgttaacagtatattgacataaggccatatagtaagatgatactggttacagtacttcccttacaactacgcaaatagcttatacagacatttattggatatccaaatatataaacaaaagggtgtcctgctgctgaattaacaaaaacaacaaacctctttctttcctggagcttggcggatattttcacggctatcaagctcccctcccggaatccagaaacggtaaccgttacgcatccatatgggaatagcaaatgagagacaagccaccataagtgggaccgtgagtgacaaacccaaaataactgatgacttgctgcagaatggcagaggtagtatttcagacaaaagtgtaagtacttccccaatgaaatgaatcaatgattataaaaatctagtggctagagagtcatacatatgtataaacaaggcatatgcaagatgctgtgaatatgtcaattgtcaaaacaggaacaatagaataatcaagaagcacattttagcaagctaggacaccttatccagataaaaggagtaatccacttaaagctaaaactttgcatactaggaactcgaggcagcagctatgactggaatcttagaggcagcagtgaccaggaactctagatggtggtgttgaccaagacctggaggtgacaaagatggggagctcaaggcggtggtggcgactaggatgtggaggtgacggcgacagggagcttgaggcggtactgcgttagcgattgggacctagaggccgtggcaaccaggagctcaaggtggatccagcgatgatcaggaccttgagtaggctaatggaatggaaggggatcaagtaagagttttcaggctgagcgctggcagtgggtatgatggcaaaggtgggtaaattactcaaacaaatcccacaaaagccatggaggagcaaggaaatgagatctccttgtcttcatgaatgggcttccttttgtgagcaactcctgggatgagctagccgtgtgagaagtttgctagcttttttctgttcaaaagctggctaaaagctgtcccaaaggaggtctaagacaagactaccatatagcagcgcaaagcacgtcagagtataattttatgtacatcaactcaaaatgagctgtgcatagagaacttaacaagtaattgtaccatgatcagataacaagtggtgaggttatcttcatgaaaatagataggtctcttttgtttgcaacaaacaaaagaatgactcgatgacatttattcgtactaatgctaataataacacacatgatcaattctaccaatataaaaagattccaagcacaaggtggcgtagcaaatgaaccaggcagagacacagtattatagtaacagacttatacaataaaatgtacttgtgtagaatatacgaaacaagtggacatggctattatgctgtgcatgtatcatttgatacccatgtgaaacttctagtcaaaccagcaagacaccaaagcagggaaggaaaacaaatgagtactccaggatttacacaaggcaaaatgcagtagtaactaagtgaagttttaaatattaaataacaaacatgtatacctcaagaaagacagaagtagaccaacacaagtactcagcaaccatgcgatgaagccatactgtagatgggaaaagaaaggaaaagtcactatagctgaaaatccacgaagattttgaaaaaaaaaatcaactacatggtcaaagtaagataaagcacacattgtaatcagatttgatattttgtagacgagttaaggaggacagaacatatctaaatgtctagtgaagaagcaaaaggacttgtcctgccatgattaaaaaataagtgcttggtattaatacgacaaatatatttcttttgttcaacatcaccttccgaggtttggatgtcatcgtcatctcttctgcacacagggaccaaatgaatgccataatggagcagacaactggtgatagaagcagtatcgagaaaccaaactcaaactgccaaattcgaaaaaggacactcttgattaacaacacaatcaacatttcaaagtttttatactgtctttgcaacaaacttacctgttcatgagttgcatttataaccttgatgggcttcggtcgatggacagccacagtaactgtttctatgatgaatattagggtaaaaacaacaaaagcacgtattggtgaacctgctacttgatgaaacatcagccttgaaagatttagccaattttctagcccacttctcctaagttcctctgatagcgagatctggtttgcaatagttgtatctaacctatctgaatcagtaccagtgacatctacatcatcttgatgctctctgtctgcatctaagctgcttctctgcagcaaagctaaaattcgtgggtccataaccttgtctttcatcatataggaaaaatttggatcaaggcctttatcctgaagaagattagccaattctacatctcctagtccaccattcctttttagcatagatgtgattcttggatcattcagtctgtcctgaaaaattgcagccaagttcaaatccaatagctgctgattacccgaggcagtagctgatccactagactcgcagccttgactttccaaaccactactagagcaaacaacgagtgaagcagttgggtccccatgcctgtccgctgaaactacagcagtttcagggtcttgtacagctacagcagaaaggcacgaattactgcgatgggctaaactggcacgtccactatctatgttcttgtcagagctctgtccttcttgacaactattcgatcgatcaaaaggaacattgttccaattgacacaatcgctttgtgagttgcttctgtacatagaatcagtagcattgccatgaggaccagcttcaacactgccactactacgcttcacactagatccacagccatctgatgagtttgaagaactagtttgccccttccttcgaaaaccttctcggagttttatcactgtgcttcttaatgcatctatccttgcaactgaggggtttgaaatagaaagccagcaagagacagctgcagctaaaagcacagatgctacaaaagcataactgatgcaatgtccaaggtacctaatgtaacacattaattagtaaacacaaagtactagatcataaatatgttcaactataaaagcataaagatgaatacaaaccagtagtgcaccccaaagcatataaggaaaacccttgatgttccagctacaaatagcgctatcatccgacttttaagaagctcaaacctaaatgaacacaggcccaaattccagtctgtagaaaagaaaataagatgtcaaagaaatagatacatcatgcacaattagagatacaaggccaaatcattaccgagaatcactactgcaactgaagttaaagcacccagccagcgtgcttcttttgatgtcagaccatataagatggaatagacaacaagaaccatcaatgagcaaaggtaaagaagccctagatgcaagaccctgcattttaaggcattgatatgttaccaaaactactagaaattattgcttaccccagtaacagcataatagaacaagcacgttacttggggaacatatatgcctatgtagtatttaagagaggaaaaggtagtgaagtcacctgctggattttgtcatgtataactcactaggatctggtgggtcaggcgagcatgaaacaggggccacttcaacacaatcagaatatgcaaatttgtacaaccttcggacatactcatcaacatcgaatccacttcctgtacatgtaatgtatgaaaagttatgtttctcaaattttttatttacaggtgataagaaattcagcaaataaagataacggataagaattttaccattgaacagtattttacttataaaaagcatatttatggccaatgaaattgcagataccccaaagaagaagccagatggggaattgagctcagaagcactagcaccggttgtaacataaacagcacaaaactcataagcgcacagtagaccgactgccaggagtagaagataagcaacagcctctgcaacaaccaacatttgttaacatcagtaagatattaataaagaacaatgagatgatagagcggcccaattttgcagaaacagcacatacaaaataccacatgaatcaaagagttagaaattgcagttttataaagtgagaaaagttcaaatttgtagtagcatactagtatttttaatcctccgtgaagctttaaaagttttcctttgagtatgccaaaatgttccatttataccatttcctagttacaattgtctagaaacaaattggacccccaaaataagcagagaagtcctagacaatcatcgcctattagaatatcaaatttaatgaacccatgacttagaagtcatgaataaacagccacttatcagaatatttggtttaatgaaaccatgaccctaagtacaagcacattgagtagtcatcacaaaatgtcctagaaaataaaagcatgtaaacagtagaaaacttactggagctttgccattgcgttctccaccacaacattatagagtagaatgacagaagcaaagcaacaccgaccattataacagctagcccaattatgttcctttccaaaagagcaataaggatgcctccccatactaacaaaactgttattggagaaacgacgacaagccatgcaaaaagagtgaaaaagctgcacagtgtgcttagttgaggtccttgcacatatgctggccatttccttgcatatatccaactgagtaacaaaacaagaacgaaaatgttagtagcttaatgagataatccagctctcagaacatcaggaacaaatcaacataaacaaatatgcatagaagatataagaatagaaaaacatcaacgtttttcagggcactacttgtgattgtagttagacacaattacatgatcgtattccataatctacatatgaatggcaggcttaaaatatataaggtgtggtgttggattagcagcataataaagacacaataaataatttcagttgttagagtgataatgataccaaatctacattgttgtatgcactctgctggctgaaatttatggaaacataacgtatgattaataatgcaacctcgcagactacagatgcaaatgctagatgccaacagaagcacgcctaatctcgagcatacctatatagcctccacggcctccagttcacagcccataggatccaaaagctgagagggccaaggacagcgaagaggaaaccgcagatgctgcaaacaagaacaaccccgcggtgttcctccttttccatcctccccctctgcaatcaccttctggaagctgatatcatgtatacaggctcaaacaaacctgctaaaaggtagaacatacaaggtccaatgatcaaaagaccaaatatacataaatgacactaagtatgcaggcaaccagattagtagtaattactaagttaattaagacaaactacgttgagttcaacgcatatggtaatattttctcaaaatattggcctaaatcagtccactacaatttacatgtaacagatcaatatatattctatatacaacaaacacccccaaagtcccaatgtggacatggctttggggttttccttaccaaacctaagcaccgaggatgagaaacttaagcttaatgcattttaatgaagccaccagcctgggtgcggctaacaactaaaaacttcactacctaaaaagggttattctgtgcatcacccaggtgctatagccctctaaatatggtatagataaaaaagaaatcccatgtatttgttctttatgcatacaacactacagattaagcccttcaaatggataaccaataaactaaacaagttgattgaaaagcaccagcctgccagctggagttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattaaaccatccagaatgcatgctactgggtcaggacagatccaaccttcattgcccgtcataaccatcaaatctctatgcccagaatatcgcgagctgtacaaacacactaaatttcaccaagccgtttgctgcatgccctcccaaaaggccaccaaatctgtcaccgcgcgccaatacaatccttctaagcaagcggcctaatataggctagaggacgagcagccatcgcgacctataagccaaatcccactaaaacctcaaccatcttccgcccccgcagcactccaaacacgccagaaagaacatctcctcagaaatccgcacctcccagcagccagtccaaccgtcggaggcagcagcctccgcgcgcacaggaagcgcacccccacaattccaccaaccccccgcaatgcggcggccccggagcccgcaattcccgcgaggagcgcccccgacagcacgccagccccgccagatccggggcgccccgccgcggaagcccccgaatttccgcgcgaaaaccctagccccgcggccgcagaagcagaaacagcagcagcaacggggcggcggttacctcagcttaggcgccgcggccccccggcggcggcgggcggggcgggcctcctcgccggcgaccgaaaccctagggtacggcctctccccacttttttctctctcctcctcctccctctctccctcccctctctctctctctctctctcccctcacgggatggcttcgattcgattcttctccgtgcgcttgctcgcgagcgagacctgtgtcgtgagcgagcggagagggggggagagagagagcaagcgcagcgcggcggggtgggggagacaaagagtgacgtttgtcaacttgggtgggctgcgtgctgactggtgtttggttggtgcggtacggtacggtgcgtgtgcgtgtgcgcgagcgtccgcctgcgcgactgaccgctctcgcttcggcctcggcgcgagcgagacttgggctctgctccgaccgagcgcgcgcgtccgcgtctccgcgaccgagggggagagtccactccactccacacaaccgcgagctagacgcggagccagcaaagccagccagaccagcgaggcgcgccgtttcccgtgcgataacgtgcggcttttcagcgtgtttgctagtgcgaaaggccgtattttgctgcgatttccgcgcgcgtactcgcagtgtctttctggactcactgtatcttgtgactttttaaccgggagtgtagtactttgtatggatggcagtttgtatcctaatgaaagaagatacgtaaagagagtggacatgatgaaagtcatatacgaagtacttgacgtgagatgtaacaaaatacgatagtttcctagcgtaagaaattttggaagactttgaaggattggaccgagaggaataaacggtgtactctctctgttccataaaaaaactaacttaatactatatgtgacatattctactacgaatctagacatacatctgtacagattcattgtattataatgtgtcgcatctagttctagattcgttttttgtgggactgacggagtatcttttcactatctttgttaatataagattatatacaaaacgtggggccatctagcaatatatggcgggaatgacaagaaacatagtggatatgctacatgatcaggagtgagagtaattctatgtgttcaccatgttgctccgtaaataggttattaagaaagtggtaggacagataaaaggtaactagctaagcgtgatagtttttttcaccgtacattatgttttggatcatacgctagagtttaatacttattttcttgtgcataactaaaagacataacggtaactctaactaggggctttctccatccaggatgatattattagtcatttaagctcaattggcagtctatggtaaaatttatcgctgaagcgattccattgaggtttatcacaagtttgtccctatgtattccgggtgttattgtttactatatcaacttttctgtacacgaagtgcatgcatggctcgcgttcgactcagttacttcagtgcttcgtctattgcacctgtcttgggacatagtggttatgttcacgcacatgtatactcataaagagaatttaagcgggagtatacatgtcccaagttgtgttaagggtttcaattgagagtagaaccaataaaccatagtttctgactcaatgtacaaggctaatgatgaggagatccatattaacaactccatggtcgtagtcatgaattccatgtatgaggtcgacaattaaggcttcatggccgctgactcattgggagaggccaacgaaaaagtgcccgtggttgccgactccatgatacatgcattaatccagctgagagcaatttggtgttggcttagatgacacgctcgacagtatttaataggagtcgtagaataggaaataggaatctcaataatttattgcttgtgaggacatatctaaaacgaccaatgatatcaatccaaagggagtataaaattaaggtggcgatatgtatatacgacggtctagggtaaaattaacgagtgatccgtgactatacatactataatagttgccatggacaacattttcaaaattcaccaaaatcatccattaggacctgttggtagaggtcatgatgacatatcattataatctaatctacactctggttgatcttcagttgctttcatatcaaaaagtataaaatggattcgactttgtacgaaagttcaaaagaaaagccccatgttaacatacgcaatcaagaagcttagggacgtccttcctctatatatccattccgtttaaaaaaaatatgcttcattcatccttcatttatccaaaaatatatgtattacattaacatagtcttaagacttcaattctgaccaccaatttccatgataataaaataatagtactgccgtgaaagtgcaacaactaatgaaatcataacgtcatggagtatctttcagacaaacatacacacgtcgttaaatgaatccaatctaaaacataaaaaaggtatcgacctaggaatgtttttcacaactgacaggaaattattaacattttaccatacacagtaagtaatacagtaagtaaaatctcaaacaagttcatcagataggttttccctgaattcctgatacctaggcaaatagcccaagagaaagaagaacgcccggctagcatgggccgggccgtagcattggttgattgcagccatcttctcgtggcagttacgagcaaaccttgttgcctgcctgggttctgaatcctttgacaggccgtcgtcctactgtccgaccgtactccctccgttatagattttgagtttttacttgcactgtttgaacattcgtcttattgaaaaaaattaaaattattatttattttctttgtgacttactttattatccaaagtactttaagcacaacttttcattttttatatttacataatttttttgaataagacgagtggtgaaacattgtaagtaaaaacttaaaatctcttatattatgggacggagggagtaattccgtaaacacaacaccttgccgtagattgtactatactgctccagtaataatgcttaccactactcctaccatgaaaaccaactgcctggagagcctggacttctgctcaagaagtgaaatcctttacaatgttagcttcagctgttgccgactcgctgtcatttgtcaactaccgccgccttctggtcaccctggacttctactacactgattttgatagcaacaccgcacgtcccatttcgaggttgatatctttcgtacctgcagaatcagccgcgatagaagccaactcggcgatgcttctgctgccgccgccgccgaacgatgattgtagcgtggaattagactggcagagtggcaaatgtagcgagaga

SEQ ID NO: 7807 - DNA, 5059 bp, Oryza sativa
  unsure (1)..(5059): unsure at all n locations
acggacaattcttctgccgtccatgtggtgggtaggcgtacatcctttattgtgatcaccaaccgtgccatgcacgcacacctaacattccggcacaggtctgtctgaaaatgtaatcactgctaaaccagcttaattatcacagcggagaggggtcgccagcccaccacaacttgattatgttattaatcactagtgctgtccacagatgatctccactaattagctctcttatatatctcacagagattttttttaaaaaaaaacagagtcaataactgaagacatgtttccttcaaaaaaaaaggagagaactgaagaaatgaactttggtatagaacatccataagtttgtatcaagaactgaatgtataatttatccattaatcagtgtacaaagaaggggggctgaaatctaagaacttctaatggtaacatgaagaacagaaggatttcaaagaacatttacgattacagactctaccacattgacatacatgtgtgatcctcttggaagcttggagcttggatgtgtagtaggctggaacaacctgngaagccgaggcggcggcgatctccagttcatggctccggcggtggcagctcggcggcgggcgccacctccttcaccacgggcgggggnggcttggcctcccgccgcctggcgacccggcgaggcggcggcgacccccagcagcaccaccgccaagccagcgtggcgcagtcgtaccgctcgtcgggcccgtcggcgtggcgcgcgcacacccggccgagaacgcaggacagcagggtgagcaccagcaccgccgcgagcacggcgaagaacgtgccgatggaccccccgccgccgtggccccgcgccgccgccccctcggcggcggcggtgacggagccttggtagtccggctgcagcggcgccgcgaacgtcgcgatcgccggaggcggaggcggcatcgacgacggcatggcagtggccgccattcttgcatccagtgggggggtgtgatcgatggaatggaccagctgagtgggatcgtcgtggagttggggaggagacgatcagaattcagacgagcatagcatgggatgggatgggagcaggaatggaatattgagaggtttcgtcgaaagcgtcagctcgctttgcaaaactactactactactccacgatggtgatgtgtcgaaggatcagaggaggataggtgcagaaaagttcagaaaaaaaaaagagggagagcaaacagcaaagtctgcatttctgaaactgcaaggatggcttttgtttggatcgagtggaggactacatggaaagggaacaaaagtgtgatggctggtagtcatactatccgtggaaaattcaggaagatgcaaggggttgcgaattaaccttgagaaatgtatacatcagggactttactggtgttgtttgattaacatgcaaggtggtttcccatgaaacatttccaactttacgtttgtctttgtgactttgtccaggcacagggtagatgcagttatttctaccatttgttccatactctcgcccttttccgtttctactttctgctgttgttaattatggatgaacgtcaactttttcttccttgagtcgatgatgtgctgcgccagtcgcaaatactgccgatcaagcccaagcaaatcctactttaaggaggcccaaaggaattggcctgaaagtttaaattgggtctaaacatggcccaaaccaacataaaaactggacgctgctgggcctcgccccacattctcgaggcccttgcactcttgcaggcatgcacagccttatttatccaggccagctgtaaatccttaaaattgagcttcagatttcgccatgaatcagagatgtttcgcgtaatcagaactagctgggtggcccgctcacttgcgcggctagcacctaaacaaaatcatatattttttaagtatgattttactttaaatttattaaatagttatccccgtatcatccccgtatttctaattatatagtttttaaaagtcacatcagctgctaccccttacttctgtcatatccttctttatttgcttgctcggtctaccactatttctattcattctccttgaaacctttaaaaattggatctgttttttgagtttattatttcgttgggtttcgtttttataatttctggaagtctcgtcaaacgctgccattatactcctctatggcccgtccactgtcttttctctttattgtcattgggattttacaaatcgaacataattatcgttcgagttcattttttttactttttataagtcccgccaaaccgtcagcgtttttgccattgtactttttatggctcgcccgctgtcttctttttttattttcattaagattttaaaatcgaacatgattatcattgtttttttactttttagaagtttcgtatctttaaaaattggaccctgtagtttttaaaatttattgtcttgttgggttttattttttataatttttagaagtcacgtcaaacgatgccactatactcctctacgacccatccgacgcctactctttattgtcattgggattcgaaaaatcgaacataagtatcgttggaattcttttttattttctagaaatcccgccaaccgttggcggctctgcaactatactcctatacatcctgcctgctgcttctcctttttattatcattgagattttaaaaatcgaatataattatcaatggggtttattttttttactttctaaaagtcccggcaaccgccttacccgtttgcttcacggcctaccgatggttggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggcgtattactaacagtttttatatgtcgaatcaaccgccaccactctactcttttataggcttggtatttaatttatctcaccgtgtgttttagatggcctcttttttaataatctttatttttatcaccagttttagttatttataaattgcatcctattttaaatcttttttctttttctttttctaatttcagaattttttttaaaaaatatttaataccgaatagtgtgcttctaatatttttatttttcatttttgaattttagttgtttcaaaattgtattcctacttgaactctcttttaatttttctaattttggatattattttattttttattctgaattttaattaatctcagatggggttcttatatggattcttctttaaatattgcttttttttaattctgaattttagttgattttaaattgtattcctacttgaactcttcttttattttttctatttttggattttatttttatttttatttcgaatattaactaatctcgtattgggttattatatggactcttttatcaatattccttatttttaatttctaatttcagttatttttaaattatattcctacttggactctcgttttatttcctaatttcgtattttattttatttttatttcgaatttcgattaatctcgtattgggtttttatatggacacttctttcaatattgctttattttaattccgaatttcagctatttttgaattgaatttctacttggactcttcttttctttttctctgattaatgtgggaatttatagccctacagcgaacgtagtgccttagcatcattatattttctctcatataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaccaaaccttatcatcctcgtgtttctaattatatagttttcaaaagtcacaccagttgctaccccttatgtcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcattgagattttaaaaatcgaacataattatcgtttgggttcattttttactttctagaagtcccgccaaaccatcagcggctttgccattgtactcctctacagctcgcccgctgtctcccttctttattgttattgagattttaaaatcgaacatgattatcatttgcttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatcgttggaattcatttcttattttctagaagtcccgtcaaccgtcggcggctctgcaattatactcttatacaccccgcccgctgcttctactttttattgtcattgagattttaaaaattgaatatgattatcaatggggtttttttttactttctagaagtcccggcaaccgctttccacgtttgcttcacggcctgcttgacgtccctccttttaatcgtcattaggattctattttggtgatttattaacaatttttatatctcgtatcaaccactaccactctactcctttatagctatgttacttaatttatctcgtcatgtgttttagatggtattttctttcaataatctttatttttatcacaaattttagttatttataaattgtattccaaattgaaatcttaat

SEQ ID NO: 7808 - DNA, 3451 bp, Oryza sativa
  unsure (1)..(3451): unsure at all n locations
atttttaattcgaaatttcagttatttttaaattgtatttctactgggactctcatttccttttttaattttggatttttattttattgttatttcgaattttgattaatctcgtattgggttcttatatggaaacttctttcaatattgcttatttttaattccgaatttcagctatttttaaattgtacttctacttggactcttctttttcttttttttttcttttttttccgattaatgtgggaatttctaaccctcacagcgaacgtggtgtctcctttcaaagctgttttaataatataatagatagatagatatggacgctcagctgttcagtttgcctggacaatgccttatgcttttctattttctgtttaaaacaggtttgaacaaaattaaaaagaaaaaagttgatctctcccccacgcaaccacatcatatggtccataatgtttatatcattggctaatttttagtctaacagcagctttcaaaccgcattcttttttatttgactatgttgtactactttatccaagcctcagctgatgaagaggttcagagagatatttaattatttacactctttaattattccatatcttataaacaacgagtggtaaatagttaaacatgatatcttaaaagtagtaaatagttaaatgtttaggaattaaaagagagaaaccggtttacgggccgtcataccattaccagcagaaaacgctcgttaagattcacgggaaatgcgtggctttacctgacgcgtgcgtggcttccgtgcatgccttattagctccaaagaccaaaacttcagtacaagaaacgccaatctaggctagctgttagttgcctgtttaagggagatgagcaatgagttggcttgaaagaatcaacgagatcgatccgtcaagccactcgagcttctcaagcaacctaaactaacacctccgtctcactcctccaggcacgctagccacgatgcagttaggcatgggctagctatagctaatagctaagctcgatcgatctcttcttctcctcctcctcctatccactgtccaaaagacggtgatcgatctgtctccgactgccgccgccgatgtcgtcgtcgtcgtgcgcggcgggcgccgaggccaccgggctggtggccatggactgcctggtggtgtgctgctgctgcccgtgcctggtgctgcagatcaccgtgttcctcttcgtcaggctgcccaagaaggtggttgtcaagtccaagaggatcatcctccggagatggcacgggagaagatcatcatcatcggcggcggcggcggcggccaagagaggctgcagcacggtcgacccggctgcaggcgtgaagaaacagctggaggagctatttgacgacgacgatctattccaaggcgcattcggcggcgggatcaacggaggcggcggcgacgacgaggaggggtggtggaaagagaggtgcttcgccgtcgacgacgacgacggcggcgtgtgggaggcgctgatcgagcaagaggggctcttctggttcgggagcttctggggccggacgacggagcaggtggatcgtccggatcagtttggagacgacgaacatgcccacccagccttgaggtttcctctcgttctcgagagagtttgtgactaaattagctagagtacttaatttatcaatgcaagcttaattagggacagtcgcaacataattcaggcgttgagctcggtttctggctgatgattgctcattgagttcttaatcaattacatcctgttccggccatttccatttgcatcgctcttcagtggacaactaacaaatcacaaatgtacatgtcacaatattaacttcagagtcgagaagggacaatgaataaaaaacacacggcattaagtctgtaacacagacgctgacggagccattttctctgctggcctgcatgcatgctcaccctgcacctgcagcgttcacttggtctgtatattttcagaggacttttgatctncagacgggaggtgttttacaacttcgcgcacacttaacanatcacaaatgtacatatcacgatattacccatatcatatatgacatgtatggataaacatatcacttcacagacataatacatagaatgtaaagttcaatctacacaatactccaaaatacacaaatttggctatgaacaataatgttgattgaatctatttatgttcttttttggctgtgtggattgaatctgtatgtttacggtgttcacattctaaaaaaaagagtaaaaaatcaattgtggtgaatgacatgtgtagaattaaagcattggtacaggtaccaaggataaaaatatgattttgctagtagagaaaaaaaagaacataacggtccctaaatttaaatcggtataccgcgtaggtactagttaaagtcgttgtctggtattggcgtacatgttcttatttgcgtcatttcccctagatatacgtcacgttctctaagattctcattcacatggtttcctatatatttttgttttattccaaataacacgttactagtgtaaaagttctcgtttgtatggttttctttatatttgtgttttgttcccaagaacgcgtcaaaactcctctttttaattattcgtgtcacttagatcttgccatagcttctaccatgtctccttgcgggtgcacctgtccaaaatgtagaagaaaaacatagaaggatatctcattccagtcccttatacaacaaaatttatgaactatatgtaaataactaatcaactacataaaataaatcttatttgataagattcgcttagccattaaccgttcgatctcgtcccatgttgaatcctcaaccatgtagtgcttttccctttgtttcattccagtgaaccactttcaaccctataacaagaacaaacggcgaaaagatagaagaaataagacaacctatttttccccataagatctattcaatgcccaaattaaacgcatgatttacattttttccaccaaatgctaccgagcaatgcaaccaggtattcgattcactcaaaatgcccatattttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacag

SEQ ID NO: 7809 - DNA, 711 bp, Oryza sativa
tccatggcccttactgttttacctctcattacctctaagtagctcgcaggtatcataaaagctcttgtggaataaattttttattttgtataaccttttgataaaagctctcgttgtatcaatggtatcacggtttttattttgtacaaaccttttgattgatactcctccgagaagcaaacgagtacgcatgcacttggagttatagaagcccattccccaaatccagtcaccgatccgttaggttccgtgttagctagctcccagagcgtgccggcgacatatgtatcgctgccgaccgccgtgcacacagaatccatccagtcggtgcgcggtgcgccgtgtctcggtcgacaagcgacaccggacaacgacctcagctccacgcacacgcacgtgatgattggattttggatcgtatacgtaccccacgcattacgccaatataggctcgcgtaacaacatcaaacacgcccgcgtccgtcacgctttggtcccctccgcaaccagccgccgcctctgcaaggcttcgtccgcgggggacgctggtgagctggtctgcgcagctcacgcgccgcgcgcgcgcgagcgaaaacaacgccgccgtgtgtcgcgactcgcgacgagccgacgacggcgactacaacgcccaggcgaccagcggcgcggtgacgggccactcctaaacgcgagcgtcgtgagtgggtcgac

SEQ ID NO: 7810 - DNA, 956 bp, Oryza sativa
ctttattagagtaaaccctgaaggattccagtccaggttaatttcatcggttgttggaagagttagatatcttggatcattccccccaagttgcaataggtcatgcagctcttccactgttgtgaattgccagaaagacacaatccaattgtttgacgaaatttcaaactgcacacatcgttgctttcgtttggctaaacgaaaacagagaggagcaacatcctttggacataaaccgttaacctgtctagtgttagtagtactcagcaatgttagcatgtgctgagtactactgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgcttagtccaaagcctagcaggatcagaagttaagccgagaaaa

SEQ ID NO: 7811 - DNA, 14812 bp, Oryza sativa
ataaccttttgcaggagtatgaggatgtcttttcagctaagataccccgggattgccacctatgagagggatagagcatcaaattgatttgattctaggagcttcattgccaaaccgcgctgcttatcgaaccaacccgaaggagactaaggaaatgcagcagcaagtccaagatcttttggaccgtgggtatgtacgtcaaagccttagtgatgaggacacaactagctcagatggaaccaagactaccttatgtattaatcaaccaaacgtgcatatgttctacattagttttacttgttatatatttgaacaaccattgctgcacaaataagtttcgtgtgtttttgtttgcagaggtacttgcttgggcgaaagaatagagaccgagcgtaaggaatgcatggatgattgaagaagttgattggggaccaaaccaagaacttctccaagtcttctttcatcttaccacatcacttttagtccatagaagacaagaaataaagttctacacattttggattcagattcgggcctcctgatagcatcaacttaaaacggacctagccgctgatctaggaagaatttcggggcccatgagtacttgttggaaagattatggagtctactttcagatggacctcaagagcgtacacgttcaagaagccggatcgatttgtgtcgtgactctgcccaaatcattgtttatcagaaccattcggaagatcgggacttaacaccctcattagttggaatcacagcgcggttgcccattaggttatttatcttcctataaccagaaaattaccacacaaaaatatttattctttacctagacaatttgagctgttgcattgttctattagtttttgcgttgttaaattatagatcgcatcatcgtgtcgagtgttggtttagttttagatttaatttttagttttgagtattgcatctgttcatcacttaggtctagggttctgtcgacgtttgatagtcacgactagggtatttggatagtatggggatcgttggtaccagggtatatgcgagattgaggtaaaagagatagagacaagaatttttatacaggttcgggccccttatctgacaggtaatagccctacgtcttgtttatatgggattgatatagaaaccacagagtacaataattgggagaacctatcgaatcattgtcgacttggcggatagataaccaactcgtagtcgatgaaaggatagtctttctcctcgagtatgaactcgtcgagatcagagatggtgctagatccctcttaccggcccctgtaggcaccgatggggttttcctaggcttatctctgatgtcgatatttggcgacgtgtgttggcttgtagctttgtggtgtctattggtctgtcccctctcctcctaggggggcttgtatttatacccatagatgcccccttatccaagtaaaactagggagtcaagtatggatacgattcaagtactcctcgtcgtttccatatagaactctatttgtccttccttatccagaactccttctatatacgaggtttgtttccgtataagacttggtatatggtgggccccgtcgagcttagtcgattactattgggtatgtggtatccacaaccctgtcagtagcccccgacttcaatgcaaatgaatgagttcatgttctcgaccgaagactttggaataaccgttgtcgtactcacttgaccgttctcggtgtaatcagtgatagcgctagattcctcttatcggcctttgtaggcactatattaggtttggctagtttaatctccgatgtcaaccgagaaggtacggagcatgcgactaagtcttccgtctcactctaatcgagaatttggattgaagtcaagaaattttgtctcggcaggtacaccattgcttcattccatattccttgtcgagctccatcaaccgttctcgagtaatcgagtaggcgtagagtctgcgacaaagccttgaagtctgacttgattgttctgatgtctgattttcctgaaatcaatacccaaaacatttaccgtactcgcttagtcgatcccggtgtaaaaccgtagagacacggagtcttcgacaatgttgaatagaactttcctgaaatcaatactcaaaatagaatattaaatagaaatagcccccgagcgaacgcttaagggcaacatgttataatatgtatggaaatatttgaaaataaattgaatctgcgtgtgacaataaaagagtacgctcgctagagttgccctctgcaaacggagtttggtactcctcctagcccccagccttgtcctcggggaaaccgttctcggaggggaaggctcgaagactcgtaacttgcctagctgaaaaagcgatttacctagcccccagccgtgaagttggaaaaatcaattacaggttacacggcttagttaatacaccttttgaacactcttacatgaccaggtcttacatagtcgtttggctctcagaatctgacaagaccttatctgctttgggcatccctagccgaaattcccgtaggtttctcggaggcttgtcgaaacggcgtaaagggtcagtaggttcgatttcaagagtatgtgttatcgtggtaagggatcaacggacaaatattgcacaaataaacacttacataagttgatgtatatgaagtgatgagacgacttccacaccggtgaagactaggtgtatagttgtactcaacaaatcgcagaggtaatgggagaatcgctacgccgctggtcgaagaccagttgtagctataactcggccactttaagtggaggtacgagagatcgctacaacatactagtttgagaatcaggagtagcagactcttgaccgttttgaagttgaggtacgaggatcgctacattgctggtcgaagactagtcgtaatcgtacctcgaccattagaagtcgtggtatgaggatcgctacgttgctggtagaaaactagtcgtagtcgtatctcgaccacttgaagggaatctagtgtaatagatggacgacattctcgtgacctacgagaacagcctcctgatgacgatgaagacaatgaggaattatcgtagtcggagttttagctcctggatctactacctcgtcctcgggccctctacaagtctagggatctcgagttttgtcgacatcgtgtgatgtcgtgatgtcgttaaccttgtttgttgtcgtcctgatgtcattaatcctggatgttgtcatcctggtgacaacggcgatctagtcggtcttggttgtcactatcacgacaacgctgatttagatgtcgagagattgctactatccattggtcgaggaccaggagtaggcgtatctcgagcacctgaagatgaatttttaggtggtgagagatcgctactatctactggtcgaggaccaggtataggcgtatctcgatcacccgaagatgaatttttaggtggtgagagatcactacgatctactagtcgaggaccaggtgtaggcgtatctcgatcacccgaagatgaagttttaggtggtgagagatcgctactatctaatggtcgaggaccaagtgtaggcgtatctcgatcacccgaagatgaatttttaagtggtgagagatcgctattatctactggtcgaggaccaggtgtaggcgtatctcaatcacctggaggggtgctaaagttggctattgcatgtgcatctcatgtggccagcatgattcacatacccaacttgcagcatatccgcggatgtttgttcgcaatcatgtcgggtgatcaagccgacgtcgttcgcgagggattatccgttaacgacatattctccaataatccggacgtggccgacgctatagatgagataagtcgtcggtcttcattggtaggttgggtacgacaactcagcgtttttcgagaacgttctcgataatggggtgtactcgaccacctcctactcaagtgctcaattgttcctgataaatattttatagaagacaagatatatagcagagaaaatcgagtatgtactaaaaaaaactacgtaaatcttctagtattatcaggatataatgagcagattaaatatcaagcattatgtaaaccgtaaacaagcatgatttatactgaagaaaatagggcgagcccccagtattaaaccgtagttggcttaatattggaaacactcgcacaagaaatattgtataaaaaacacgtacgctctagataaacataataaattattgatctgacaatattgtatatagttgaaaaataggtacggtaaattgtatacaaaatattgcgtactttgtagatacatgccggatgtctctatggaatcagtagattaatttaaaaaatcaatatactaaataccgctgttgatttgtttgaatattgtgcaggcgtactgtgcggacatgtattgatgtgcatacaccaaacatgtaggcccgtggataaatgtcccctgagtcctgattggctggcacggttgtcatgcatgcatatgttccgtttacccaactccagtcctaaccggacacaaggaacgaagcagtgcagatcgatctgtgcccaagtcgagcttgccaatccttggatgggagtcgtttgggacagcagctgcacggctgggtggaggtcggtgttttcttctccgcgacgatgattccgatctcatcgggaggcgtactccggttgggttaggtctccctatacctgaagtcgttgagtggtatgtcgtcggagaatccatctcttaaacccatctcgtcgaaaccttgaagcaccaaaatccccatacttgacgtgccactgtcgacgtttgatagtcacgactatggtatttggatagtatggggatcgttggtaccagggtatatgcgagattgaggtaaaagagatagagacaagaatttttatacaggttcgagccccttatctgacaggtaatagccatacgtcctttttatatgggattgatatagaaaccacataatataataattgggataacctatctaaccatcgtcgacttggcggctagataaccaactcgtagtcgacgacagggtagtcttcctcctcaagtatgaactcgtcgagatcagagatgacgctagatccctcttgacggcccccgtagacaccgatggggtttgcctaggcttatctctgatgtcgatatttggcgacatgtgttggcttgtgcccctgtggtgtctattggtttgtcccctctcctcctaggggggcttgtatttatacccatagatgcccccttgtccaagtaaaactagggagtcaagtatggatacgattcaagtactcctcgtcgtttccatatagaactcttttcgtccttccttatccggaactccttctatataagatttggtatatggagggccccatcgagcttagtcgattactattgggtatccataaccctgataggttaatcactaagtttgtgagttgtacgtcagttttgggtccagttttgcatctcgtcggttgttaccggtaccttgaaaaatcgaatctactcatcacatggtttccgtttttatagttttcacaagttttcgttggtcggttgtgaagttacatgattgcatgaaggggtagggtttcctgtaccgtgcacgaggaaatagattggtttctgttaggagattagtatcgtttttctccatcagagttgggctccctcctctagtccgccgtggctgaatccaccgtggtgggttcaggccgaacacccatccattcgactcctctccttctagatcattctgtttggtatgctggttaaggaaaaatcttcagtggatttgtgatatttttataaaaactgaacctacgtaacgtgatgtaacatcctgaaaatgtgtcattttctaatcttgcatcatgccgattcttatgttcttaataaccttctaaacctaggaaaatataattagcaggaccttctaaaactaacttgcataaaaaacttctatggtatttaatctcttttgtgcttttcaattaaaaacatatttggtatttcttgttggaattctatttttgaatattagaccttctttcgactaaaacacttttattcaaatttagtttgaaaaccatttttactattatgaattatggtccaagaaatcctccaattttgccttgaacctaaaccaaagtaatttcaatctcattggaattaattgttagcccatcctttgatcttaaacctatcctttgattctcgatccaaatatctaaattcctccttttgatctagccaccaatttaatctttgtggcttgatttactcttcggcacaagaatagtattattgcaaatattgtgaataattgctcttgtgctaagaaaattccaatttatattcttcactcaactttcccttttagccacaaatatacatcacaccaattttagagttcaaatcctatttattgccttcaactaattcccttcaatattcccaaaaatatttcgaggaatattattaatttcccttcctatttgagtgcttccaaataaattccctcaaactccacctctaaatattgcactcaaataaattaagaaatctcctttgtgaattctttccgaattcaaattctttgcaaaacctagttatccaaatcaagtattcaaattagacttctttctttttgtcatcgggccaaaatttcctttccttcttcccttggcccatctctcccctcagcccaattcggcccacagccgaatcgccccccctcctcccagtgtgcgtgtcgtacacgcgcacggcgcacgccgccgcaaactcctcttccgtcgcggctaagaaacgaagccggcgccgtctctttctcctccactccaccggcgtcgtgaccctcttgccctcctcctccaaaccgacgttcgccgcctataaatagccggccatccctcctcttttccccaaatcaaaccgagctctctctctcctccccatgtcagccactggtcgatctcctccaccggtgccccgccggccaagccattgcgccatcgtgttttcctcgacgaggtgaacccatttttcccctttcccttctcttttagccaccacaacaagccaccaccgccactccttttgttgccacggtcgagctcttgtcgtcgccgttccggccttctccttcactctctccgccagccaccgccctccccggaagcgtggtgttcgggaacaccacccgccgccggcgtcgccatcttccagctgccggaaaaccggcgcccctccttcccttctcctctgttgctcggctggaaagagaagaaaaagaaagaagacgggaggaacaaggagaaaaagaaaaagaaaagatactgacaagtgggcccctgcacagtactatttctcattttctagatttaattcaaatcccaatctttagaagcccatatctcctaaaccgtaggtccgattccagtgaaatttggacctaaattcatataaattcaaactcttcattttgatatcaaatttgctattttaagattttatttgaatttccttaatttattcaaataccatttgaataactatttgatttaatcttatatttgaatttccaacttaaacttatatttgcttttcaaatattttcttttctttccaaaataccctttagccactaaaaagccgccggttggaactttacgccttccatggggatgttcgcgtggtctacgggcctcaacgccgaaccgttggttgtaaagcccggcataaaccaaacccaaggtcgaagtgctgctcctggcaccccacgccttgatgcgtatagtggtcggagcttcactatcccctcgacctccattgcacgccgcacagttagctatcgggctctgtgtgatcctagccgctccgccgtcactcacggttgtcggagtaacacttccaccccactaaacctgcacccacctcctattcttctagccgaaatgctatctatcgacaccggctagaaattattccaaatctagtcattatactgtccaactctagcgacgagtagcaaacacctaaaactctagccgatatttatcctacctcgatgtcggcctaaacaactaaaccctagccactattctacaaaagcccaaccttgacccatattagccacatacctatttaaccatatcaactatccagtatatttcctatcatccaaaccacgagagctttcacataaaatataagcaacattagttgcttgattccctttttaccatagcctccaaccctctagaacctccacataaaatattagcccagtaatccctataccctataaaagagataggttataccttaaaccctagccctcttagttgtttatcgttttcttattattttatggcttttattgaaattggttcttcctctttctcagtagagtctattgtcttttggatggcaacctatggtatttcgagaatcggataaccaggttgcctatcttggatttatttgcgttggagcaaggcaagttattattcctcccctttgagcataattatcctatattctacattctattctatgcattagccattcatgattttgaatgcataatctgaacatatagcaaaccagttatatgctagcttttgcttagccctgcctagttagactgcataaaatataatgaacttagattgggacagtacgtaagatttggttgatttctaggtggctagtactgtctccgtcgatataagtttaccaagtacttatgtcaaacgaacgagtacgaccgcagcttctagaatggggacagacctagatattatgttaatttacaatgtggtacctctgtacagtggttcttatgtaagtcctcgcgaaggaggcaaatatatgccgcgaagggcaaatgtgatatttaccgaggcgtaggtaaatatcttgattatcgcgcgatgtgtgtgtgattttatggaaacctggttgagatgacgtggggtctcatccagttctctctaaaaacctcgggaacgccagaactcctcttgctgctgataacgttacgttcagagcgcatggggactagagttcgtggaacaggtaccacaattgttaataacctaatactgggccatgactaagctaatgattattggcaagttatggactgcgggtaaagcgtacatctactgcagtatgaatatccttgaatctattcgaatagccgtgctcacggatttgagtatcgggactcatatggtaatttggttagaaatataattcaagattttcttaaatatcgttgcatatcaaacatttcaggatttctacctctttattctcagctttctgcaagtaaatctagctctacacatatattacatctcatacattcattgttgaataatataatagcttgctgagtacattgtactcatccttacttcaacccctctttttcacaatctattcagagtttttgccgaagctggaagttcaatcatataagttagttccattctaacttaattcataaatatagattagatagatggtttaagtctataaccaaacattagagttggttcattctatagcttctgttgtattagttagccacaatcttgtaaataccctatcattttatgtaaagatatctcccttggagttttgaccaaatgtatgcgatgaagatccagattgttgaacctgtatcaatctactgatccagggtttgatacagttaaacatgtcggtttctgaatcgttagttttgggagccgacacgtgagtattccagttttgaggggatctaattttagttttgcactttgcatctaagtccctgtaatatttatatttacatttgagtccctattcgaggtcagcggttagttcttgttaaaaaaatagtaaaaaaaataaataaagaaagaaaaggcagaaaggtgcaaaggaaaaaaaaaaagaaaaagccgtacctacaaaaaaaagaaaaacaaaaggtagaaaggtgcttaaaaaaagccgcaccaagaaagaaaaaaaattattcatcctttgagtatgtttttagagtgcagagttgtgcattgaatcatatctagtccttagtgttgtcgggtgcttgcttgagttagggttgagtctaggctaggccagcacattgactagtactttgaactattattcaactttgcattttctgataagcacaattgcattcctttgctactacatattgtgcctcccaagctccacatatatacttctggtcagcaccactttgatccttgcaatcgccacatcacgtccttcaaggtatcacgaaccagccaccggttgtaccgtgcttagcattgctggtaagacacttgtaagagcttgataaggtgctccatttggctgagttgttgagaggcaccactacaccgcgtagcagattattagggataaccttcactgtttgctgctgtttttgtgtttgcaatgacaggtatgattggcgctcaaaatcagcgagaccaacaaggtaacaataatcgcgtgcccgatgatccttatgctaaggttaagtttaaaataccatctttttcgggttattacgatgctgagaaatactttgattgggagatgacagtagagcaaaagtttagtgcccaccgtgtgcctaaccaacatagagtttgacaagccagtagtgagttcaaagattttgctatcatgttgtgggctgggttagctgatgatggagttttacctactacttgggaaagaactttaggtagctaagcgtgatagatttgttcctccatcttatcttagaggtttaagcaagaaactgatgcgttaagaacaaggggataaatctgtacaggattactatggtgagctataaaagggattgatgcgatgttgcatagtggagggaactgaggatttcacttgtcgcttttacatgggattttggcgtgaaattcaggacatagttgattatatgtaatttaacactgtcaaccagttgtttcagtgtgctatgtttgtagagaaggaattgcagggtcgtgatcaataggtcaagaacaaggtgagcacgtacacgccacgggcgaagccatctttggggcttccaaaacccatctctttctgggcgcccccaccaacgagcaagcgaccagttgcgtccagagtttctgcaacgcgaaaaccaccttccccacgacctgcagatttaggtaaagcttcttcgcaggtatctaccaagagtgcctcatctatcacttcgacggtacgcacacccaggattcagtgccaccgcttccatggatttagccatgtgcagaaggtttgccctagtcaacgggcatatgttgtttcagtgtgctatgtttgcagagaaggaattgcagggtcgtgatcaataggtcaagaacaaggtgagcacgtacatgccacgggcgaagccatctttggggcttccaaagcccatctctttctgggcgcccccaccaacgagcaagcgaccagttgcgtccagagtttctgcagcgcgaaaaccaccttccccacgacctgcagatttaggtaaaacttcttcgcaggtatctactaagagtgcctcatctatcgcttcgacggtacgcacacccaggattcagtgccaccgcttccatggatttagccatgtgcagaaggtttgccatagtcaacgggcatatgttgctacggaatatggctacatcagcacctccgatgttgaagacgatgaggaggaagagaagaaagacgaagaggaaaaagacctaaccatatagctccatgcatgcttgaggaatgtttaattgaccaagcgcctataatttctgaagatgagaaaaaaggtaatgataatggtgctacaactactcaaggtgtgcatagttatgatgtgccaactatgtccactacttatgctacgttagagcaacccatagtggaaacaattgttgaaatacctttgtcacaaaacaaattgcttgatgtctcttgtgataaagaagagttgtgcgatgcttcacttatatccatgccacaactagtgaatgaacatgttagttctatagtagagccaccatgtgttgagtttaaacatgttattcacattgctagcgagaataaagagcttaaattgctatcttctttaaatacttggggttatattcaatttgatgatctttgtccactcaactgtttagagtagaaattattttctagatttgaattgccatgcccttctgatgtgatttttcatattactggcaattatgatagtaaaggagaatataatgtgcatcaagtatatatttgttcgaatttgactataccacattttcatgatgaaatgtgttgtctagaggactgcatgcttataagtaattctctatctagttcctctagttgtttaaataagttataggttggtttgcaagaagggaagtgtggtggtttttcgactaccaagatttcaggatccaaccatatggccatcaagaaattttcctcaacggatgttgaggtaaataaagataagttcaatacactttatgacaaggtgaaaccgaggacgaattccaatctagaaggggaggatgatgaggacacaactagctcggatataaccatgactaccttatgtattaatcaaccaaatgtgcatatgttctacattagatttacttgttatatatttaaacaaccgttgctacacaataagtttcgtgtgtttttgtttgcagagatatttgcttgggcgaaagaaaagagaccgagcgtaagcaatgtatagatgattgaagaagttgactggggaccaaaccaagaccttctccaagtcttctttcatctcaccacatcacttttggtccatagaagacaagagataacgttctacacgttttggattctgattcgggcctcctgacagcatcaacatcaaacagacctagccgctgatctagaaggaatttcggggcccatgagtacttgttggaaagcttatggagtctactttcagatggttttggtcccacatcaaaattcctaccaagctaccggaaaactgcaaaacaagccacgtatctcatccagtccgaatatcatttgggttttgggccttgtaattgtgtcgtgggcttagcccaagggggtgtgcaccctagagcaaccctaggatgtccctaatcatttttactcagtagcagtcatcgtttagagtcagattttgcttagattattctgtcgagaacggtttcgccgctagatcggtttgtaagaccccaactcgtgagcttaatcattcatttgcagttttggttgtattctatctcgttcttgtttgtgttattcgattggcaaacagggattagccttctcggcgaggtcattcgtgtttcgacacgggtgacaaccagaggagacgtggtgctgccattgcggggctcaagagcgtgcgcgttcaagaagccggatcgatttgggtcgcgactctgcccaaatcgttgtttatcagaacctttcagaagatcgggaaccctagtgcacatcacttagtccttgtgcatttcctgtaatttggttcataagaaagatggttcttggacttctacgagatccacgcgctgcacctcacccccaacgcacctggccatcttcatgcacctgtgcgagatgttcatcgaggtgaggccgtccatgcggctattccagtacttcttcgtcccgcagctgcagcagtctgtggtggtgggaggatgctactttcagccccgcgcgggggtgatggggcagtacatcgagacccacctccgcaagaagtgggacgactggaagagggactggttctacaccgcactgcccgaccacctccgcctccgacttcccaccggcccacctgagcgatccgccggctggctggcggtctcggagctgggggaggagtatacgacgcggtgttagactgcctcaggggcctacggagggaggcctgacggcggcgatggtgttcgacgactacttcagccgccgcatcgtgccccttcaagaacagccccgcggcgcgtgggcctacactgggtacaacgaccagatgcgcacctatgtggggattggtgcgagaaagacgcgcgggctatggttcgtcgggtgctgagactagacaccatcgagccgacactgatcccagacgggatccttcccctctacagcgaccgcgaccgggagagtatcctagccgtgatgatggcggtcggcgaggctagaggtcggtcccacgggggcgccgctgggggcggcggtggcaacggcgctgggagcagctgttcggcagcaggtggcagtcgggccggcggttccggcggtggcggcagcttcagggcgcctggcccgagccatggggtgggaaaaggcccggccaccgacgcgaaagggaagcggaaggtttctgggtccgagccgccttcccctccacacggcggcgtcgccgagcacacagtcgaccggccaccgaccagccacaagcgtcccgccgcggcggagccgaagcggaagaagaagaggcttttgaagatagggcaaacggagccgtgccagcggagcttcatcgagcccccggagtagaccttcaaacgcccccccccccaccccacaggtacgactgccgccttcagattccgttatctctcttcgctctagctttgcctttctctttttttaaaaaaa

SEQ ID NO: 7812 - DNA, 4798 bp, Oryza sativa
ttcaaacgcccccccccccaccccacaggtacgactgccgccttcagattccgttatctctcttcgctctagctttgcctttctctttttttaaaaaaaaagctactgggattttattgcagtgaaatcccttcccgagggggctcgacagctgagccccccccccccccccccggatctaagcccgagaggtcggggcggccggaggccggccgaacagcggtcgcggataccacacaaccctccagcggggcttgggggcctcacactgggtccggctctgagtctaccacggcttagaccatccccgtaaaggaggagaggaccactggtggagttccgccccaacctcaccgagaagtatgacgacatcgtatatgactatcgtgctgctctcggcttcccgagggcctcgacgatgtctgggctgtcgatcgccgtgacatcatggccgatcgacgggccctcctccttgctgatgaggagagggcagtggtggtacgcgaggtaccagtagctgcgggccggctgccggcggccagttgccgctgcgcggcggtgaccaggttggccacgtcgtccaaccaccgctgaaccggggtttccggctccgggttggcagcgggggtgccacaaaagggcctccaccacctgaagcgcgccctgaggcggcgatgcaccccggcgcggcgtgctctccccccgtcgagcaacggggagagggccgagccccccgactggtcggggttctcccgccgtcgagggcttcagtgagggggagtcggagagtcccgacgatggtgatggggatcgtggctcccgctatcatcctttgtgagttcggctaggggatagggcgcgatgatcaagagcgtatcttcgcggtggattacgctagtaaggtggatggcgatcaagtgagagatcagggattatacaggttcgggccgctaggaagcgtaataccatactcctatgtgtggaattatgcttgtgctgttacaagagatcgtgagctcctaggaaaaccccactgtgtttcccctagagttcaagctaccaagagccattcttttgctcggcgggtaaggacctccttttatagttcaaagggataccacatgcaccgcccctattcatctcatctttcctggaggggggtccctcttcctctggttccgctcccgcctatgccttagaccggaagcaatgtggctgcttgctccgaggtgggtccaagcgccgtctcccgtctgacacgggagacatcccctgtcattccctcattaagctttgaagacttttgtgggctcatgcttccggggacgcaccggccatgcgtactgagccctaatggccgacgggacggggcatacttgcccccacgctgcccgacacaggacggggcacgggcacgctaccccccatcccatccatcggccaccggtcacagaccggtcgtagaccggcccaagtgattgacgcacgtcaatcacttgggcggcgtcgcacggccaaccacgccgcatttaatgcgatgggggtggttgggacgccgatcatgaatgtgccagcggcgtcccctcctccgcccactcagccgccacgcggcagctgagcgagggcctctgggtgacacagtccctcgggcccgaggggtgcgacgaggccccccgaggctcctaggtaggtatggggcgcccctcggctacctacacgtggctagggggaagggctccttcactctttccccctaacgtgggtaccccgggcccatatcaccgatagaacccgatgcagcccaactcgaaagcaagaactcgtcgaaaacaatgaaaatagaaaaggtggcgatgcgccgaaaatattattgaactgtcgttattttgtttacaaggccttgagtcatatttatacccaaaatacataatatatccttgccggacacaactccaaatatgttacaactctaagatacgaacaagtcttttaggtagactcttggcaacaaatatttctaaagaaactattcaaaatactctaattaatagatacaattgcccttttttcggacttatcccaatcgtggcagcacttgctcagtacgtcaatcgattccgaagatgattctagaaccaccctaccaagatcggctacatcggatgttctttgtccgatccaatgtcagccgatgcagacgttagccgatgtccccccatagccgatacatagtctgtttctaagaaacgacctcccgccaaatccgcttcgactttagcttcgaatttgatgcatgatttaccaaatttggtcgtcaaaaggtagcacctgacaaattccctgagtatcagttacaggatggagtattacgtttccaagggcgtatttggttgggtaataaggttgccgttcagtctaagattttggctgctttgcattgttctgctcttggtgggcattccggaatttaggtcacttatagtcatatacgccgtttgtttgcctggccaggtctgaaaaagtctgtgcgttcttttgtctctaattgttctgtttgcaagcaagcaaaggctgagcgtgtgtgttacccgggatttttacagccattaccagttcctgagtatgcttggcagactgttactcttgactttattgagggtctaccgtgatcatctgggtttgattgtattcctgtagtggtggacaagttcggtaaatatgctcattttatggctttgtcccatcctttcacggtgtttgatgtggctatggcttatctgagttatatctacaaacttcttggcataccacaacacattatttctgatcgagaccgtatattcacgagtgccttgtggactgagttgttccgtttggctgatactcaacttaagatgtgttcttcataccatcctcagaccgatggacagacggaccgagttgccccaagaaatggtttcgatggcttgcttggacagagttttggtacaatactgcttaccatttggcgctggataagtcaccttttgaagtattgtatgggaatcagcctcggcattttggtgtcagtaatatttctgaaagtgtcgtttctgatttggatgaatggttgaaggagcgggcaataatatctagtctgttgcggcagcatttgttgagagctcagcagcgtatgaagttttaggctgataagaagaggtctgaccgtgtatttgaggttggcgattaggttttcctcaaggctcagccctacgttcagagttcgctggctgttcgttccaaccacaagttgactttcaggtattttggaccttttccggtgcttgagaaagttggagcggtggcttatcgtctgcaacttccggatgattgtgctattcatccggtggttcatgtttcctaatttcgtcaagcatccgcgcccagtcttgattttccggtacgtcttccactggtggttaatcctgacaccattgaacctgttcaagttttggctcgtcgggttttgaagaaaggagctggtacttctgagcaggtccttgttcgttggactggacaaatgtcggaggatgcaacttgggaagatgcggggatgcttcgtcagcaattccctactgcaccggcttggggacaagccgattttgatggagggaggaatgttgcagactctacagtatctggtacggttcctgatctggcaatctatgcgaatccagtgaaaaagataccagtgcgagcaaggcgggccaacgtaggaatgggcctgagttgtgttgtaaagatgcggctatataagcatctgtggtgtggagaaggggtatcgaatatgaaatggatgtgactacacagtggtaccacttcctctataagagatactatccacctatatttcaaatacaattttctcttaaactacttatccgatctacgatccgattacatcgttatgttcgtaacaattaaatctttataataagatctcacatgattatattttgatgaaaaataataaattacttttataatatatctaaattacttttaaatttcactaaattacttcttagacatataaaagtaaattaaataaagcctaaaagtaatttacatatattatagaagttacttagaacaaaacgaaggaaactttaattaatgtgttttttcattgaacaaattatcatatatttaaagttacttttagatttgattaaaatacttcctatacattcgtaatgctataaggtaattacttttattattgtttttagttaattccataatttgtgctgattaatttaatttctagatagagccatatttttatctctataacgtatttacttcaaatgacatgccaaagttaccttcgttttatgctaagttacttctataatatatgcaaattacttttacttttagactttactgaatttacttttatatgcttaagaagtaaattagtgaaatctaaaagtaacttagaacaaaacgaaggtaactttaattaatgcgtattttcattgaacaaattatcatatatatatatatatatatatatatatatatatacacgttacttttagatttgattaaaatacttcctatacattcataatgctctaatatgattacttttcttattgtttttagttaattccataatttgtgctgattaatttagtttatagatagagccatgtttttatctctacaacggatttactttaaatgatatgccaaagttaccttagttttgttctaagttactataatatatgtaagagtgaaatacatg

SEQ ID NO: 7813 - DNA, 37440 bp, Oryza sativa
  unsure (1)..(37440): unsure at all n locations
ttctctatacatgcaaggagaagaatgagagggaagaacgatttgagaattttttttgggattctggtgtcactatatagctataaggagatatacgcgacgtgttgtgatgtggagggggctgtgagcaaaagtgttgcttacttggcatgccactttagcggtcaaacgcagtcaaaggacgattggaccggggtggtacattaaactaagtttatgggcctaaacgtgcaattttcaagttcacggacctaagtgacaccaccacacaagtttagggaccggccatgtattttactctatatgtaaattacttttagactttactaaatttacttttatatgtttaagaagtaacttagtgaaatctaaaagtaatttagacatatcataaaagtaatttatgattttttattaaaatataatcatatgagatcttattgtaaagatttaattgttacgaatacaacggtataattggattgtaaatcggatgagtaatttaagacaaaattttatttaaaatatagatgataggaatattttccctacttacttaatggattagtactatagtaaagtaatattcttcgaattaatacatatcttaataatgctgatggggtgtgctttcgatttagattttgcgatatgaaataccagaacactctctaactcaattccagattgccttccccgaactttgttcttctctgaacccaaattctgagtctcttccaaaccctagcgagttcataacacgaggggcggagcggttgagcaggagagaagggacacggcgaaagcaaaaccaccatatatccatcgaatcggattgagtccacggcaaccgcaggctccaaatcggaatctgcttctgaagccgatcgaatttggatccggcgaggaggggaggtcccggcctgatcctttttttatttatactagcaaatgcccgtgcgttgcaccggtaatttcgtggtagataaagtttaaccggacgatttttttaatcacaaatgttttcttttgtttggtcaattattccacgtgtacgtgcaagatatgaagtatgttcatgacgcattaatgtaacgattgtgtcatgggaggaacaaatggtgaatgccttaggttaatttcacgcaagaatagatggactaaaatttatatatttttggagtgatcatgtaattgatcataattttctagtaattttaaatggttcaaaataataccaaagaaaattatgtaaatgattaaatgaattaaatcagccgaattgcaaatgcccctaaataaaatcttatttcgaccatactttcgtaaccggcaaaaatcggcccggcctgtttagcgtgtgcgcgcgagctgatcgcacggcgagcagcacgtggcccatccactggcgacggcccgacgcggggcgaactgagcagcctagttgtcttccacggcccaatgaccgcatggcccaacagcggtggcggcccaacgcgaggtcaatctgagttgtctgatctgatggacagctcggatcggtcccacaccgatgaaaatcaccggccaaaggggagggtccgaaaaccctaatctccgatgaattgctgatacgttctttctccttctgtctccctcctccacccgagttgttgctgaccaaatcgaccaccggctgcttcatccagaggcttctcaaaatcaagagtctccaacaaagccagataagatttattgtctttaatctacagccattcacaaaaattcaataaatgtacttctcgttgtacttctcgttataaaataaaaagacatgttatagtatgggtttctcatcgtaacaaaattttcagccttggggatttccacttaaaattcagcaaagcgcgtaaacatctggaaacaacatccagtacttaatgatcggtagctagaaagttttcatctgtaaaaactgttctgcgaaaccaaccaactcaactcatccattattatctcggctcctcctaccacgtgtcaaaagaaaaactcctcccaaccagtctcccttctcctcctcctactctattctctctccaccttatctgctgagtaccatccacgctccacagccattcttatctccctcttcctcttctctctcaccctcctcttctcactctcttcatatcctttcctctctcgattccttcatacagtcggctcgcagtggtgagcgcgtggcaatgccggatccagccgccgctccggaccccacgcgcacgaatccggccacgccggggtggatccggcttggctacgagcggtgcctgtctccccctacgcggatccggccgctactccatcccccgcacgcagatccaccgcgacagcgcggcaatggtggatccaaccgccactccggcccccacgcacgtgaatctggtgcgagtgacagcacgagtgattgtggtgacctcgacctccgatggttggcgctggccaaggagaaaggggaggggcggcggggctagggtttgggttttttattttttttttcaaccttatggaaaaataggatttggccgcatggaagtatggctttttagtattgtcttaataaaacttaaatttttgtgaaataatctagaacgacaactatttaatgacagaagtagtaaagtggaagaaccggtgattttgatatcaataactaaaagtaataaaaaaataaatcatcacttgcatgtgaacggtgttgtgtgtctctatacattagtagttaatctcaatgaatagtagttttttttttgttttttcttaaccaccagtaagactattaagatcctactatcaatcctgtagattaccacaattcaaaacagtcaacagtcaatggcacttgacggcacttgaccgcaaataaaaaaatatcttgagcggtgggagagatatgtttagttcatttttgcccatgctaaccaccccatgctgtgggacccacgggcccaccatccagtgcactgcacccccactccaccgacacagcacagccacaaaccttatcccaatccattcccaatccatggagtagacgaggagaggcaccagacttgctctctacatggaaaaaaatccccaatccccaacttgctgtctacagaaaaaagatccccaatccattcgtcggtgatttagagcagcgatggagggagcaaacggcgaagatgtgccgaggaggacatgtcggagggcatcggggatcggcgtcgtcgagcatcgcccatgattgggcgtcggatggagcggccggcgtcgaggtcagcccacagtggagcagcggaaggtgaggacgccctgctctgccactgcagctcgggactcaggcaggcggggaaaggagaggaggacctgtcgcggcgatgcaaatagctgcgcatgcaggcggccaaaggcgacgattgagcaagcgagcgatggcgtcctcggccttggggagcagcaacagcagcgacggcgtcggcgagcagcaggtgcagtgtcctcgtcctccacgagcaacaggcagccggagcggcggcggcgtcatgtcctttgcaatcagcggacagtggcgtcggcaagcagcgtagcaggtgcggcggcctcgaccttgacgagcagttggagcagctctgtgcgggaggtggagatgaagatggtgggtggatcggaggggggagccgctcctgtcggccaccagctccaccccgtcctcctctcctcattgcggcggcgacggcctcctcctccatcccctcttccggtgttgggcgcaggagtaggcgccagttggagcgggcgctgcggcgatggacgcgacggcgacgagcacggtcgcgggtggcggtgaggactgcgctcctccatccccgatttcctctttgtgatgaatgttttaagagatttttttttcttttgcaattttttccttttgttggccccggtgatttgtgatgattttgctcaattgttgttgtatttgtgattttgtgattcatgtttctctcttttccgtgcatagttcttggcttagatgaatcggattcttgattttgatttcgattcgattttgattttgttctctgttcgggcggagggcatcacccgtggatgaacgcgtaaaaagatacggatgaaaacagattgacgaacgaaaataaaataggtgacgattggaaaaataccaatcttttaattagttaagataagatatagaatagattcacggacggacgacggacgcccccatcgaccatcgtctcctcgccgcaggtacctcgccctgctttcttccccaatccccaatccttcattcattagctagttttggtatgctcgattgggtttcaagtcggcgacctagttcgatctgccaaaaacttttaattattatcattttttttcatcttccaactcgtacctgtcctgcacaaccagatttttgtgcctccttcccttcctgtgtatgattcctacattaccaaccactgggtcaagactaggttggtgcctggtgggggtgtgggagtgggcagggcaggcgcgtggtggtcttccaaacaatcccctccctcctcctcgtctcttcattatagaatatatacagtattatgatactatgatgactgacaaggaacaagaggttgaggaaaatggttttatatattcttcttgtttgggcacaaggcaatagcttttcacttagacaatcaaatccaatcttctattagtagttgggatcagtctagctagaaaactagctattcatcccttttctattcattttcctgtgattagaatgaaatacttcttttttactctctctctctctctctctcatattgggttctggtttggttacaatcaacaaacatacaagtgtttttttcgcacatttcttcttgtttgatacccgtgtgttgctctagtgcaccattccaattattttaatgcctcttcaactgtgtctttacataagaactacactgaaaacgttgctcaaccattgcttcctgcttgtaggcttcacaggtacaaccatttcagccagaagagcacacatggatgggatctgtctagtaaacaaaaaaaggagactgacgctcaggccatgtgttgaagtagatcacagcagcaagcgggtaagatcgcgatgtgctaagtttgagtctctcccagaggtatgtaaaattttagaatgaactgttctctactgaatgcgataagggactggatgctgatgcttttgttcaaactcactaccaggacatagtgtcaaggattatttcacaactaacattgaaggaagctgttgtaatgagctcgacatcgaccaagttgagaagagcttggatttaccatcctaatctttacttggacacttcaatagtgtttggcagttctgatcgccagaagcgagtgccgagcactgagacgtttattgacacagtcaattttatcttgaggacgcacagtggtttaggagtgaacaaacttgctgttatgtttgagttgaggaaggagcatgcacatgacattgatggatgggtttcctttgctgttacatccaaggcaagggttgtcaccctcaacttttctccatatcatggatcgcatgatcgcagttacaacttcccatgtcatcttttcaacggcaaaagtggatctcaccttcaagttcttcaacttgataccgttactttgggtccaagtcctcctggcttttgtggctttgctaaccttacaatgcttactttggagaatgtgcttgtattgggcgatttgcagttcttactgaaatgccctgcccttgaatggttgactatccgaatgtgctcccagttacataatttgtatgctcctgaaccattgccgcggttgacatttttgtgtgtacaagattgtgcaattgacaagattgatgttcatgcccctaatctcaccacatttaagtatagaggtcgttttaaagttattattgcccttcgggaatgcttgaagcttaagactgcaagcattgtatcccccattgaggacaacctttactatattttcactgagcttccaaatgggttacctcatgttgagagactacacgtgaatgtttttgtcaagactcaggtttgttaatcccaatgcatgccctcaaaatcttcaatagagtgtatcttctatttttgtttcagaaatttgttttctaactttccttgtcgtctttcagatacctggatttactcaggccccttacaaatttatcaatttaaggcatctgaccatgaggataacctatgaaattgctaaacgctttggtagaaatgcagttctgcaactagcatatttttcggaagctgctccgtttttggtggaccttcatttggatgtgagttgttatgccatctgcactttcatcctgtttgtagttataaatactatgtaatctctttttttttgccctttactcctgtaatgtttccagacttgctttatattgtctacttacttttaagtattgccttgagtcaaaattttgaaaaggggggcagtccagcctgttatattaaatgatcacttaaatctggccatgagtggaatgcagccacatagttctagctattctgcaactattggcaaaatactattttggtttctccattgaaggtttctgtaacatattgacttggtcaagaacagttcatagtcttacctagcttgttgagtatcttgattgtgaaaagacttgggagcaatcttgctaggtaacctacaaaggtggattgagaaagcgattttattatttataannnnnnnnnnnnnnnnnnnnnnnnnnttatgaggctattgcatatattttcctgattaagtgcacataggttgtcatgctattgatttttctgtaatgacagaaggtgacaaacaattttgtgtgcagatgctgtgtttagatttttacgagtcccgtcctgcaagagacgtgattatgaatcgccctcactacagtctcaagagagcttgcataaccggattcaatggcaatggagggcaagttgcactagtaaaatttatcctcaagaatgcagtaaaattggaggaaatggttatagatccaaaaggtagaataacgaaccaaatgatgggagagcacaaaggccgtagaatgattaaggaaaaacttgttccaaaatacaagaatggcctacttgtaattctataacttctcaagttatgcattctgtttttctcaatgaatttaagttatgtctgggcagtgatatatttacttgccctttaaccctttttttttttctgaagcaacgataataaatattttatgcgatggagcatttgctaagttagagtactagtagagtagtgcaaatgtactagtattgtgattgtgtttttctttttgcaatactgaagggaagggtcatcttggtctgaaatgaatttgcattttacaagctcctacgagaaaggtaaaaatgagggagggcagcagttgcaagcacactgttggatgttactcccttcgtatcgttttgacttctttatcagtcaatatatttgactaattttatagaaaaatataataacactttcatcacaaagtaaacatattattaaaatatattaaatgctagtctaatgaaactaatttggtgttgtaaatgttgctaaaattttctataaacttggtcaaacctaaagtttgactaagaaaaaaatcgaaaacaatttataatataaaatagagggagtaatttgaaagtttattatatgcatttagcactaattgtgaacagttaatttttatatgtatggctggaacattgtgcagctccaaacctgtgttttcgtggaacaaaatgtgtgcgcgtgttttatattcagaacctactaatatgctaaccattctggtttctgattggctatattgagaaccttggtcaccatacatacacaagccactccagtagtagtgctagtgtgatgccaaattgttcgagggtagttgtgaacctatgaaatctgataattagccatatataaaatatgtatgcacaattgtggacacattcattcagttgtgataacggacatttatatttactaaaaaggaaaaatctgagcatccatgtttagttttgtgaaacagtctacacattcagttgacaaacacaagcagtgagaagcgaaggtaaggaccaaaaggccctctttatttagacccataagtcagcttaaatgagtttaagtataagcctaaataaataaataagtagcttttatataagccactcttacacattattaagccaaaaaacctttttttttcttatgtgagattaaggtatgactctattcttaaacttagaactttaaattcaccgatatataaatcatataagccaaaaaactgacttaaaaggctgaaccaataaacctaaacttaggctgtgtttagatttaggggtgaaaatttttgccgtgtcacaacggatacatgtacacatatttaaagtattaaacgtagtctaataacaaaacaaattatagattccgcctgaaaactgcgagacggattttttatttgacccaagcaagacggatttattaagactgattaatccagcattagcaaatatttactgtagtaccacattgtcaaatcatgaagcaattaggcataaaaaatttgtctcgcaattttcacgcaatctatgtatggtgcgacaaacgataggccagtagaaacttaggatacacctacggctttgcaactctactaccggctatgggcagcgaacaaaccaccacgaagatgacgcgagatagcggcggcgttgcacggtttgggacagctggatcggctctgtctggagctggaagacaacactgtagcggcaggtaggagaattagacttatggctgggtttcctttattcggaccgattgaaggagggagcaaaactggactctgggaagggataaagccagtcgaaaggaagggagaatgggccgaggactgaaactgaacttttcctatttcggcacgaaaaggaaaaggggattttaattacttttccaattaaattaatcactgaaataatctttgaattgttaaaaatacttccaatgctcaaataatttcaagacaaatcctgaaaatacttggacactataagtatttaacaaaattatatgcagatcatttaatgattaatttaatatatgaataattactgaaatgttctttgtatgattaaaattagtaattgagctctaaaaaatccaaaaaaattccagagagtataattaatcatggagaatttaataaaaattaaatccaaccatgctttatattgaggaaattttatttcccacatttaacttcacttgtaaattaatgaacatttaatataaattctaaaaataatttataaattctaaaacgaaaatcaggatgtgacatccttgacccgctgcgtcacgacatccgcgcggagagctgcaacacaaggaaaaggcgaagaagaatcagacatagagcttaaaaatgttgtcatcagcaataagagggatggcgacgcgagaacgagtaccccgcgatgatatccgcggcgcgtcagaagctccctcataatcaaacgcgggatgggcacgggcttgcagcggctggatgtgtcgggcaatgaagtcttgaacgacttcatacccggttagcccctgttctcacaaatctccaatagtgttcgcgaagacttctagagaaggattgaagggaggtttggaagtccagcagtcttgtcggacaagctagtccttggggacgacaagaaccggatcgagttcttctagctctagataaaaccacctggaccgccacttggaccgggatgtatggcactggagagatatgtatctcgtcttcatgccatcacgcaggcgaaacccgcaacatcccgatactttgccggcttccatccaccggagtttaaagaaaaaacagaaaagatccgagaagggcactaccccaatgtaggcctcgcacggatgggtaaagatgcttaagaaagcgatggagttggggttgaggtgcaagagagaaaggccatagaagttcaagaccagcaaaaggaattccgatggcggcggtagaaaaccatcgcgaacgaaatcttctactactaccatatgacctagggcaagggaaggagcagtacctccttcttcttgggccatgtcttgctctggaagaagggctccatcggtggagagcttcgccagcgttgctagatcggaggtggaaatagcaaggcccgccattggaggaagatcgctggagcaagacgtaaaaatctaaggaatttgggagatgaaaggtccgagactgttggaaggttagagaacttttcggcaaatggacttgaaatggatcccaaaatccctttaaatgagtgcactacctgacggtttgagtttcgaggaaagagagagattgccgccgaaaaatcctgaggcccattaagggcagttgttcagacttcaattcaaattcatgattagacagtcggacttctgttagtgttgtcaataactccacatcttctcggtcccataccgagaatgatcaagtgagtacgacaagccgctgatgagaagtcacgaacgacaacatgaattcatttgagttgaagtcgggggctactgtcagggttacagataaggcatacctcctatcttgtgacttatagaatataccgataagatataccttcatgtatacggattgttcccatgaatgttgcgtggtaaccgattcaggttatggaaaatatctctacgagtcaagtgatttccaaagtcctactcggaagggatagaatttatgttataccgtaccaggtccgatatcctcaaaccttttcttggggatcaagatgatccacggtataaaagggaccccctgggaggggttcaaggcatccaattcaattgccagcacacccaccaaagtttacaaagccagagtacgcggtgtcaactcgctgggagatctcgtcgaattccttgactacgatctcgttggtaccacctgtttcgactactctctttgtaatatgttctcattgtcatcaatctcatataaactggactagggctattacttgataaggggcctgaaccagtataatccctgtcttttgtctgcttgatgtcgtactatgtagaccctcgttccaacgtaccccaatactctactcatccggtccgcgagtatcactcgtcgacaacaatactattttactttcgcttgtcatacaatccgaaccgtcatttagttcggctatattttcaataatgctattgtgtaagctagcaacacaatccgaaccaacacttggttcggctatacatgatgtttcattatcatctaaactagcatttaagatattgtcatccacccggctttcctgagccagagcttcatgcaacacatgatcaatatcaaaaatatctagccattcaatctctttttaatagaatcaagcaacccattatatgcaatgtcggccaaatccttttcaattgtatttaaactaaaacatcggcttttagcatctctaaacctctcaatataatcaatgacatattcatcgtgtttgttcctaaccgatgttaaattagacaacctaagctcagtttcactagtgtaaaaataatcatggaatttttgttctaattgagcccaagtataaatagaatttgctggcaaagaagtaaaccaagtaaaagcagtatcagacaaagataaagaaaacaaatgcactttgagaacatctttaatactagcttcgccacattgtgcaaggaactagcctatatgttcccaagtagtcctattatcctcaccactaaagttagtgaattcgggaactctataaccacgaggatatgggacattatcataataatcaggatacgacttttgctaaaccctagcacgattccttacctcaattccgaaattttccctgataatattcctaatccgatcctccatagtttcaggccttggttgtggatttgatggcctaggaataggtgtttgtggcggccaaggaatcgaagaaccgtcggttgtccgagagaatatgattatactggccataatgcgtgttttgtaccaatccatatacttgatgattttggactggctcataacaattgttggcataaatagcatgggtatgtggaatagcatgactaacagtattaccaggtgatgaataataattaaagttagtattgctagtcgtggtatgaaaacatggagaaatttctaaggaaccgttttgaccgcccacctggtcgcccggtcagtccagtggtcagtggtgcggtcagaccggccacagaaagcccgatctggccaagatagggcatggtctgaccggctatggtgggcacggtctgaccggcatagtacatagtctgaccggccatggtgggcacagtctgaccagcatagggtgtggtttgacctgtgtcacgaccggtcataccgtcagctaggttttgcatatagccgattcctgtgcaatcggctgtataaacacccattgatccatccatagcattataagcatattgtatagcagcaaaactagaagtagcaatgcatctacacaacgatcattaactttttgaatagcaagggatgggttggatgaatcggaggttacatttggtgaaactatgacttgaggtagcaggacgtttcttttcacgacgccttgatcagtcctaatgtattgtgcaagatatatattccttcttccacaccgccatttgttcttcaaattactgcagctgctcctcgtccaaatcctaatgtattgtgcaagatatatgacttgatcagtcataatgtattgtgcaagatatatattccttcttccacaccgccatttgttcttcaaattactgcagctgctccttgtccaaatcctgcttagtaagcttattgatctcattcccgctcgctatagttgatgaagaaattacttgattaatttcggccatatagctcatcgccgaaacttttaaccgaataaattgttatacggtcttgatttcttgatatgttactttacttagccaattttgtcaaacaaactagctttgttgattgctacaggatatttggtactgtagcaaatataaaaaaatcaaccgatcttaaattagatcggctgctatgtttttttttttcctttttttgggtatgtgggcagtaacagatcggctttgatagcgtgatctctgttttttttcctttttactaggtgaccgtgtgcgttgatgctgctgcttctggcttctggcgtgcacgcgtatgcagttgtagatcgatacggcttccgccggcttgatggatggccagaagacgccgaatagcacgatcgggcgacggcagcagtgtatagattgatttcggccacacggccgaaacagtcgtctcgatgagacaatgcgcaaattgcaaattcggctactctaaagccgaatagatctctttccagtggagtcgtcaaaaatcgtgttggcaactttttgtgacaagtcgacaagcacgatcacagcacctaaatgccttgcggtggtacggagtccccaaccacctcgatttagctaaaaacccatatcaagatgggttatgtagaaaacagctaaaccggctagcggagccaatttagagattaaaatcagcctctagaccgatttagatcgatacgaggataactacctgtctcgtgagcaaacggaaggttttcaggacaaacctacaaagaaatatcgcactctcacaacggcggcggacgattacctcgcaaatcgataaagatggactaaaactaagataaagtaaaaaaccaaggctaaaaagtaaagataaatgaaaagcgattaaagtagattgtgtgttgtgttgtttccaattgaaccggtgttgtcccttatataggggttggtcttgctctctacatgccctcctccacgtccaactcgggttagacaccaaagtaaacccaaaacatagcctctcgagtaaggaaacccgagacccgacgaaaacagactcgggctcggactctgacggtctgaccggccacatacccatggtcagaccggccctactagccggtcagaccagccacacatctacggtctgaccggccctatgaaggaaacccgacacttttcaaactttagtaattttcccctattttgtccataggtgtcaaatttgggtgtaaacatttttacacatgactagttcagatacacagaagattaattaggctcaatcatttacaatggtcgatgagattattcggtcatggaagaatctaggcatcatgggccgtgtttggaaataaaattggattcggctcttttatatctgtgtggaaacttgataggagttaaatgcttttctcgaggggcagtaattggtaatagaactggaaagcaaagcatatgtgttggataaaagatgtaggtgcgacgaacgtgaaattatcaattattttctaaagtagcttaggttggaattttatttactattactactctctccgtcccataataagcagttgtgggtttcagtgatcaactttgaccatccgttttatttgaaatatttttataattagtatttttattgttactagatgataaaatatgaatagtactttatgcgtgaattaacttctaatttttttatataaatttttcaaataatacggacggtcaaacattgtgcacgaaaacttatggctgctcttatagtgggacggaggagtagtttatagttgttgtcgaatagacaactgcgtcacgtcgaaagacgtggttctctcaagagtggatgggaaataaaagaacaattgtattactttgttcagaattttttttgatccccctattacatggccctagggggctatttatagccccattataggttactactgttagggtttagattatacagaggaatttacatgattacccttatgatagggacattatcgagggcacactgtgtcctttacacatacggcccctacagggcttaaatggctcggcccatctatctggcgaaatcccctgaggacgtagcggcccgctaggcctcccgacaacgaggttcggtactctggcgaaacccgtgcccgtgtgcctaggctttcgccgcatcatcttcgcccgtgcggccttctgtcaaggactccacccggtgaagctggtgtaacccaagccacggctttcgcccatatgactttattctcaaccttcgccgcctgcctctggagtgagcctgttgcctgagtcttttggtttcggcaggttcggccgaaggccgtccgtggtaagcctccaacaagcccctcacgggcaagggtgagtagggagcttcggccgagaccgtgcaaatcgaatggtataccaagaggcgccccctttcggccgatgttccagccgaaatccatgacgtagtcctgcgaaataaatgacttgttttcatgtttacaaaaaattcttgagaaaattcatttcccccgtttgttacaaaatgtcgaaagggttagcttatctttttcgttactaagaatagtaatgggccccgtgggcctctcctttcttgcaatcggcttttcactgttcggctctggcccaatgggaatttaccgtttcgtctgctcctagacacgtgtcaggatttaattggttggcaggctacggtctcgcgacggggttatataaccccgggtcagcttgctactttctccccccccactcttcactttttaccgcttaacccgctccacgctctcttcatttgcttgcctcttagctccttcgccaccgctgtgctctttgcctttcagctaattttctctttccttggccgcgagcctgatggctcctcgttagcccaccaaagccgggccaactagcgaagaccctagcggccttggcgaagggtgattgtgtttccttggcaaatcgctcgtcaaggaggccgacttagccgagttggtttccttcggtgctcttgtggagggccaaggatcgtgtgggggtgaagccgttgtcccttcgcccagtgatgggcgaacggttgtctttgcagcctacttcgccgccgggcttcgtctgccatgtgacgatttcttgtcgtctgtgcttgcgacgtacaatgttaggcttccccagcttagtccattggcattcccgaagctggcggttttcgcctggatgtgtcgaacctgtgggttcgctcccgccgccgagctgttcgccgttctatttacggcatgcgccaagaccaaggatgtggagacgccggctggaccaaaaaaaactgttttcgactgcgtgaacttcatgctgcggccggaacgctcagacgcttggccggtgcctgcgtcgatgaacaagtgggagaaactggatgcagaagtagttttacatcgccaacccttaccccgccgaagatgccaaggcgaactggctccatttctagcgttccgccgtctccatcatcgcgaagccaaatgtggagatcgatgggaccctcgagtcccggctcatactcctccgcaaggtcgcacagtggctaagcacccgggacctttgtgaggagttttgcctccttcggatctcccccctcgcctgtgtctgggacgtttctgtgaacgagggcgaagaagttttcgggcttccctgccttgctctccccgccggggttgaaagtgagtttttgctttcgctcttagccgtatacttcctttatggaaatgtgcttcaggctaaatagtcgttttcgttttgctttttcgcagcccggacctgggaagacgccgaaatggaggcgtcgaagatgataggggccctaacgacggccgaattcgctcgcttgcttcagcgccaaaccgacggccgggtgaaccgggttcatgctggcgaattgccaggtcggtcgaacccctccagggccggggatgacgaagtcggtacctcgaagaaacgcaagcgtgcggtcgcgaagggtggccagattcgaactcgtctcggcgcgaaaggtacggttgacggtgacggggaggaggaggaagaggaagaaggggaggctggatctgaggatgatgggtcccacggctactccactagtccgactcctgcgaaatctagagcaggttctcacgtttcgcctacgtgtccgcaagacatttgtcacgcccagaaattcacgaaccagaatttctaagctgaatgtgcattaaacccctgtccaggatcagccagggtacacaaacgacaattgttgacatacagatccacatcttacaaaaatttaaaagattacaaatgcagcggaaaagataaaagcgagctaagcctgaagacttgactcctgcagcaaggcgactccattccataggcatccttgacggcagcgacgaagccaacttcttcgagacatcttcaactgagaaggacttcaactctggtgtgggggaaaagagagcaagactgagtactacccactgtactcagcaagtcataccggaagagaaggtatgatgcaggatatatccaagggaggctaaaggctcatttgcataaagctagcatttaacagcagtagttgaaagcaataaaacagttgtagtaattaatcagtattaaccaatcactgtccaacgctacaccacgttgcaacaggcccaaccaaccacctgaactacaccagttcattagctaactagcggtgagactaatcacggtgaatctggtcgaccgcccataaccgcgggcacggcgattcgaatagttttactctgattagaggtgtacaactgtacccacaagacacagccccacgacacgtttccgtgcgccgacatgccaccacgacataccggaaagaggccgtgataggacccttcgcataaccccctctaaccaatcgcaccacaccttagggttcgcccccgtccctatcaggcaacgggcagcccccctttcgtgcagcggtgaatccggaagccgatcaaccggacaccccggccgacccaactccatcacgcccaccctcacctgggtacgtcggctagaggaaagctacactacaagcccagccgttgcccacgctgacttgtggtaagtacgataagttcttccagggcatcccgcgaaccggtcctttatcgccatgggcactactagcaaaaccatgcacccacagcctaccatgtagtgtattttaattaactaacaccattgcggcgacactaatccaaagctatgccaataatcaaagtccatgcattaatgtgattccccttttgtgtactagtagaactaagcatggctaagcatctcctataccaacatctagtcattttagtacccaagttatcaatggcgtaagggaaacaacatatagctgagtaataggacccatcccacatgatattgtaaaacaatgcaatttttaatagaaatccgcgagaaccttgagaggatctcgagagacgaggaagccgctgctgccaacaccagacgagaccctgggctgtcggaatcggccgccgggcacgagggcgaagacgacagaggccaagaccaccctgaggtgtgaggcccttcgccctcgtgtgctatctttttttttattctattgtagccctttcgggctttttggtagtctagctttgtatataagctctttgcatgttcggccttgggccgctttcaccttgtaatcactatgaactctattctactgatgaaacattatcctttcgctgatctacttgtttcgttggaaagtggtattgatctcgtctatatttcccctttttttgcactttttcttttgtgctttactagcaggcttgtggccgaaaggtatgcgttcgacctctagctaaaaatcggcgaaacaagaacgagaaattcatggcggtgaaaggcctactgaagattaagtgtccctttcggcttgtttaccgtaagatgttgattaatggtaacagttataaggttgtaaatgttgttgaatggatgcgtgtacatccagccgaaccctagaggactatgatcactatcgtgtgtcatgtcgtgaagatagctcgagcttctggcgaaactttaagagatcggttcatcaagaggcaatcgctcgtcgccattatagtttagtttgtgtttggcctccgtcccatttgatggttgtatacgatatcagtagtgacgacgaatctagttcgccggtttgtaacgtaaacgaggatgaaggtacaaacgatgaagcaatctatttgtcatgtttgttaattataaatacaacacattggttgtaattcgacattcttgtgattttttggacatacctttatgccatggttcacatagtcacggtcgtgctttcgttaggtcgaaacatgtcggcccctttgcgtgctatggtgaaaagctatgtttattttgcagctttgctcttccattttcggcttgtggcaggcgtgctatcgagcatcgtggcctatgcgtgagtcgaatataacgttgttttgacttttgtattcaaaattcaagctctcgcggtttcgacgttcggtgagccatgcttcgatcgattcgtttcgcccctctggcattttcgctgttcaggcgtttgccttggggttttttgatcaggcgtttgccttggggtttttccacgaaaatttcactcacagagaaagaatgaaaatgaaaaagacacaaggattttatactggttcgggcctccaagttggataataaccctacatccagtttgcctctccctctttttttttcttttttattttcgtcttttttttgctttttgtgccgaatggcttacatcatatgtacatttttacaagttggtgaatggggtgccaccccttctagacataaaaacgctttagggaagaagcgttccaggagtggtcaaactcttcaccttgtagtgtcgccaagcgaaaggagcccgtcctggtcctgtgcttgatgagatatggctcttcccattttgactcaaatttcccgactgccactgggttcgcattcttccttaggacgagatggctgggcagtagctctgtcggtcgaacctttttgttgtaagttgccgaagtgcttgtggcatatttgcgcatatgttctagagcttcgactctcaccccctcgaggagtttgagtgacacctcgcgcccttcttcgcctccagagaacatcacccttggcgaattagcccctatctctgttagggtcattgcttcatcgccatagataagcatgaacgggttgaacttggttggccttgtgggggtcgtacgaagggcccagagaacagatagcatttcgtccggcaatttaccattcgctgccccctcaagccttttctttagcgcctctaggatcttaccatttgcgcgttcggccaccccatttgactgtgggtgcgcaaccgaagcgaacctgatttccaggtttagccctttgcacatctcattgaacttgtcagagtcgaattgcttgccgttgtcggtgatgaattcttttggtattccgaaatggcaaacaatgtttttcctcacaaacttctgtacagctgccgaagtgatcacgccgagtggttcggcctcgatccatcgggagaagtattcgattgctacaatcgtgaacttgtaaccgtttcgcgccatagggaacaggccaatgatgtctagcccccatctggcgaaaggccagattggtgcgataggctgctgctcatattggggggtagtttggctttgactatgccgcagacagctttcgcacttcttggcttgctcaacacagactttcagcacggtgggccaatacacaccctatcaaaatactttggaggccactgttcttgcggcctggtgtgcgccgcagagcccctggtatatttccttcgccatttcttcaccttcggcaaaggagatgcagcgaagcaagggttgaagcaccccggagcgatatagctggcccgagactaacttatattttacggctctgagctgtaggcgctccgcttttgcttcatcctccgaaagccaaccattcttgaggtatttaattttacgaacggggttcgccagtcctctgggtcttcccctagctctacctggtcgattgccatgatgtctaggatctccacaggcacacttggtgcgtataggacctcaaaaatggtgcctggcgaatacgggcctccacaagcagcagatttcgccagggcgtctgcttcctcattctggcctctaggtaagtgtttgaccgttatgctggcgaagcacttttccatagatcgaatagcctctagatacctcttcatcccctcttcttttgcctcaaaggatttgtcaacatgacttgccaccaatttggagtcagttcggacgagcaagcgtcgaacccccatagctttcgccttttttaggcccaacagcatagcttcgtactctgccgcattattggttgtgtcgaactgtagccttgcggcgtaccgaatcggcacgccgcctggcgaagtgagtaccgccgcagcgcccgccctcttgtgcgaccacgagccattggagtacatcacccaaggttgttcaacgggctcaggttcaggggcgaatggcggtgtccattcagccacgatgtcggctaggatttgggacttgatggcagtgcgggcgacaaaatgcaagtcgaagggagataactccgccgcccactttctgagccagccagtaatttccttgccccgaagcacttcgcccaaaggatactgcgatggcaccgtgactttgtgggcctaaaagtagtgtttaagcttgcgcgaagccatcagtagggcgtaagcaagcttctccatttcgatgtatcgtatcttcgccccttgcaaagcttcggaaacaaaatacactggtttctagcctgactctgtttcttgaacgagggctgcactgactgccaccggtgaagctgctaggtagagtagcagttcgcttcccggtgctgggctgaccaaagcaggtgggctctacagatattgcttcagctcgtcgaacgctgcttggcattcgggtgtccaggtgaactttcccgtgccccggagggtcttgaagaaaggcaagcctctttcggccgctttcgagaggaatcgactgagtgccgcaattcggcccgcgagcttttgtacttcgcgtacgctcgataggggcttcatttgctgaatagcatcgattttctcggggttcacctcgatacccctttcagaaacatgaaaacccaacaacttgcccgcgcgaataccaaaaatacacttctcaggatttaatttcatacccgccgcgcgtaagttgtcgaaagtctcctgcaagtcggacgcatggtcgaaagccttgtggctttttacgacgatatcgtcgacataagcctccacattttgccccagttgcttgtaaaagaccttgtacactagcttggcgaaggttgccccggcgttcctcaggccgaaaggcatcctgaggtggcaaaaggtgccgaacggtgtgatgaaggctgtcttggggatgtcggccggattcatgtggatctggtggtagccggagtatgcatccaaaaaattcatgagttcgcagccagctgtcgagtccacgagctggtcgatctacggtaagaggaaatcgtccatcgggcacgccttgttgaggtctgtgaagtcgacatacatgcgccattttctgtttgatttctacaccagtaccggattcgccagtcactcgggtggtcgatctcctggatcaccccagccttgagcagcttttgcacttcggctttcgttgcttcttggcgatctgcggacatcttgcgcagcttctgtttccttggcttagcatccggtttgaccgccagatgatgcatgatgaggtctgtcgaaacacctcccacctcgtcggggccccaggcgaagatatcaatgtttttcttgatcacctcaaggatgctgtcagcttctctttcgcccatgtcagccccagcgatacaagtcttttgggatcggcatcgtcgacctgcaccttgattaccctgccgtgaggggcgggcttcggcgcatgcttcgaccggtcatatagttcgacctcaacattgtgcactgctctgttgattgcggccaagtcgccatttgacgtggccgaaggttgaaaccccttgaccacgatcactcctgcagggctaggcatcttgagcttgagataattgtggtgggagatggcttcgaatttgttcaaggttgcgcggccgaagatggcgttatagttgtatgggatgtcgacaacgtcgaacagtatttgctcttcacgcctgttttcacctatgccgaaagctaccaccaattgtgcttggccttagacttgaactacttctccgtcaaagccacgaagcgaggacggtgcttgggtgagggctagggtatgcaatcccatcttggcatatgctttggcgaagatgacgtcagccgaacttcctccgtcgaccaggattcgccgaacttcgaagccagctaccttagccgagatcaccaaggggtcttgatgtgggaacaacactctttcgacatcttctggcccgaaagaaatctgctggttcaagtatcgcgaggccccttcacctgccgaagtgatgttgagcaccattcgcagctgcatcttcttttgccattttgacagttgatttggtgggtcagcccttgtaatcacttggattactctgcgttgcacatcatggcgttgttcggccgggggtgcttgttcttggacagcttcgtgaggtgcttcgacggctgctccttgctgcgtcctcggatcttgcacgctgccacgctgccgaatgtttcggcattgctcggtggtgtacgaagagcgtccatggaatgcgcagtaaaggtcttttctgaccttcttgcgaacggactgctgatggctgcttgcttgctgggcgtcgaatttcttgcggagggcctgaacttcttcgacagccatcacggccttgcctgcacgatcggttctgaattttctccaagtcatgggagcttgacttggtcttggcggttgtccttggatcggcggctgagactggcgaacggcgagaggagccggttcggcggcctgcgcttgtacttgggcttgagcagcggcgactgaggccttatcgtactcggcttatattgcttgtcgtcgcttggaatcctcttcaccccttacgtatctgtcaatgatatgaagcaggtgctcgagtgtctgtggctccttgttagcgatttttcttgtgagttcgcccttgagcagtccagccgaagcggtgttgatgacaaatgcttcgattatgtcctgaacttggcattgggcttgcgagaagcgacgcatgtactcccttatggacttccccggcctttggcgaatgccgagtagatgttgttgcgtcttcggctcctcataggtgcctcgaaagttaaggacaaaaacatcgtgcaattgctcccatgagtaaatgctattagctggtaaattgaagaagcaagaacgggcgatgccgcctagagtgagatgtattacctttgccttcgtattttcgtcgccatgagcggcttcgatcgtggattcgtagatggatatgaactcttttgggtctgtttcgcccgggtatcgcggaacaggcgggaacttgaactggggtggtattggacgaatcttgattcccccattcagcggcagccccttttcgccccctgccttgctcacggcaccttactgtagaggcccatttggatatggcgtggcgaagggcgaagtcatggcttgcgcgtgcggttgggctacagtgttcggctgcccggccccgaacggtgacgcttggtgcgccgccatggatggatcgaatgaaggctgggcccatgccatggcgacctggttcggtgtctgattcgttccgaagcctggtgtcggtgcctgtggtcgaatggttggtgcttgagtggcgttgccgaagtcgaattgcggtccttaactccatggcgaagcccctggaccaggcaggttcgatggtagccaactgggtgcaccttgacttgtgttcccctccggttgggctgaaggggttacttctggagtgttgtggggttggttgagctgctgaagaaaagcctgaagctgcgcttgcaaagctgaagctccttcggccattgcttgcgacatttgtccggtgaagtacgctggtgcttgcatgacttgaatcggcgcttgcgggtagacctggggtgggatgtaacctgccgaatactggagaatgggggccgaggcgaccttggcttgccgggtcgcttggtatgcctgctgctgctcttgcatttggcgaagcatgtccaggaatcgcgccatgttctgacgcacggcccccatgtcagcttcggcttgcgctttgaggttggagttgacttgcgcggcggtgagcgcggtcggagcttcagcctaccgcggcgaagcagcttggggcaccatcggttgacttgtcgaaaggatctccaccctggtctggagcgcccttgacattgctgccgcctttgccgcttcgaccgcgttcagcgcctgccccgttgaagcggcaagagccgaacgtggtggttgcggcgcagcagccgaagtcgatggtaccataccagcttcggcgccgagcgccgaaggctctgcttcctcttcggctgccatctccactcctacttcactctccttacgccttgccaccttctcctttgcgaccttcttcggtggcattcgctctcagtggtttcgctcagaggtccccacggtcagcgccagctgttgtcgaatagacaactacgtcatgtcgaaagacgtggttctctcaatagtggatgggaaataaaagaacaattgtattactttgttcagaatttttttggatccccctattacatggccctaggaggctatttatagccccattacaggttcctactgttagggtttagattatacagggaaatttatatggttacccttatgatggggacattattgagggcacactatgtcctttatacatacgggcccctactgggcttaaatggctcggcccatctatctggcaaaatcccctgaggacgtagcggcccgctaggcctctcgacaacgaggttcggtactctggcaaaacctgtgcccgtgtgccgaggctttcgccgcatcttcacccatgcggccttttggcaaggactccacccggcgaagctggtgtaacccaagccacggctttcgcccatatggctttattctcaaccttcgccgcctgcctccggagtgagcttgttgcctgagtcttttggtttcggcaggttcggccgaaggccctccgtggtaagcctccaacaatagtgtttgctttttctcatatattttgagtgctggatattaatatttgttttttttgtgtgttgttggtcggctcgccgcttctccacctctcgtggtggttgcctcttcttcctccgctgccagaatccggggaacttccccgccggccgtcgctcctcgtcctatactctagaatagaatcatcaaaagcatagcattagtgatgcggcaacggatccaccacctccaactatcgatcctgttgtggttttagtaaaattgatttgaggagctatgtccgggttcgagcaccccatcatcggcgccgcccacgccgcctttgggcacctccaacttcaattgccccccgcccccggatccaatattcccaacccctaacactccacatatactccatgcttcctccaccgcacccaacacaagcacaagcctaaacaaccaccgctccacctccttctctgcattgcattcgattccttggtccataacatgcaggaggtcctggacaagcacaaacccaaggcgctatttcaaccacatctggagacattaatcctccatggaaacaaggcccatttcgatgccttcctctccaacctcccttttgcaaaggtaccgccgcctcccctgcctcccgcaggcatcttctccacaccaccgcctgtctctgcccacgaccaagaccaacctgcaattccagctcaaaccgaggacaaggaagagattgacactgttgactccatccgtcccaatatatagcaatttttagcacttaggatttgtcccaaaatataacaacttatccaccaacattcacttcccaaccaatcacaaacctccaccatttatttttcccacctacctccagttatcaaccaatcacaaccccttcctatttaattctacctaatttcttaataaccgtatccaactctaaaactcaatatattatgggacggggggagtatgtctctgtagtagtactactagccgggtactactagtatgcctgtgcattatgatgcacgcacgcaactactttctgttggcaactttttgtagcaagttgacaagcacgatcacagcacctaaagctttgcggtgatagtagagtcgctaaccaccctaacctagcaaacgctaagtcaaaatgggttttgatagattaaaccagctagcggagccgatttagatagaacaatggataactacctgtctcgtggtcaaaatggaaagttttcaggaaaaacctacaaagaggtgttgcactctcacagcggtggcgacgattttcaacgcaaatcgacaaagatggacaaactaagctagaactagttgagattgtatgttgcaattgaaccggccttgccccttatacaggggttggtcttacatgtccaactcaggatagaaaccaaaggaaacccgaaacatgccttcccaagcaaggaaaactcgagaccagacgaaacagactcgggctcggactctgccggtcagaccggccacaggtcggtggtctgaccggagttcaggctgcggtctgaccggcccatacacggcggtcagaccttcgtcccaaaggaaacaccgatagatttccaaactttggcaattttccctatttcgactctaggtgctaaatttgggtgtaaacactttccccaccaagctctcccatcccattctctctctcttctgccctctgttcccatcctctcccacgggtctgccaccatcactgctcgcctatggcagctgagagcctgagacacggcgagtggtgtttgatgcatgtcgaaccgtgtcatacacgagctgaccaggggatgcgtgtcgacacgggaaaaaatgtcgctactcgcctatggcagctgagagcatgaaacacgacgagtggtgtctgatgcgtgtcgaaccgtgtcagacacgagctgacacggtgatgcgtgtcgacacgggcagcagcgcgctcccctccgccggatctagcgggagggtaggcggcatgcggccacgggggcagcagcgcatgtggatgtggtggcgccgtcccctctctccccctcctcccgaccccctcccctctgtgagccgacgacgacgacggcgagcggcgatgcgctcccttccgtcggatctggcgggaagggaggcgcatgcggcggtgccatcccctctcacccccttatcccgggcccctcccctcttcgagccaacgacagcgacggcgggtggcagtgcgctctgatctgctccgccgaatctggcgggaggggaggtggcatgctgcggcagaacaggagtggcggcttcgtcccctctccccctcctcccagacccatcccctctgtgagccgacaacggcgatggcggatggcgctgcgctccccttcgctggatctggcaggagggcaggcggcgcggcggcgggtgcgacggcgcatgaggatgcggcggcgctgtcccctctctcccttctcctcccggtcccctcactactgcgagccgacaatgaagacggcgggcggcggcgcgctcgcctccgccggatcgggcgggaggtgagacagcatgcggcggcaccatgccctctatccctcttctcccgatgcatggcgatggttagattttttttaagttaatttgttgtgaatgaatttgttgatttgagtatgatttatgaattcgtggatgaatttgtgatgcgaacaaacttgcgtggggtggcccgatcttcacggcagtaggttcaagatagagagtgccggcgtaaaccgaaacacaagagggtaactagctgcgagcagcaagaggataactagctttatacctgccaaggtcggatccgactaagtggtgagggtgagaatgatccgaaactccaacccatcacaccaagcaatcatagaatcatgatccggaataactagctttatacatgccaaggttggatgcgaccaaatggtgagggtgagaacgatccgaagcctcctggactctgacccgtcaaaccgagcaatcatagaatcacaatctaggactaatccacacaatacggtgcagccaaactagaagccgtagagcacgaactagggggcaccagaggagccttctcacaagtccaaaagaactcacaagaacaaaggggtaagacacttatgcagtctttagcaatctctcatacatgaggttttcaattgaacaaaagttctctaatggatggagtagaggggtatttatactaggaacatccctcctagctgaggtgtgaacataagaagccacgttctagtggtcaaggctaacataaatgagaatgcaaagagttttctcgggttcgcgcacagcccttcagctcctccacagccttcagtaaaaataccataactttttattggaaaatgatattgaggtggggtttgatgcattggaaactagacttgtccctctttccaacaatatatgccatgcacccagtctctttactggctgggtcgcacaagccttagaagtttagcctttgcagcataaaccatcttcttgttggcgtaaacagctgttggttgggcatgtgctgattcctcctcgatgtaacccttgtcgttctcaacataacccatcttccttggcgtagtgatgatgtcctcgggcgtaaaccttagcaatacaaaggtagagcatttaggtagtataaaattctcactaaaatttgggttaagtttagcaaagagcgagttcacctcttgttgtatattcctagcacgactacgcgtaattggaccatgataagcttgatcgttcttgctgagatgtaatccatcaacttggtttacgtcaccttcattttattcatgtgatgtatgacgtaaactatcacccttgtttacgtcaagtgtagctgggatgtcctcatcaatttgctaagagtagtatgtgggatgatttgtcgcaggaatgcaagccagcaaaaaacaatgaaaaaaaagaaaatcgggactaagatgccacgtggagctattatctttagttccggttggtaacaccaactgggacttaaaaacacacatatttagtcctggtttcggggtctcggtttgcaacccgggactaaaagggttgcaaaccgagggtgaaaaggctttcgccagtagtggttcttggaataaagcgaccacaaggcttttgaaagttgaacgaaatgtcccagccccaatttttttttctttggaacaatctaccgtaaaatcataaagaactttctttctcataaaaaaagaactttcactgatatggaacgaatcagatagacactggtggatgcagcagggggcaagaggaccccgggtaaccccttcggctgcatgaacccacaataatcaaaaatgctaatgagcggttagttgcgtgttgggtttctcaaaccgtcatggccggagttaccgagccccggtggtgagcacggttaccgcacggtaactgtacaaaaccatgtaaaatttatcaaaattttaaattattttttaaatctaggttttccttttaccgtaccccgcggtaagcgcagttactggcggttttgcaaaccctacgcgtggcccgattcaagcgatagtagattactagtactatactactcatgagtactactactagtacctatgtctctggagtagtactactagccgggtactactagtatgcctgtgcattgtgacgcacgcacatagctacttttcccaccgagttctcccatccctttctttgggcctgtttggtagagttccaactcataaatttagctctaggagttaggtctggagtggagttgtggagctgcctaaacccagctccacctgtctagtttattttgtgagagagctccacccagcttcactcctatttttagtagagctgaaattgtaaattgtttggctgagctccagctccaagagaggtggagctggagctagagctgtgccaaacagggctctctcttctgctttattttcccatcctctcccatagatctgccaccatcactgcttgccaatggcagctgagagcctaaggccctgtttagattccaacatttttcttcaaacttctaactttttcgtcacatcgaactttcctacacacacaaacttctaactttttcgtccaatttcttcaaacttctaattttgacgtagaactaaacacagcctaagacacggcgagtggtgtttgatgcatgtcgaaccgtgtcagacacgagttgacacgggatgcgtgtcgacacgcgaaaaaatgtcactgctcgcctatgacagctgagagcctaagatacgacgagtggtgtctgatgtgtgtcgaaccgtgttagacaagagctaacacggggatgcgtgtcgacatggaaaatttttttagactcgcgtgtcccggtaaaactagtggacgacagtgatggtgggcagcggcgcgctcccctccgccggatctagcgggagggaaggcgacatgcggcggcgggggcggcggcgcatgaggatgcggtagcgccgtcccctctctctcctcctcgcggccccctcccctctgtgaccagatgacggcgacggcgggtgcagtgcactcccctccgctagagctggcgggaagggaggcggtgataggggtggcaggctccccatggggaggtggtggtagaggtgcggcgccctcccctccctgtcactgaggaagtagaaggtggagcatagaagcctggtggccagtggctgacgtcaggtggcctagtgcccagcatctccccggcctctattgtggatttttttgtggatttatggatgatgttgttcttcagtacatttattcggtgatgtcaatcaatcttggtgacggtctaattttgattttggggatttggtgattttaatttagatttggagcacaatgggagcaactcgatgcgtggcatggcggcatggtgtagtagtgagttcaacccgattcgagccggctctctctttttctttttggcgcgtgcgaatctataggtgcctgttctattttcctcataagtgccggttttctctattggtgccagatgaaaatccggcacctatgaacccttgcaaaccggtacctatggcatattttgttgcagtgctataaaatgttgctgatgggattgagaggaattaggaatcagaagggctcggcatctctatatatactgcatacgaagcaatcatgaatcgatcaccttctacaactcacctagaaattcacgaataaaaaaaaagagatgaacatactgcctatagagtgttgttgatgggaatgcgaggaatttggaatgggaagggttccgcgtctctgttatttgcaacgtgatgccgaagccgatggcacctcacgcaggatgattctgtcagctggcgactgggtaatctgcatcagtactgaacacatgcatagttgtaagtggaaccacaatattgaatagtccatactgctgataatgtggatgcagcttttcaatgttcttgtgcagtacccgtgagtccgtgatctgcagtacccatgctatccacagatcgcagagcataaatggagtccgataacatagaaacaatccattcgcacatgccactcacacatcgagaattttggactcacgcaaaccgtaactctgctaaactccaggaaacaaaaaaataaaaaaagtgtaccatacaacgagcctaaggtatataaaaagcatcgtcaacatttttcttcgacagatcccaatcataaaatttttggattttagctgaaacttgtgctttttggatgtccaatatctgttttcttgctatgtgcaacttaagagccactcccaatccaccgatagctcggacaggacgacggatggctgatcatgcttggaagggggaacaatcgcacaatggggagttagaggtagccgcacttatgatttttcttacacagaggtgaacttgtaccattggtaagctcttagcggaaaccttcttgacaaagttcaacaagtctaagctctctcccctgcgtcgccctcccccggacagctcgggaggcgacgtgcccgccgccgtcttcctctccccgtctcctcctctgcctcgccgccgcctgagcgggcgccggcaaagccgcgcggccgcaaggacggtggcggcggggcttcatctcacccacgctgcgctcggaggccgggggagctgtccatggcggtggcggtggtggccagatccgcgccgtgttcgcagtatctggcaggtggatggccggcggcaggggctgacggtggtggcggcggtgctggtggcggttgtggtggcggcggcgctggtggcggatatggtggcgaaggagatggcgacgacgacggcgggccgcggcgctggcccggcttgtcaaggacctcgccgccacgagacctccggcgcagcggcctcattgatgctccctccacaacgtcgacgacccggacagcgcgctgcacctccagatccgagccaccgaggccggatctagccggctggcagctggcaacggtggcggatggtgacggtggcggctgtggcgatggcgggtggcgacggtggcgcctgtggcggtgatggttggcaggccatcacgaaggggctgacggtgcgtcgtcgtaggtggcatcttgtggaggtggggaaggagtctggcagtggggaaggagaccgggtgtgggcgcgacgttgacgacgggaagatctgtggcagtggcctaggccagatcgctgaagggacaatgtagtcgaccggcgacgatccttcttgtgctgattggttgtgtgggtttggataggcaatcactgccgaaagcctcgccgagccgtttggccggctgactgtggcatcgccttttggcgtcgttcccctccctggaggcatcgttttcgcatacccctctcctttccttaccattctccgtgtgaaaaccttgcttcggcttccgatcaagcagtggcggccatccacgtcgcgtcctccttgggggcaccactttggagaaacttcttcgtgcaaggatgtcgttgatggtctatccatttgcttcgaagcttttcagccataggttttgacgaggccttcgctttctcgctccaccttttgttttgcggtggacgacatcactgtttgtttgattttgctaggtggagtcggagctgcttcgtcggggtgacgaagctgcgcaacaatggcatgctgcattttccttctaggggttttgttgttagccgtgaatagattgtggcgcttaggcggctttggcttatgttcatcgtggaaagtcgaagccacttgatcatttgcagcatctaggtttagatggtgcatccggtttgaagtcggagctattgtgtcgcttggcggcaagctcagcaacaatgacacggttggaaagtcagaaccccctatgatgtttcggtcaaccttggtaacgacatcctacattgggctccgttagtggtttcagctgtttgtgagttctggcgtgtactgtgtaactattcagccagccggtggttggtttttcttttcttgtaacctatctaggatagtagtagattgaactgtttttggagggttaaacagtggaatcagtcaggccgcctatagacaaagttgtagagttttctccaagctttccatattggtaaaatacaatttgatcggatgagtagaactcttgatatagttgtttctgtatgtaccctctaaaattctggacggattctgaagcctgctttcaagcgcaaattagaccacttaaatggcagaataaaaatatactttctacataaaagttgtaggtattgttctgtagattctcaaaatgtatatattttcagtcatagccttttatatttcaagatataaaggtttgaagcaacagtcttgtgtatagtccaagcggcgttccttgttattgcgttttgacgggatggggcagtaggttcacctttttcattgttttatatgcatgtttgaatgtgttcgctgaggttttgtttgtgattaggtggtggtcctttagatcgtgtatgataccaacccttcattggtggaaagtgcatgacgaactaattatgtgattcatggattgtttgctctatctatttattttcgatatatttctacgtgacatgtgaccgcttatattcacattgttgttcaagccatttaggttttcatgtttatcctatgtttacgatgttattctggtttcaatattccagattctggttctaaataattcaagttccatgcttgccatggatgtgcaatatggttttaatttggttctttgattctagttttcaattattcaaggaccatgcgtagtcatgggagtgcaatttggatctttattcatgtttctgtgggtaagagttgatcacgcttactcggctttgtcagcaaatgctaggatatattcactattatccgggatggaaactactatttcaattcatgcctgcccgggatgggaactactattttctttgacttagtgtttgaaattgtatttcttatcaaagaaagaaagctttctgttcgtgctctattgctaatgatgtgtatatgtgctttctagttccatattgtacttgttgagtatttccgtactcactcttgtgtttatttggtttttagatacacattgagatcggcatgcatgggcgggaagtagcacccttatatacacatttatctacacactaccaaactatattgcctaggtctataatgatacttaaactatatcatggttcggtcttgtaataatcttttagatatcttttagtttctttctatgggctatatggatggatcatattgtgggaatgatattattattagttcaatttataactgtttgtcgtggatgttgttttgagtgtattttagtgtggcactctaggtacgtggctacctggggcgttacaattacttcaatacatctctaatatttaaaagtaatggatccacaggtttaaatataaatcaatggtagatgctctgttttctcataatttggtttaatatttcttgaatttattagagtgtcaggtgtgttgccttaggagcgtttgtagagattaggagggtgtgattagtttaacagatccaatctaattgttaaaaataaaatgttaactataaatcaatcgtcagatgttttctttttttgttagaacttttttggtttttctctaatttattacagcacgatgtggtggcttaaaattatttgtagcagtgccatgtggcagcttaggagtgccatgtggcagcttaggagaatttatatgttgttcaatggacttttagtatataataatattcttgcctcaatgattggtggatagcagtacctatgtagaactgatacatgcgtttgagtgtgacatagaattgacacataagttaagacttgtaagagtcaagtacaccggatcttaagtttaaacttcagaaactgaagaggtaaagatcaacatatatgcctcctttcaatcatggctagacacattgatgctttaatcatgtagcatattttcttttattttgtttctttgtaaataactttcctttatttaatattattaccacagtaggagccactactgcggtttctcgtcaaaaaaaaaacatatatgcctcctattattctaattaagacatatcgatcctgatcatttaatcgtttattttttataatcctttaagtagggaaaatatgtagtaaaaaccacatatgtagtgaaaactt

SEQ ID NO: 7814 - DNA, 14315 bp, Oryza sativa
gtccatttctcgatccaacggtagtttccaagttttcaccacatatgtggtttgcactacatattttcccctttacgtattaaagatatacttcctccgtttcacaatgtaagtcattctagcatttctcacgatgttaatgaatctatataacatcaatgtgaatgtgggaaatgctagaataacttatattgtgaaacggagggagtaattatattaaaatatttattaggacatatctagattaatattattgtcaaattgacattttaaaatggaggtagtatttttagtgcgaatgataattagaatattttagtttaggatattgtagattgctttaaatattaaagttatgatgatgccaaaatatttttcatgaaatatttaagtaacaatatttttttatgaaaattaatattattttaacaaatcaatattttagaacggtggtattatcttttgaggtgctaatcacaactagttagagtattttattctgtgatattatagagctaatctaattattctgtatgattgtgatgtgatatatgatgatatgatctacattatctattttcttcacaactttttttgttgggattgtgatgtgatatatgatgatatgatctacattatctattttcttcacaacttttttttgttgggatggcatgcaaaaatgtcaggacaatttaaaataatagagggaatacatgttttttggattgttatttacaatttaatggtttttatttttttcatatctatcgtatttaatttattagtgtatgttttgtaaagtgatatatagtcatataatatacattgtcatttttgtctatttttatttaacagattcaattgcatgctaagattaggatgtgataaagattaaatatttgttatgagttaaagaatgtagtaacttggaatggttaattaagtaccatgaatacattaataaagaatgataaaaagattgtgtaatttaaaggatacgattatttttctatattatttgtaattggaacatcttaaaagaaagaaagaaacagacgagaagactagatgaggggagggggcaagcaacgtatacgtacgtagggggagcaaccaaattaagtacgtacagtaccgggggggggggaggggggcacaggtggattgtgggtttgtaaaaataaatctaatagataaaagtagccatgtggcaacttagttgcgtttgtaggagtcacatgtgacagtgtgagagcgtttgtaggaagtttaatgaacttttagtatataactataaaggaagcccacgcaaatgcgcgggcaatttatttattgtttataaaaagaatactaaaaaaattcatgtctcactctatccattataagaaccctagattaacatataatcgtaaaataaaaaatatttatatggttaaatagaccatagaatttatatactaaataaaaatgactatcatattcaaacagaaattactttgtctcaattttatgtaaactcgcttatcaccatcctccgcaaacataatatggtctttgatttttttttttattatacatctaattcacctatgcatgtttatgggtaatatacgaaggaatatttatattgttaaaattatttgtgctaattgttaatgctatttacatgagaacgacataattaaaaataatattatatggttccatatgacatttttaattgtacgtatgtatatatattttttctagtgaatagtaatctctcatacgcacttacttttttccttttttgaacaaatatttttctctcatatgggtagagtatgcgtatatgtattcatggagtgggtatgtacacgtttatatgagcgcctataattacctttacaatattttaaaaaatactttcaagaaaattggtgggatggcgtgaagtggcgccatagcggcattgcttctttgacaacatcgccaggagtggtttactatatacatgtataatttgaagaaaaccttagggatacaaagagagaaacagaaaactactgagatgggacagatcgtatgcactcttctatttttcttcttttcaatatctcttgtgtgcatacgtacagagggatagattagctgatttttagaagcaagggattagaatatatctaatctaatggttgaaaatggattgatcggtataagtgtaaattgatgaccagatgttttgcctttttcttatatttagcgtcacatagcatcttaggctatgttcagcagtggctgttcccatcctcttctcctcgttttccacgcgtacgttttttaaactactaaacggtgcattttttgcaaaaagtttctatacgaaagttgcttaaaaatcatattaatctatttttagaaaaaattagctaatacttaattaatcacgcactaaatgctgctccgttttgcgtgcaccctcactcccgaacgcagccttaggagtatttgtaggagtgtagaaatgctattactcatactcacaatctatttgtagttaactattatttgatgtggcttggtggcactctctatttaactatcattttgttcatacatgcccttaggctgatcatattgatccatttttcaagttttttttggctaatacttaattaatcatacgctaataaactgctccgttttctgtgccagcgggaaacgttcccaactctaacgaacgaaaagcagcactagtatcatcctttatcctctgtgcttgatgacaaacgtgttcattggatgtcagctaattattagacgcactgtgcatagataccatgttagcaatatgacttagcaattggtggatagtggtttgtaaatagaacttatatacatagggataaattagtggggacattattgaaaaattatatattgtatgctacatattagttttagtacatacataatatatttatagttatgttctaaaatgcttatctgattggctactcacttagttatcgtgactacgtttaccgaattgctaactggtgtgtatttgcaaaatattttctatacaatttttttttcaaaatcaaataaattcacttaattaatattgtgctaatgacctacatcgattcgtgtgccctggacaaaggctaagtaggagataaagaacatcaatatggtgttaaaagaatatatttgttctttaattttccaataatatatgaatagagaaaacacaaaatacatgaaaagtacatttatgataaatttagaagtgtcattttgatatatgtgtattttttattgttggagttatttttttcgaaaatataagtcatatctaatttaactattatataatctacatatttcaatttatttatgtttttcatggattttttgatgacatgtgtctaattagaatacaactcgaaataacatattccctctatcccaaaatataataatttttcgctatgaatcgggactaatgcttgttcagaattatagttaaaagttagaatgtagtacatgaaatagcatagtacatgtgtattattattcattatggttttagtatatttttattgttttgttgctatttggttatcacgcaaatggcaaaagtacgtatatgtttaaagttagaagagtgttttcttatatgtggatttaatggtttcaccggttaaatgttatagatctacttccattaatgggtaattgttttctttataatattttttaaaaaattaaaatattagatagaatataggaaggtgagagagaggattattggacgatggaggaagtgtgcgtgcccatgtgcgtgcacggggtgttcggagggattagtctgcttttgatctaatctaaataagaaaaaaaaagatgtgcaacgggagtacataagtacgtacatatgtttgtttttccttttttggcaggaatactatgtacatacttaattggtagtttttgatagatattttctggaatacttacgtgtattttttagtagatgtcgatgtatatagatctaattttattggtataaaataacgggtccaccaatttaaatgcaaatcgacggcaagtatagatctaatctaacagtataaaataatgggtctaccaatttaaataaaaatcgacgataagaatagactgcgtcacgtggtggcctaatagcgtttaaagatagaacgtttgaagagcattgattggatactttatttttatattaatttccgtaaatttatagagtaatatgttttatttttaaattgtagaaaatcctattttatgtaccatcgatttttttttcaatgcactacgtacctatatttacttttttttttactatacgcagctttttttccaatcgtacgtacttacggaatactttttgatgggatacatatacggagtttttgtttggtttcccggcccacagtaaacatgaaaaaagtattagtttttttaagaaaataatgcatctaatctaatggtctaaaatatcgggtccaccaatttaagcgaaaatcaacggtaagattaaacaatgctatgtggcagtctaggaggagtgtttgtaggagcgccacgtggtggcttaggagcgtttgtaggaagtttaatgaacttttaatatataatagatagatagataatagatagatagatagatagatagataatagataatagataatagatagatagatagatagattggtagctctcctgctagtttagttttaaaaaaagttcaacacaagtcagtatatgtgtaagcatatgcatatctcaccagatgatttcatcgacactcaagtgtcggaattctatttgttactttagcctataaacaatcacgtttctaattgagaaaatcaatctactgattgctgcgtttgaagccattactcttgattcggttttcttcttttcttcttctttcttctcttgcgattgctggtaaccacgacgcccttcgggtctccactggcactgcgccgagataggttcacggagcccttccagtgcggagccgaacggtggcgtttaagggtttggtttttgctcaaaaggttcaagcgtactctctaatttgcttctctcttcttataatgtactagggggtcccgggagcttatcttcaaccaaagttagttttaaccagtcacaaaacaaacttatctcttatcttcttagttcagattgtgggctcatcaaaaaaatcaaacaacatgaacatgtgaacacactggacgacgatttctagcatagatattagtgttgtagaaattctcggaaatacacagttgggcacaaaaaaaaaattttctaccaacatttgctcgcagatagtgagctatttttatgttgtagccccatttcaaaatataaggtatattatgtgtaagaaaaatataagttaatattgcccacctatatttaaatatattggaaatagggcactggttttagagtatgcactaaacaggggcaaccaaacaaggaaaagaagtaataaatggaaagcatatgcaacattatttggtatgcagcagtcactcactacatgaatcattcgtagtcgccattcctagacaaagctattgttagtgatattatcaagagacaattatagagatgattgtatcatatattatgtttacatatttatccgactttgttccttgaaatagataactcattattgattaatgaatatgtgattctttcatgagactctttatgttgtgtgttgctatttctaaagaatccctgatcaaatatcatatctggaacaaatatgtttagatgatcagcacatatattaattgatgatcatgtcccatggattatggtatagagataccaaattaataatgtggacacatgttagtgaacatgttgttggaaagacccaacatgagacactgcaagagccatatgtgttgtgtcatcagtgatctcatttagtattggtgttgaatccttagacctgagattatcatggttcccaacatgtgtagtagcttacttagggactgctaaatgctactctataattgggtagttataaaagtagttttcgggtatgctatgaaacttgtagtgagatatgaataatcaagatgggatttgcccctcctatggagagatatctctggcccctcgatgttgtagattatgtaagtgcatggccatgccaaaggtgattgaggagtcaatcacaagttatataatctatcaataggttcgagtgaatgattgagctattagatgatagcatatatctagccttgagattaatcgatatcgtgaggcaaaggggttcatacaagtatacactagaggttcagccgatatgatctttatgtatgcccggtgggtctatacgttctgctcggggccgctgttttcgggttacagccgagtgcacataaacctacagggtcgcacgcttaatgggccggaataagtggattggatggagatctaatatgagcttaatttggatagggatccgaatatgagtcctacggcccttggaggcccgagtgatgtatcctatatattcgtgaggggtgtgaccggcggaggtattgcatcacgtgagaaaccctagccgtcactcccctccccgagcaaaaccctagccgcgcgcgggtgctagcacatttgtgcgtggcgttctgtccctgtacgtgtggataccgatagaggtgccgctagtttgcggtgctaatcggcgtgggaatacggcgaggagaacgcacgaagaggagaaggtcgagctggtgcgatcgactacttcctctacatcgacgcgcgctacttcgtgagaattcattcgacttcttagcgccttattccgctgcgcagcgcgtcgagtggtaacgatatatgatctaatacttgcatagttcctggtttacgcgatagaaaattttaaattatgctatcgtagcctacgcgtatcccagcagctacgtgggtgtcgattcattgataggaatggaagggatccggaacagaggaggcatctaccaacaccttacagaactctatcaacagtaatggatcagaacctgacgaatctctggttatctatccggagcaaactgcagtactctacgggcttggttgtagtagcgcgtggttggaggtagttttaatcgagatggccgcggtatgagtgctgctatccgtacttacgagttgcgacccacggttgtataacttatgtagactaaaaacattcaaccatgcatggatcaatcaaataaaacgatatgtttgtttacactacagttatttgtaccggttgattcaattcagtcgcacatgagtcgaacgattaattgggccagatgcacagcaattttcatggcagtttttgggggtgtgggtgaatgtggctgtacgtgtttagttccattctccttctggcttgagtacaatcacggaactcagtttttctcgagtgaagtgacaggaaataatcatgtgatagacaaataagctagcactctgtcccaaaatagctgttgatctcctaacattagaaaataaattaataaacatatcaacttttactcaataatcaaagtttagcgatgaatttgaacaaattgtcactaaaattaaatatctttggctggaggaacaaatcaggaccaacaggtaaatccaaaaattttcaaccaaatgctcaaaacctgccagtaaacattcaaccaatataaaaaaaattacattactccatccgtttcatagtataagtcatttgacgagtttgaccaaatttataaaaaaaaatttagaaacatctcaatattaaattagtttaattgaattcaacattgaatatattttgataatatgtttgttttgtgttgaaaataaaattgatcaaacttaatatgaaaccgagggagtaaaaagcaacccacgagccagttatagtaatttgcagaagcaatcctcctctctgcgcttgctcgcagcagcaacgcaaagttgactaccatgttctgtttctcactccagtcgaactactttcaatttactgacatacgtccttatgcaagattcacatccttttatttaagcaaatctgataaatcaagctgatagcaggctgataattatgcattgaacgtttgcctccagtcggaacatacgagcacaaatactccctagagagagcatagtccactactgaaaaactaatctttactcggataccaaaaattacatttgtcgtcccggttcgaatgaaaaagggactaaaaatcgttttcccacaatagctgtcacgcctccaaccggttagttttggttaccaaccgggactaaagattaacgatctttagtccaagttgatatcaccaatccggactaaaaattgatttttagacaccaaccgggactaaagatgcctcctaggttagtttaaaaggaaagcatctctatccaagtcacatgtgtgtagtaggtgggatgataatgcacgtgggatgataatgcacgtgaagactgaggtgatcgagagatcttaagtatgcatctttagtcccggttatttcaacctgagctaaaaatctttagtcccggattgtccatcccgattacacaatcgagactaaaaagggctgcgaacccaattaatctcggactggtgcccagggtgccgtttattaaggggtctagacggaccactttctacttagtcttgatttccacatcgtatacaaataatactatcactgcttatttttattttgaactaaccaatttccaacatcatcatataaaaaggaatggagggactaagtttttcacataggaacatgcatggtaccacctgtgtcttaaaatacggcttctagtatttgaaattaaatttgtcctgagaaatgaaacatccaaccttttttctcacctcaaccaatcaatattacatctcacttaattattccaccaatttcaacatttaattttaaccctctcctcgatccatgtaaaaaaaatccataaattcttatatttcagtacagtacagatgtaataattgatggacagacaccacactggtggagaaagcgtttgtagttccggttcgtaacccccctttagtcccggtttccaaaccgggactaccaatctgggactaaagatcgctatctttactcccgggtgaaataaccgggactaaagatcgatatttagtcccggttggtaataccaaccgggactaaagatggctcagccacgtggccggctgagccatctttcgtgggactaaaaatcgagctgacctttttttttcatgacccggttgctgcatggtttatatatatatataaccatgcatatatatatttcaatacatatttatatatgcatatatatatatatatatatattatattatatttatatatgtttcaatatatatgtacatgcataatatatttgtatttatacatatatatgttatgcaaatgcatatgtatatatatatttgaccaaaatatatatttacattatagaaaatgtgtacacatgcatatagaaacatagtcatgtattaattacactacattatatgtcctagctagctacgattttgacgtagtagtagtcgctatctcagaagctaaggacatatgaattgtatttccgtcgtagtagaattcacccttgggatcaaggatttgttcgttgatgaatctcatgagttgttcttgaaccgccgcgataaattccttgtgtgtgatcaggttatccctcatgcgaataaagtatatgaatgtatgaaattgattagtaattaaacaacaaatcgatacgtaatgaaattttgaatttatttgtacgtacatcgagctctcttgtggtgatgatttgatctgcaaggcagtggcaatactcgcacatgtagtagccgcacaagttagttccctgcttttgctttgcacactataaataaatgacaaacgacgagagatctaattaatgtacacttgtatgtatttgaatcggagaaatataaatgtagagcatgtgtactcacaggaaatttgaacttctgcctaagtctttctctccatttgccgcggaccaaatgacggaaccgataccaagccctacatggagtttaaagctatgattcgtagtagcaattaactataacaagattcttaattaacatagaaacttatgacagtacctgtctataagttcgaaaaccttgtcaaacgtagactcttttttatccattgagtcatatacgttgaaggtgcaggcctccaggtcgaagagtaaaagcacccagtggaatctgcaatgtgcgtgggatgcactacatataaaacacttagcatgttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagaatcaaaaaccccccgccgttgggccctttgaatctccattctacaacgataaaagggagtatatattatatatagtctacttatatacaaggacttaattaattaaaggagacgtagtaagaaatctaactgaacgatatacttacaaaatccagcgactcataatagagacgtcgagggcgtccagctggtatagttcgtagattcccttgaaattgatcaagagaatgtcatctccttgcaagaagtccgtgtccctgatcctcgctccgatcatctctctaccggtggcgctcatctccatgtacagctgatggaacttgtacatttgtgtgggtagggacggcaacagctcaggcttgagaagcggtttaccgagttcgcacatgtatttcacttccgccttttcgattggtgcatctcgtagcaattgatctgtagttagcccgatgtcattaataaagtcttgtattccaaaaacttcaccggtcaccaacggctcgatctcctggtttggttgctctccaagctgagggactagtttggactttccagaagatgctttcttgagtgttcgctcatagtccgatagctttatggcctccttggcaggtgcagacatacccctgaagaagttcctgacactcgggtctataggaatcttcttttctagactacgaggcttgaattgtctcctgacttctgatgccacgtaagcgtcaagctcctcttgcgtgcaatcgtaccccgggtccttattcttggcggcatcaactttcgccttcttcgttgcccttgtaggggtaggcggaggagccttgggggcccttgacttggaaggtgccggaagaggagcctgaggaggagtcggtgtaggagcctgaggaggagtcagtgcaggagcctgagaaggagtcggtgcaggagcatgaggaggagactatgcaggagactgaggaggagatggtgcacgagacgccgcttgtcgccaagggaggatgatgtaccacttgcgccatagaataatggcgtggcttgtgtcatgtagatgcgtctcaccgtctcctctagggtaatccagctcgaggtcctcatacgcgccttcgaccaactcaacttcgaccttggagtatcctgctggaatcggcctgcagtggtaagtacctaaagggtccgttgggatggccatgcccgacgccaccttcatgtggtgagaggttatttattagtaatcaacatatataagtagcaactagcggaatggccaaatctaaaatatataaactacgagcttacctttattgataagttcttgaagggaatatacagctcacatggtgtccgctgagtgatgtcatcaacagggtaggtggtttcgtcctgggtttgcatggcgtccatgctctgtgatcctacctgccccgttgaggcgcagctgctacgatttcctgacgggctcaccattgcaggaggaatggtcggctagggatcatgggaccgatgtacggccatgtgttcatcaaccttccttgccacctcctcttgcaagctgagctcgtagctcgataccctgaactcaagatctgcaatctttgcctcggtatctctcttaatcctcatccgactcctgtacgtgtggttgtcctccttgaacccaatcttccaaggaatcacccctttccctcgtgtttgtcctagatgctctggagtctgcagggcgagtgacagctcgtccttctctctgtccggtcggaacgtgccctgagaagaggctttcaatgcgtctgttagtcgacgcgcagcctcgcgtatctgatcgccgaagactagggagccatcagctgggttgagcgttcactgtgagcatagtaccagaacttcgatcggtccggccaattagcgggggccggttcgatacccctttcaagcaagctagccttcatctgctcccacttcgacatcgcgacgctatagccgcctgaccccaagtggtgatggtactacttcttggcggcattttctttgttcctttccatcatcgcctgctcttgttcacctgtcttatatgcaacgaactcgtcccagtgatccattagctttgggaatgtgtcgaagttcggtgtctgccccttcatgatatatttctgatacagatctcccttgaagctctgaaactgttctgccattttcttcagagtccacgttttcactttgtcctctgtacccgcgggaagggtgaatgtctcgagcattgtggtccacagcatctctttctccgaatctgggacaaatctctcatgatctccgcgtgcccttgttctgcaccagtacactgtactgacaggcacgttatcccgcacaacctaaccgctgtgacgtacatagttcttggcggcttctaccgaggcactaggtcggccgtcttcgtccacttccgttatgatgtgccgaccctcaagcttcttcgcggcatctcgttgcccgcgtgccctcttctgtccagcggagggttgacttccactagcctcctcctcttggttcccctccacatccctctccacgtgcccctcctagttcccctccgcatccctctccacgttcccttcctcgtttaaatactggtttgtgtcctcgttcccctcttctttgttccagtattggctacttccctccgcgattgtatcgtacaatatctgttcctcatcgcgatcagccatctgttcatacaggaaacagctgctaagtcatgagacatttatgttttaacaatcttatatgctaacaatcatatatgctaagtcatatatactacgtctaactgtcgtatatgcgaagtcatatatgcttggtctaactgtcgtatatgctaagtctaactgtcgtatatgcgaagtcatatatgcttagtctaattgtcgtatatgctaagtctaactgtcgtatatgctaagtctaattacaaatctaataatcgtatattaaaacaataataatcttatacaaaaactcaaataatcttatactaaaactcaaatagtgatatatgctaagtctaggtgacgtatattataggaccctagctagtcaataattatatactaagtctaattacaaatctaataatcttatattaaaactcaaataatcttatactaaaactcaaatagtcatatatgcgtagtctaactgtcgtatattagaaccctacacaatcatatatgctaagtctagttacaaatctaataatcttatattaaaactataataatcttatattaaaactaagtctaattaagtgtcgtatattaaatctaatagtcttaattgcattacaaatataacaatcatatatataattacgtcacttgcctgcgcgaattccttcgagggctagctaccactccggcttgagggacgacttcgacaacgtcttttctgcaacatacaaaaagatgtattaggataaacgcgaagtaacatatattgcatttgacattcacgtttcgttcacgatcattcacgttcgcgttctcgttaaggtcacgtttcattcacctacgttcgttcgttcacgttcattcacctgcatatattgcattccacgttcacgttcgttcgctcgttctcgttcacgttcgctcgttctcgttcaagttctcgttctcggtcacattcgctcgctcgcccccgttcacgttcacgttaattcgttcgacgccgtggc

SEQ ID NO: 7815 - DNA, 3391 bp, Oryza sativa
ctcaacaaccaggagtaaagatatccttactctcggttgttctcatcaaccgggactaaagatattttcccgttatttccaaattctttttaaacccggttagggttaagaaccgggactactgataagcgcactgaatattaatttccattacatatgtgtttctaaaatagaaaataatgcattaaaattatttaaagtacaaaaattaatgacaattacttcgaaaatttattgttgtctgtaataaattaagtggatgaaacgtaataagcaaacatatgatttaaaattaataaaaattctaataatcatatatacttagcatatgaatgatattaaattgttaaaaactctaattaacatatgtatatacatacggcatgatttaaaattaataaaaattgtaataatcatatataattagcatatacatgatttaaaattgtaaaaacctctaataatcgtgcgtaattaacatatgccatacaacaatttgatttatatggataatcactacatccaaaatagtttacatcgtatacacaataattacggcaatacatcggcggtgacggttgaccgcacatactttctcctcactattgttccctccttgtgatcgctacgtgagtaaggggtgtcttcatttgataggaggatgctagggtcaatcgtcaccatgaaagggggttgcccatccaactgatcgtaatcctcatcagtcttgtcctcaaccccgacgatttttcttttgcctgggagaaccacgtgacgcttaggctcgtcaggccctctgcccttctttcctttgctcgacatgtccttcacgtaaaagacttgcgttacatcattggcaaggacaaaagattcgtccgagtatccaaccttgttaaggtcaaccgttgtcatcccactgtcatcaatcattacgcctccacttgtcaacctaacccattggcaccggaacagagggaccttgagaggaccatagtcaagttcccatatgtcctcgatggcaccgtaatacgtgccagttgttctatcgtgtgccatggcatcgacacgaacagcactgttttggttcgtgctcttcatgtcttgggctctcgtgtagaatgtgtacccattgatctcatatccctggaatgtcgcgatcgacccagacggtcccctcgccaataaggcaagttgttggttgatcgactcgttacccatgagatgttgtcgtacccacgctgggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtgtaccgtcattattgctttccttccgagagttccctttccccgtagtctcccttcatggcgtgattcaggtaccccgattgggcgaaggtcttcaataaattctacgcaaaattcaatgacctcctctgttccataacccttggcgatgcttgcctctggacgagcatggttacgaacatacttcttcagaacgcccatgtacctctcgaaaggaaacatgttgtgtaggtacataggcccgagaatactgatctctttgacaaggtgacaaagcagatgcgtcattatattgaaaaatgaaggtggaaatatcaactcaaaactgacgagacattacaccacatcattctgaagggcttctaatctatccggatcgatgaccttctacaaaattgcgttcatgaatgcacatagctttgtaattgttgcccagacattgtctggatggataccccttattacaactggtagcagttgtgtcatcaacacgtgacagttatgagactttaggtttgtgaacttcttctccttcgtgcttattattcgcttgatattcgtggagtatccagacggtacctttatgctctccaagcattcaaatatactttccttctctgccttgctaagagtgtagctagctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcatgaccatcttcgctctctataggctggcttccaggcccctttccgaacactactttaagatctttaaccatagcaaacactgttttcccgctgcgatgtttaggctttgtacggtggtcagccttatgttcgaagtgcttgcctttcttccacaccgggtggtttgctgcaaggaatcgacgaggactgtcatgtcccaaaacgactctaaaatatatcccttaaatgatgcctagaataattaaaatccgtgtgaaagcctccaacaattaaaatgtgcaaagttaaaagccaaataaggcttagaggatttttgtaaatttcctaaaagtctaaaatgcgtaaataaattttagtggaattttcagagcacaaataataattattaagaaataaacaaagttaaaatgattttataaaaagaaaaaccctagaagtcccccttccctcccttgggccggcccggcccatctctccttccccccctctctctctctcctctccccgcggcccactcggcctctccccgcgcgcgcgccgctgacgggcgggcccgcccgccaccctcgctgacgggtggggcccacccgtcatccccttcctcccgcagctcccgccggcttccccgcgccctagcgccgccgccgccgccgcgaatcccgctgcctcccgccgtccccgcgtgcaataaaatggggggaatcactccacgtaatcccctctccctttccccctatttttccctctctctctctcgcgttcaaacgggcggattcgcaaatctcgccggcgccattgatggcggccggacctcccgcgccggtttccttcccctccggccgctctctcccccttccaaccctatttaaaccctccccgcgcctccctcgcccgtttccgccccttgccgcaccgtctccccgcctgaatcgagctcgcgtcgtcgccctctctctcctccgtcgccgacgacctccggccggccttctccgctcgccgggaccgtcgtccgccccggcgtcgcctcctccggcttagccgcaccgccgtcgaccccgtccaccccctcgccgagtccgccgaccgccggaacgccgtcgaccccgtcgacccgag

SEQ ID NO: 7816 - DNA, 15158 bp, Oryza sativa
ctaatttttccttaagaagtcaagaacccatttttgtgctttgttcctgcttgttgcagcttcggaagatccgctcttcgtggaggttgaagccgatgtttgggaaagtgagcaaggcaagtcacatcatccttgaacatattgaatcccagtttataaaattattttgatttaaattattgcattatcgctttatttaaatttccgcgttatcactgttttatctagccatgcctatttacctttgttatgaccttattattgttattgttattatttccttgttcaccctagaaaaaaaacaaaaccccaactagtggacactctactcatggtaccactagtatgattttaggtagatgcttcgctggttaagtaggcaacattaggtggttttacaactctagactttgggaatactcttatcacctggacactatggaatggttggattattatggaattggattcacacctccccctctattcaaaaccctcaaaatggttttaggctaggctcggggtgcatggttttgatagtagcacctcggccatataaggaccggtcttctggcctctgttgcaaagcactaccgtacttccacatgtctagtgggtaaggcttagtttgttgcttagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggcggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacttgcctaacaactaaaatgtggaatggttggcctgggttggtttgggacgagctgggacccagggtcgggttgccagtttggtctgaatcatcgtaggccttgggttaaggcaggttcgtgtgggttcacggccttagttaataatattgtatagctctaggaccgtgtttacaaagtagctttgaccaactaagtgacttttaatgctgtatactgcaaaccctaaccccctatattatggctcccttgtactcccttgcatttattctgcacttgtgggtgtgtcttgttgagtacggtggttgtactcagtcttgctcaattttttccaaacccagaagaggagcccctggatgatgaaggctttggtgtctagctcgtgcctgccgtcaagcgcatgtggtcgtcgccctagtcttccgctgtttttcatttgtcttcttgtgtgctgggtcttcgccgcccatgtaataaattaattaattacgcttccgcttattaaactctgaattgtatcaatttttggtgtaccttgcctcctgggacaaggaataatgcacgcacgtaaggaacgcccgttgggttatttccggtcgtgacaatgacccatatatacaaccttcctacagtgcttaagatacgtactttctgtttcatccatacagtgagtgcaacccttgtaccccttgttggactatccggataggttgctaagtgcaggccaatcgttgatggttacgaacagcagcgctcgtaggttaaactcctcctgtttgtccttgtcacacacggggacaccttccttcttccacaacagtttaagatcttcgaccagtggtcttaggtacacatcgatgtcgttaccaggttgcttggggccttgaataataatcggcatcattatgtacttcctcttcatgcatagccaggggggaggttgtagatacacatcgtaacgggccaagtgctatggccgctgctcatctctctaaaaggatttatgacatccgtactcaaactaaactgtatgtttcgtgcgtcctttccaaagtctttaaattttctgtcaatgtttcgccactgcgaaccatcggcggggtgtctcaacatcccgtcctgttgacgctcttcagcgtgccatcgcatcattctagcatttctcttgttcctgaataaacgccttagccgtggtattatagggaaataccacatcaccttagcaggaattctcttctttgttagctgcccgtcaacttctcctggatcgtctcgtctaatcttgtatcgtagtgctttgcaaatagggcatgcttctaggttctcctactcctcaccgcgatataggatacaatcattcggacatgcgtgaatcttctgaacttccagtcctagagggcagactatcttcttagcctcgtacattgtctccggcaatttgtttcccttcggaagaatgttcttgatgagtttcaataaatcgccaaatgccttgtcactaaccccattttttgccttccattgcaagaactccagagtgatatccaactttttgtgcccctgctcgcaacctgggtacaacgacgttctgtggtcctctaacatcttatccaatttatgggcccccttttcactttcgcactcctctttggcgtcctgcaacatctgaccaagatcatccgcaacgtcgttaccatcagcatccctttcctcctcgcccgtttgatttccttcaaatccaacatactgagcaaagtccggaatattgtcgtcttccacttcatcttcttctatttcaacaccttgctctccgtgggatgtccaacaattatagcttggcatgaactccgactcaaacaagtagaaatgaatagtcctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgagtcgaaaaaaaatcgtacacaaataattattcttacaataatgacagtcatacaataattataagataattacaaactctttcaacagtcatacaataatgacatatctttattcatacaaaaatcataaaatattacaccaagtaattcttatttactatttctaaagttttaaactaattttaatgtgttttacttcttttaattttcattttagtttgttttttattatttaagattaactttcactatattttccttctcaactattttataaaaccttctttagcaaatcaactaaatttctatatattctttcttccccacacaaattttctctctcatcaacttacaactaaattttggagaaaaaaaactgtgcaaaacatagctccaaatgtaatatgacaaaaaaaacattggaggatgaagttgcaaaccttttaggcacctccgatttgtatgtaatcacaaaaataaattcactagaaattttggcatgacctcccctcttttttgaagaaattttgaagcttgctcgggcagctggaggaggaagaaaacatatatataggggtgggactttagtagatccccgagatctttagccccggttggtaacaccaaccgggactaaagatatgatctttagtcccggttggtgtttcctgacagtatttgaaccgggactaaagatagccccggtttttattgtatccgggactatcgtggaattcggccgaccgacgaaagacggtttctccaccagtgccatggcgtcaatacgaacgaaataaaagcgcctgcccatattatctcctagggttcggtataaaatatcttagcagtctttcttgtgcctctcactctctcagtactccacccaagatcaactcaacgaagaaggcactggataagaaatagaataaccagcattatattggtccccccgtgtccgccatgcaggtcccacgtgatacttacgtggtgaacagagatcagtgtatgtaactagaagaaaaacacagaagaggaattagctgtgctagctagtctagatgctggaaatgggaggaatctggaatgagctagccagagaatccggagaatgatgggaatgcacaccggagactggaaagtgccgttgttggacaaaataacggcgcccgtcaagggccatggctgcaggcagcggtatattgcctagccgtgccttcgaagagtatggcactgaagttgcatcaaacgagatgtatgtggctctctgtaggttcaggtgctaagctatagctttggttttttttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgcgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgactgcaatcctgcgaaacaaggttgcacggacggtctgccctcaacccgaacgacgaacccagcatgggtaccactgtatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaattccaccccctcccctcacgccggcgatcggagggtcgccggagatggaagggaaggggccgggagaaaaggggattttttttttctcctgaaacgcctgtttcgggagagctcgagaggctcgcccatcctcctactactccttgaggtctcttcagctatagctttggttgttgtcccaattccaaccagctaagagcaggtttaatagtataatcagcaacgggctacagaaactccaactcagcaaaaaaaatattttctcatagtctattctctctcattgagggcattgggaagcgtgcaaatggtgagaaaagtttgcagctgcagcatgcatggacgacgattggtcatgatgctttttctacggctgcagcccggccatagattaagcgccagccactctctctctctcctattttgtcactcttccatgtaggatttatcttagatgtatagtactaccgcctgctaactgtaccctattgtacctgctctaaacaaaacttgaaggcttttctcggttcgcatcgatcacttaatgccaaaactgcaccgtagttacacaaaaatccaggacaaactgcactgctctgataggtattattgaaaaagaaatccctctcactttaaaatgtgtggtttggtctgtacattgaaatcttctttgtcatgtgctttaatttgcaattatatatgtagaagatgcaaaatatcatcctagtggcagcctataaaaattgattttcatatacaaggtgagatccacattagttcctcgccattattaggctccgttgggtagttcaagttcccaactcctttttctcgttttccgcgcacacgcttttcaaactgctaaacggtgcgttttttgtaaaaagtttctatacgaaagttgcttaaaaaaatcatattaatcaatttttgaaaaaaaattagctaaaacttaattaatcacgcactaaaatactgcttcgttttgtgtgccgaggagtgagggttcccaaccctcactcccgaacagagccttagaagtgtgattgttttccactttgtaaaattaaatccccacctgcaaacatagtgttttaagtcaatgaccatgaaaactaattttccaggcggtcactagaatagcaccccccgtgaaccatgtgagtgatattacaaagctgagacactcctccagagatcacgcctctacctccttttctcccctctatagaccggcggagctcgattacttaatttattaaaagaagcatccgccaaggtacaagcgagagaaaaatgccgataactttagtgcttctctgaaactccaatggaagaatgtcgataaaccctacacttctccagaactttttggagagaactccgatatttggggcactcctttcgtattttcccctcactctctacctaattccgcatactaaagtggtgcctaaaatataagtgagttgttttgcattggagagtgacttgagctcctgcttttatagccttcaatgatggttgtagaggtcggttcaccgacaactgccattactatccaatggaaggctgccacatgcaaggggatggttgggggtgctagcacaggttcaactgacagccgaaccagctccaccgtcaccagccatcaactttatccagtgaatgacaggtgggtcctatgacggttagcagtggattggctcaagtttagtcagttttgactgacatgtatctttggtcggaggtgcatatcgtcgcatggcgggtgaatcttcctccagcattcacttgcatactcacatttaccaattctagtggaaatggttagtaataaacccttaccagtaagtttggtattctattttacatttttttatgcaggagttgatggttaaagtttgcacttaactaccataaacagtaatcgctatggtatgcctcataaacgtcccatcgctatcgcatctttctatcatcattttgtgaaggattttaataccattgccgcaccattgaatgagctatcggataaaggcgctctgttccaatggggacaatcccaagaagagactttcaacttgttgaaggataatttgacacatgcgccactactccaactcctttagtttggtaagacccttaaacttgattgtgatgctagtggatttgggaccgaaggtgtgctgattcaaaaaggtaaacttgttgcttattttagtgataagttatatgggcctagtttgaagtactctaattatgataaagaatcatatgctttagttcaaactttagaaacctagcaacattatttatggcccaaggaatttgttatacattctaatcactaatctttgaagcatattcgaagccaaagtaaactgaatcatatagtaattgtgaatcttttccttatgtcataaaacaccataaggataaggagaatgttattgctaatgctttcacaatttgatttcaatttttttttggtttgggagcgattaaagatcattatgtacatgatgttgattttaaggttttttattgtactgtatggaaggaaaaatgtggaacaaaattgtaattactaatggttttgtatttagatctcacaagttatgcattccagctagctccgttcgtttattgttattataggaagcccatggaggcagcttgatggcatattttggcatgaaaaatacggaggatgtgttggctagccacttctattgctcaaggatgaggcgagacattgagcactgcgtttcccattgtaccacgtgtaataaagctaagtctcgactaaatcacatggtttgtacatgcctctttctgttcctagcgttctgtgggaggatatttcaattaattttgttttgagattatataggactaagagggggagggatagtatatatttgtagattttctatgatgccacatattatacattttcatatgagcgatgatgctacacaaatcgatgagttattttttagggaagccgttcacttaaacgaagtgatgtctacagttgtttcagactgtgacacagtttgagttatttttggagaactttgtggaacaagttggggaccaagctgctattttccacaataaatcatcgctaagcagatggacaaaagaatttgacttcaataagtcatcgctgttaacagaagtggtcaatctcacattatcaacaatgttgcggccttatatggaaaagaatttgaagatgtgagaagagtctctaactcatgtggagtttgtatacaatcgctcattgcactcgaacccttttcacgtggtatatgatttcaatcctcatgctcctgttgatattttacctttgccatcttctgaaaaagtgaactttgatgcttctaaacgtgttgaatttgtcttaaagctgcatgaaaccactagggagaacatagaacgcatgaatgacaagtataaggtcactagtaatcagggtcgaagggaattaacttttaaacttggtgatctcgtgtggttgcccatgagaaaagaaatatttccatacttgcacaggtcaaaattgatacctagagccgatggtccttttaaagcaattactaagattaatgataatgcatacaagatttagttgtttgtagattacattgttagcgatgccttcagtgtggctgatctaaagtcgtagttgggcggagagcatgagcttgagtcaaggatgacttcaattcaaacaatgggaggataataaggacatctctaccatggatactgttgacagtcattgtcgaccagtttcgaccgtcaatattacccaattaatgaacactagctatgcttgcaatgcattattccataaataaaatattctattccactatatgcttggaaaattaaccatgcaggagaagctatcaaaatggaggagaatcgacagtacaacaatcgatcaatcaaacggacgctgtcgagaatcagacttatggatggatgggccaagaactcggaaatgagcaatcattctgagccaaaacattgtgtaccataaagtggggcccacatgtcagcatcctgaagaaggctgtgggccaggggagccagctaaggttcggcggaacccctggttcgtccgaacccccagctggcccaatcctgcccatcttcggccaggcggttactaccggcatcctatgacggttggagctaattctacctgaagaaaacatcgtggacacatggcaagaagagatgaaatatgctctttggatgcttcatcatgccacatgtcatgacgagagcaaagatgctcctaggatgcttgaagcatctccacactcccaaggcacctctccacctataaataccccacctctcattcattccctcacacaccttaagaagaagatcatgagctctcccaagttagtttagtagttctagtgctagtggagtaggaaataaaatagtcttcatagtcctcaagtcttcagttgatttctggtatggctctagtagcttccctctcttcttttgtaagacttattgaattaatagaatattcttctttatacaagttcggtattttattccattcatattacttgagtaccgactttactttatactcgaatcaatatagtcatgtaactagctttccagataggtgtattggtgtgggtttagtgtccgagtatccggttgctctatgtcggttgcaaggatgtagagtagtatttagtaatgtaagcgcggtgcttagattattagataccattaattggggtaatatacagtggttcagaggctggccgctaatggtgacgactcagtacgggtgccctctgcatgagtatattatcctaagtgcaatttcctggggagggtactcctccgtatttagccccggttgtatggccatgacaggttgtcgtatggaactcggcaactaggggtggtctctcgagaggacactgggtacggggtattggttgcatgagtgtataatagcaagtatagactaaagatgtatgtatactagaagtacaggaatgatacttttcttgttctttctctacttagcttagactgtattttagtgagagtagttcttagttctttcttctgtgtgtcaccctaccctttgaagtgaattaacccatgcatagactttgatgtatataagtaatatatgaattgttagcatagttctctcttatcatgtcttcccttgggataaaataaatacgataccttggagtactcccgggtgaaatgctacaatggtatatccgtgtgcttgtgaatcatatctgtcaccataatataccaggattatttctagtgctattgctgggaattatattcccagtagtgtcgctaagaaataccaacagatacaaccacatcaactccacaagttgaaccaaatatacaaggatcaattactcgagcctgtgcaaattaactcaattatccaataaattcgttcttagaatgcataagcacagtttattgagtgagatactactaaaagcttgtgatgatgttattttacttagcaatcatgcagaaagatacacacaatccaaaaggttatgcaagacacatgattccagttcggcctcctgaaaagccagaagttaaaccaagcatactcattgattcctgttggcggtcattagcgatcagtttcgaccgtcaatattaccggaataaaggagaactagttatgcttgcaatgcatatttgtgttagaataataatattccactagtattaggtatactaaccttttgcagaggataaccataaagtggaggagaatcgacatcaaatcagacgatcaatcaatcggacgatgtcgagaatcagacttatgcatgaatgggccaagaactcagaattgacacgaacaattgggccaaaattcaaaagtctgcgaggagaagcaacaaaggagttcgccagccaaaacctgggctagttgggccggcccatggttcgaccgaaccagggggtttggctgaaccctcctcagtgccatccaacccagtgctttgcctggacggtgtggattagctcccaatgacagttggagagtatttccgaccattccaaccatcacaaccgtcattgggaggctataaaaggagttcccatcctcacttcctccacacacttcaagcaatgctctctcatattctctcaagcttagtttagtattcttaagctagtggagtaggaatagaattgaaatcggagtccggaagcctttggaggagttcgggtatagctctagtagctctcatttcctcttttgtaagctttgtactttatttagaatactcttctttatacatttctggtattgaaatactttccgagtatatgaatgccaacttatgttcatgttatactgattatactgctagcttatctaggagatgcataggtacgggtataatgtttgctattacaattactctatgtcatgacgatgatattagagtatagtatctggtagtttaggcgtggtgtctagattattgggtatcattatttggggttatatgctgcggatgagtggtggggcgctgatggtgacagctcagcacgggtattcctccgcgcgtgtatatggtcctaagttaatttcctgggaaggttactcctccgtatttagccccggttgtatggtaatgatgggctgtcgtaaggaactcggcaatcaggggcttctcgaagtactaggagggcatcggaaagagggtattagctagttaatcatataactagaatgtatgtataatatgtatactagaagtataggaatagattattttctactttctttccacttagcttagataatttggtatgaggatgagtagttctatgcttgtgtgtcactctaccctttggatgatattaacacctgtttagactatgattattacaagtaacatataaattattagtaaggttctttcttctatgatcttcccacgggattaaataaatatgatactcttggaatactcttgggtgaaatgctacaatggtatatccatgcgcttgcggatgaactctgtaaccataatatatcaagagtatttctgcgccattgctgggaattatatttctagtaatgtcattaagaaataccaacaattccgaagtccgttttatctctagaagtacttgatgtaaatatactgccctctttcaaactaatccggtatcacttcaaaattcaatctgactcatccgcaattgccaaaagagttgtggtttgttcatggaaaccaagacccatagtactgcatcactttcagttgggtcaatgggccttgtaggatgtagggcggtgtgccacatcctggttaccgtccctagtcctctttcatgtataaatacttacatatacctttagatttagttttgattttgtttagatcaaagtttagcgtcactactttaccgggtaaagtcgtagttatttaaatcgatcactattttctcgttatgaagccccacctttgcatatagattgaaggatttatattttatttgcaatttgagttgcttgtttgtcttgttgctagttatcgattgcttataggaacaaataccctcgtggttgggttaattgttctccatcaatatcacgaataacccgtgaagttgatgtataattgctaaggcgcaacgtcctttgactattgtagtcgggtcatcaatgtcgcatccttccaatcgaagttaaccctctcatcgagagattgagacacctgagagcatatcacatgggatgtagcctatatatactggtgctggcatggaggaagccctggtggagatctcgcataaaaattgtggcatgtccgcgattgattgccatagaagggaactgacaatgtgaagatgagagtttgccgaaccaaccagtagagaccatgtggtgggtagttgttgcctcctttgcctcctcaagctccaccaataaccctttgcctcccctctcttgctctcgcttttctcccctctctcgcactcctcatcgccgccgacaccactcgcggacaccgccctcccgcgggaggtgagggaggtgaggcggcgggctcccatggccggtggcagcgccccgccctccccgatgtgttcacgtgcgagatcaagttctccaccactgccatcctagcgacgctcaagggaaaggaggaggcgacccaagggccctatcgccgccgcatcatcctcaacgctgttgtggttcgagtgctgatagatgaccggatctatggttggtgtcttttttttgtctcgttcatgttctcttgttaaatttatctcatgtttctcttgttcatgtgtgtacggatttggatcgaatgaacattgttctggatgtaaagttctggatgaatgtgctttgatgaatgtgttgaacattgttctagatgtgacgatgtggaggggatcatggggtgtggacaggttctggattaggctcgattcaagctggagtttctttgttttttttttggcttgtgcagacacaaagatgccggttctattttacctataggtgccggtggcatgtattggtgccgagcaattggtgaattcacttgcaaattaaacaaactttacaattaatggtcactagtacagatccttctatctgtgacggcctctaacatgcctagaaatagcgggccgtcacaaggaagtgatctcaatcgggccgaaaaagtgcccgattgagatatggtcgcacagacatattagaagagcataaaacttaagcctgtcatggatgacacctatcagtgatgggccgtagtttaggctcgattgagataacattccatatctcaaacgggcctgaagttggggcccgtcacagatgaccatcatccgtgacgggcaccaactttgtgcccgattgagataacattctatatctcaaacgggccttaagttagggcccgtcacagatgaccatcatccgtgacgtgcaccaacttgaggcccgttacaaatgactcatcagtgacgggctatatactaatccccggttgacatgacttaatatctatcgggcattaactaaagcccgtcaccgagtattttttccattttttctatgaaatgtttatatttgtaagttgaactatagcaaaataattaacttgcagtataataattcaatttatgagtcaaataattttacgcgtagtaaatgatatcaaatggaaaagtcatcaacaacaaagttgtataactcatcaagatcaataacttttattttggtcatttttctatataataattttggaacagtttgaatttgaatttgaaaatatgataacttcaaacaacattttcaaatactaaatgatttcaactaaaaaagttatcaacaacaaagttgaataactcattaagatctataacttttattttggtcatttttctatataacgttttttaaaccgtttgaatttgaattttaaaatatgaaaacttcaaataatattttcaaatattaaatgatttcaactgaaaaagttatcaacaacaaagttgaataactcatcaagatctaaaa

SEQ ID NO: 7817 - DNA, 14118 bp, Oryza sativa
gaacaatgttactatcactttagcagataaagaaatgaccaaaataaaagttttagatcttgatgagttattcaattttgttgataactttttcagttgaaattatttagtatttgaaaatgttgtttgaagttgtcatatttttaaattcaaatttaaacggttcaaaaaatattatatagaaaaatgaccaaaataaaagttatagatcttgatgagttatacaattttgttattgatgacttttttagttgaagtcgttcactaacaaaaaattctatttgaatttcttaaactttgaatttcaaatttcaaattgtttaaatatagttagatggagaaatgaccaaaataaaaattttgcacctcgatgagctctacaactttggttttggtgacttttccatttaaaatcatttattaaccctaatttttgttccaagttgtcaaattttgaaaattcaaaatttgaattgttcaaatgaaattatttgtacaaaggaccgatacaatagttgtagatctcgatgagttatataattttgttgtttataatttttgatggttgtgtatgtgaatgaatgtatatgaatgagggatgttggggtgtgacatcctggcctagggcttaataggactaatagaatactcactataactactcttccgaaagctgatctccaaagaactttgatgttaagcgtgcttggcctgaagcaatttcgggaagggtgacccatcgggaagctcttcccaggtgcacatgagtaaggacaaaaaagactggctctgagagacgcgggacggcatgcctaaaaataaatttttttttggcattatactcatctatgacgggcattaacttaggcccgattgagatgactcatctgtgacgggcattaacttagactcgattgagatgacttatctgtgacgggctatagttaatacccgtcacagataagggtcatctatgacggactatagtttgactggtcgtctgggtcaaagctatcgatgacgggctttaattatggcccgattgagataggttcatctgtgacggccgtttgtccgattgagataacttttcatatcagtaacttctagcctgtgacggacgccatgcccgattgagatgagggttgccgcccgattgatatgatggtatctgttctagtgggtggactttcgagcatgtgctgttggcagttgggggcgaccatattggatgaagatggtttactgggaaggcatgcaagagttacgttggaacatgtcagctaattcatccgtcagtacgagtacgtgtgcatccatccatccacacactgatcctattgcctgtctgaggaaaacaatactactactggtggctggtcacagtagcagatatatttgatgctagtaccatttgtaagttcgctgattaatttgttcacaacagtgtcgtcagagatagttcctaccacgagataagaacgtgaatgtggatgcgactggtgattgaaatagatggctgcatttgttgtaccgaaaagccatctgcaatatcgtgatatcaacgttaattatgcttgcttgtttgactaaccaacagttagagttttcaaatttcttgtgcgatagagattgccgatatatgtgttgacggcatctttgcccgcttcccgtgggacccaatcggatcctaacgagaaataaactgcatcgtccattctaaaatggataacatactaaatgcttatagtcaaatctccacatcttaattcattaatacatgtgtagaaatattaggatttggtatgtgaaaacgatgttgattagattttttatgaaaaaacatttcatgtgttttatttttaatattttttatcaatatatagctagaaacataaatgatgaaacattaataactggaaaaagtccattttactccctagaacaaattaaatgaatctgttaaccccctaaactattttcgccttattttatcccctaagctagtgaatctgttctctttttaagttccattttaagctgaaattatttgttaagagatatagatggtactgttataagagtataaaaatatttccaattttttcatggttgtttgcttgaaccttaaagtactaaagttttgatatttaaatcagtatttaattcagtattaagtgcttccagcctacgtaaatagtgagaaataatttcagaaaaaaaaaagttaagacgatgtaagttgtaatgcatttatcatcctctaccaagttttcagcgcaaaatatgacttatctggagaaaaaaagaaatagtgttagggaagttaagtgaataatgttcagggtgtaaaatgagaaaaaatagtttaggggtaagtgttttgttgaaatagtttggggagtaattaaaatggggtctttcccttagttatatacacataaattttgtcactgtctaaaatgtcaagtgaaaaagaacgaatgtagcatcatccttgtcatgatctccaatcatccacgtagatcactgctcaccaaacgtccaaacctatcattgtgttattatgcgcttgaatgtacttgcatgtttccaagcaagttggatacgtgggcaactttgccaacttatctgtgttttgaaaataatttaatttacaaacaaaatgttttgaaaggtcaaaaaatgcaactagattcctaaaaaacaaataatattcaaatgaaacttaatacatagaacactaattcctaacaggaaaacgttaaaatcaaattgaagttgtgacatgaacaaatgaaaaagaaattgtaaataaacacaaaatcaatttagtcaaagcttgtaacgtaccatttggaatggaacttgcagtaagacagcaaattcaaaattggcagggccgaaataatcgattcttaattagattttgaattaactagctagcttggggaaatactagattcaactatgagagctactaatgttattaaagagaagatgaaatatatattattttacaaataaatagcgatagatgagaagtgcaggaaaatataaagtaaataaataagcacgtgaacatataaaaagatgagagaaaccccagaacccttttgtggctgattttacccctaaacgattggaaaaggttcgctttacaccttaatatcatttctcttattttactctttatacaagttgtattttaagttcaaattagttatagccataaacggtactgttatcaaagttgaaaaatggtactattaccagtaaagttttgtatttaaatcagtcttaagtgcttttaacctacgtaaacagtgagaaaaaaaatcaaaaataaaatgttgacacataagtatagagaaggaaaaatagtgtaagaggagtgaagagtgaaccattttcaatagttcgggagtgaaatgagaaaaagaatggtttagagggttaagtggtccagtgaaatagaagtaaggaaatggaatggacttttttttccaaaatataaagcaacttaacaagtaaatttatgtcatagaaaaattgtactgttctttttatattgcgcaaattttgggcatatcttttgtaaacctcgctgatttaaaaaaaaaaatcattataagtcgattgagaaatactttctccgtctcaaaatatataagtattttttagatggttacaagtagcaagaaagtaggtgaaaataattggagaaatattatgattggttgagaagataaagttggtgaagaaattgaatagagaacggttgtgattggtgagacttgagaggatgataagtacagaaatagttttattttgggacaaggcactgtaatagaaataactatattttataattgtgatggtagcaaagttaattttggatcaaatcaattttctctatgccactttatatttatgaacaagtggatcatgagcattgactttccaagatgtgaacaagactgcaataaataacaaacgaattgaaggatcgatcggcccggccgggtcgaaggtagttgccgtataagaatgccctatggcggcatggctcatccatccatcgactagtcattgtacgtagccacaccggtccaacctaagcgagagctaatggaagctctaactagctcgccaaattagctagtcaccatcactatatcttcctctatgtgtaatatgtacttgcaataactaataagaagatttgcctcctaatcagacaactaattagcttgatctgacagcgtgcattctgacgagtcgtacgtgcatcctgacacggcgtcgatcgttcgaatatataaacacagctgcgctctacgccaacaactaactgtccgtgtgcgagttgcgaccttgctggaaaacttgtacctagagctagctgaaggaagcaatatggccaccgtggatggcacaacggcgccgagctccggcggcaagacggcgacggtggcgttggagtcgggcggcggccgctacggtgggccggctccggcgaaatgctccggcgccaacctggccctgagggcgctgctcttcgccgtgtcgctgtccgcgctcgtggtgcttgtcaccgccaagcagacggtgatggtcccgttcgtcatccggccgccgcagttcatcctcgcgccggtccccgccaagtacacgcactcaccggcgctcatgtgagtacactaaaaaataattaatatgttattgattttgtttttttgctttgttgtactggatatatgtactattgtgtactactcctatatatgttgttgacttttgggatggtttttggctgtagatatctgctggctgcgctgtgcgcgacgtgcttttacagcctgatcacggccatcagctcggtgaggttgctctccagctcggcttgctctgccaagacgctcttctacctcatcctgcttgatgtggtgagctctctatgcatgcgtaaactgtttcaacacggcatatgcatgcatggttaccgaactactactgctcttgcgatcgttaattatcctgtcaaatagtagtactaactaaatagtatatgtatgaccgtcgatttttcgacgtacagacgtagcatccccctagctgatgtaactcgggcatattagtcagagcatagagttatactatcaaaatttaatcaaagtattttaagagggaacgactaattcaatcaatcacagtatatatactctatatcgacggatgattggaaaggtagcctgcagatatttcgttatagaagtagtaacgttaattgaagtatatactggtcagtttcaccgccttgacttggctagtatgaaaactaaagcaaaggaaaaatattcaacaaattaatatcaaatcacacacactacgtacgtacgacaagtcatggtgtgtgaaattcaacgaacatatcaggggatcggacacactaatagatggtcctccctctgtgtcaaaatgtttgacaccgtagactttttaaaacatgtttgataattcgtctcattcaaaaaatttaagtaattattaattcttttcctatcatttgattcattgttaaatatattttaatgtatacatatagttttacatatttcataaaagtttttgaataagatgaacagtcaaacatgtttaaaaaagtcaacggcgttaaacatttagggaaggagggagtatataacgcgacgtatttaaatttaaaagggatggaatttttatatttctgaccaatttatttttgctcttgtgtgcaaattcgtggcagttctacgcagccgtgatggcgtcggcgaccgggacagcgggggccgtggcgtgggtgggactgaaggggaactcccacacccggtggaacaagatatgcaacgtctacggcaagttctgccgccacatcggcagctccaccttcctcgccctcatcgccgccatcgttctcgtcctcctcgccttcctcaacgcctactccctctaccgccgaagccgttgattcattccccatgaacttgtttgctgccgccgcccccggaccgtagagttgcttgcttccgtcgtcgcatcgaccgtccgtgtgtggatggattcttgtgtttaattagtttttgtccctaagtgtttgaaacatttgggtggtgtgatgtttttttagtgcttgccggccgtatatgttagctgttgtctcacatctccggaaattcaacgttatcctctcagtgatatataatgtttcatggttgaactaatgaactagaacatgtacgttaacgttgtcgcattccgttgcatcaaattttactatcattcgttgtgtggatcgagtcttgtgtagcagaaacaaagtattccagttaggtgatctatatgttgttatcgaccgagaaatataatgttttgcaggtagctttgcgcctgtgtttacgtgtagcggctggccctgaaagcttacctatatacttcctccgtctaaaaatataagcatttttagctataaatttggaacaaagggagtactacatatatttgggtcatatatattaatttaatggtaaaatttatcgcatgacactaaaattttatgtaatttaatgggagacaccgcaaaatcacgtcactgtgttgatggacatggaaaaattcatgcaattttctgtagtacatgtaacatacccaaaaatttaaatttcaaattttgcatctaaaattattcaaaatgatgttcttaaataaaaatctaaaaattttccatctaagacctagatatgtctaatatagctagtgcgcttatgaaaaatttggaaacaatttaaaactttttccttgctaatttaaaatgaaaataaagcatagggagtgcttgcattttgcatgattgttttggtgtgacttgagtcctttgtgtctttctggatttcaaatgcactttataatataaataggtgtcatgagcattaagtagaaacttaaatgaactaatgtcgcattttcgaagatttatacaacttaactaattaatacaacatggcatttgttatattccataatctgaggtcatgtataagctaattataaatttaatgagtatttagttgcatctccatattaggaacacatggataacatcaaacctacacagattgtaaaacaaattggtgcaagataaaataatggaataagggaaccccagccagtctagagacgaaaagacgtggataagctgctagcgctgaatctttaggaccggtggttctctagacacgcgtcgcacatgcccagcgacacccgattcagccaaacaggcaaaattgtaaccatggcaccatttcgagcaggctgggactcgccaggcccaccactcaccacgtggtgagcatgctggcgcacccacctggcccaaatgtgagcccgaggagcctggggtattgtaatcatatttgttaggtaggtttctcggggaatttttggaggggactagccggtgttgacaagaaggccgaatgacaaggcaaaaagactagtagcactgtgagctccttcttatactataacagaaaagggacatgctacatagaaagggttgcttgtttctaacttggaaaagacaaagtttgtatttcaccagatccataccaacaaagaaacaggagtatggtattacacctccggtggcctgaacctttataaatctcttgtgttcatctgcttggcagggagcttgggccccgcagattgtcttcttgattgtcgtgtgcaactaacccctggtcagatcttcatttttagggaggggtcttctgcacttccctgttgtcggagaatcgcctctccaacaatgtgcaatgggaatttttttgtcacaggcatatataagttgcgtactgttaattccaatgtcccctttccttccttcattgtaaatacagctgaagcatgttgttttcagtaaattattaaagctaacaaatttagtagtcttaattgacacgcctagcttggctagctcttgtatgttatatatagccgcgctgcctaccagaggacctccgttgcttttccatttcaccatacatacacataagtttgtacagaagttccgttgttattgtttctttgaatgggagagggatctggaacggcgagagtggatcaaacaaacatttgagcctgaaacatagtgatgtcgcacctgtttaatttccatgaactcctaaactaatggcacaaagtaagggggacaaacatgtggaacatgcgtacatcagcacaatatgcttttccattattagtcccttagattccgttccatctgaaaaataagggaaaacctcgtgtttcgtcggaattgagtgattttgtttgctccattgagcaatattattttgtcccatgagcccaaacaatatccaaaattgaatcggagtatttctactctcgtttggtctgccaccagtagatcgagcgaccaccatttatggtgaattaacaagactaataatatgcccgtgctaaacgctacggtacaattctatttgtctttaataatttttaaaatttcatgttagcaaaaaaaattttatatgatttgtacatttgagctttaataacctccggcaaggccaggtctgttttgtgctttgtccgtgaacattatagctattcacttgacattttccccgtatcgttttactgctgattaatcacgttataataaaccatcttttcttgattcacatagagccataactgagcattgcaatgctataatcatttatgtaggtgaaaatgctaagtacattaaagcgatatgatggataagtcatgacattgcgtgtagagtcaaatatagatctgaaagacacaatcgtatgcaactgtaaaaaaaattggttcaaacgcaattatgaatatctcaagatatatggccctgcaatgttatgcggttcgtgtcaatgcccagagaatatatagggaacaataatcaccaatcgatcaacaatgcatagtgttatggattgaacaacccatgtcacgtgtacagttgcatgagctatcttctatatatttccggcgctacatataacttcgatgttcatttgtgttattcacatgggatgtctattttccaggcttacatctcagccagttctcaaagttgtgtagaatgaatgatgtctcacccaatttctccattatcaacttgttttcttcaaaagtagcaaagctttctatctacttcaagaagcactcccccagttaattacacttattctgcacatgtgtaaaataattagcaatccataagaagcatgcacacaagcattatagatagaagaataaaaaactattaaaaaggattcggtggctgaaaaaaaaatgaaaaacatactgatttaatcatttaagctcacagccaaagttcagacaagataaaaaaatggagctatctcagaatcattctaaagcttgctgtctcctattcacatgctttaaaatagatttgagtttaataattgcgcgtagtcttttatgagagtcgatggttttccatatccaacttgttatgagaaatgtgagaaaataaagttctgttgagctgtattttatagtcaacagtactgcagaaccaaatgttcgaagcaaatgcacagaaactttggtgtttttcccttacaaagcaagttactgaaaatttataaacacattttcaaatatgtgacgatacgctttgactttttagatggcttgctagcagacaagagcgaaaatacagcttcgtccgagctatttgatgaacgcacaagcacctcttctttatgaaactcaacagatccaactgatcctgtgtgccctaattaggatatttctctcaattaatttaaggctgttaccagaatttttatttcaaatgcttccttgaactacaacagttcggatatctctcaaatgcagctgatgtagatagccctaattgaagaaacagtatatttctttcgaagttgcaactcaattttttcttgcttttttacgtaccttcgtacatctaattttaggtttctactataccatagatacttgtaatccaaacatcctttttaagacgtacatgcaattggagaccactgaagtgaccagccactgccaggttgtggtctctgcttcttctaataagtaaccgggtttcttcagaaccgacggatcaaattctacactcattccaaaatactggcatggttatattatgcataaaaattcagaataaactgaaaggttgatttcaaatactacagagtgaggatggttattataaaaatttcagaacatgaaccagttgctaatccacggctgaaatccaaccagcagagtgagggttcaccctggagcaaagcagctgtgcatcattagttaccatggttaggccctgcaagtcaaatacgaaaatgaatcaatcaattaagctgaaagtagcgtaaaagattctaccttgtatctgaactctgaaggaagcagtatgattaaagaggatcacaccatccattatgcacttcatgaacagcatagatatccttattcattcaaaccccctgatctgataaatgaatcgatggagtcaacatggatagcagttttcatttcattttttaaacaacgagtcccccttcagcctgaaacaatgaacagtcacaaatgtatcaactttgatttaagaaaaaaatcatagaagtaatttagtttgttatgatagaccatcctctataaaattgcaactatcagtctcacaaatagagaactgattaatgattaggtcatgccatagactattcaattttagttctgggaagttcagttttctaaacatagctcaatcagctatataatcacacaatactccaagcaaaagagcacatgcaaaaatagtcctttatcgtctcttgttgactgaaaaagctttattgtctttcccattttttgaatggagtggcctgactatttcttatgacaccataatgaccagaacccgaagaaaacattgccaggttaaaactgaaccatgtattccgtaggctagtagcaacccatacagcagctgaatttttcagaaatgagagtgtttcatttcaccatagtttcagaattatattttcagaaatgtttagacaaaataataatctgtcccctgtctccatgagcaatcaaatttcgaagctggcaccataagttagcatcgctccagattctatttgaactgacatacaacttaaacgagaatagtgtaccaaatatacaggaacaactgaaaacatatatagggtgaataatgtgaggatatctaaaaaatgtggaattttcaggagtggagcttatgacctcttctgcattaagtggatgttttaacagcttgcttctcaacgctaaactgatctaccaagctgaactgcagagaacaggcaaaccatcataagatgaaagaaccggattcggcggtgactcttggaggagccatgggcgatggtcaatggcgagcggcaggaagcccaacgggagatcgaggcatggggaatcgacgatgcaggatgacgatttgcgctatgaggggccggcgacgagcggagacaggacaatcggcaacaatacctgaggatgagggtgagaagggaggggatcgacgacggggaggctcgtgcgacggcgagtgggcgggtgacgggatggatgtgggcgtgaggagggtgtgcgaatgaaaagggggaggagattggggcggtttccggcgtcagcggcggagacggcggagggaggcgtgggagggaggtgcggtttctggaagggttgtgggaggaggaggtgcatggggagggggcgtgggaggggcgcgatcgggagggaggcgtcgatgccgtccgatacgactcatcagattaatttggataattggatatgtgacatgatgaatgatgaatgagtaaaactatttgtttaactatagcctagactagtactaagatcaccttatactatcttttatgccggcgtttttctttagaccaccattcagctaatgttttcactttagaccgagtaatcttgcaattatttcactttgaagcactccgacttgcttcttaaccatatgaacgaccatcaactacaccagctcctattcgtaataaactccatcagctatatatgttgaccgttactttgacatatgacaaattggatataaatggataaaagagttgagagtgatccaaagtaccataaaggtaaaattacccggtcgaaagtgaaaaaattagttgaagggtggtccaatatgaaacacgagtaataaaagatgacccaaagtatactcaaatctgtattatagatatgtgaatggaaactctgaaataaaactgttccatataaggttcgaggagcgagcaatccttcctagcaacatcatttaggaatgcaaactatatcaactggtgatggtggtaattcactctgagggtattctggctgtagattggcaagtaggctgaaacagactatgacagttgtcttggcaaaatataatggtagtcctaattgtcttcgagtccaataatgaacaaaagatatataaaccaaaatgccatacacaattggaattcatacacaactaccagctattgctgctctcaaatgtcaccattctagctatttgctatcacaatctccacagctctccccatacacaagtggctcgcctgcaacctaatggccccctttacaaaaaatgatttgtgtagtaatgaatattaagttagtaactcacagaatcacagtgacgaggagtacattacaagcgacgggcttaatttgcgataaatttgtagtccaagtctgaaacagtaataagtattggtgagcacctacagcctcaagcctagcagagcagagctagccatccatgtatacgcatgttggcatctgttcagaaaactgcttcacctttcaagatcgttatcttaccataacaatttctgctccactcccctgattcaatctccagaaattgaggtgacaagatagaaaaaaaaaggaaacaaaccttacaatgtatctagaagttaaaagtagacagaaatttattctataaattaaatatgtaagaatggtacaggtattgggaatggaacgacggtcgcaagcatatgctgcctgggctgtccagttaacatgaagaagacacatcttaatcgttttctcctgtcacctctggcatcatatatattgctattttaattttgttcttaaaccatattctatgtccaagctaaaaataaacatgttattccagtactgtgatgacagaaagaatggctcaaattacatatatttctcaataatctgagtagtaccaaatttagtattcactgtggtttaaggactatttatgatcataatttccatgtttatctagaagcatttatttcttttgattggctaatatattagtatagtattatgtttatcaactttatatttactcaggtctaaactttctaaaagacgagaatgggctatgtcaatttgtacttcactaaccgtaagtctgtaaaactacgagctggagtatatatgttttatataccatctacactgccatttccatttttctttgttatacctcagatatatgttagcaaccttcttcaccaaattaaatagcaacaatctctaattcaactcaatcacatgtatttgttggaaagtggtaagaaataagctatacatgattctagaaggttctagaacattatagaagagatagtatgaggagttgagagggatagagacattcacaaggttcaattcatgcgtaaccagatcaccactcccgagcctctaatgcctttcttctattcgatgcccataaattcagctgcacaagcttttgttccctatcacttgggcttgcttgggccttttgtgcaagagcacctaacccagcccatgatgcgcccattcgtggcatgaattttttttatttataatttttattattaaaagttttacaaaaataattttccattttgaaaattgacggaaatagtcgcctaccgccct

SEQ ID NO: 7818 - DNA, 6838 bp, Oryza sativa
tgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaataccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgctcaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcatatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaatatagagcacagtacaaaatcgc

SEQ ID NO: 7819 - DNA, 8996 bp, Oryza sativa
ccctcccagagggcggtaggcgactatttccgtcaattttcaaaatggaaaattatttttgtaaaacttttaataaaaaaaattataaataaaaaaaattcttcgtggcataacccatccgtgacgtgtagcagcgccccaggacaagatggatataggcctgtttagttcccaaataaaagcttttcgatcaccctgtcacatcgaatgtttgaatatatacatagagtattaaatatagaaaaaaaactaattatacagcgtgtaaattgcgagccgaatcttataagcctaatagtgtcatgatttgataatgtggtgttacagtaaacatttgctaatggcggattaattaggtttaatactttcgtcttgcagtttacaggcgtaatctgtaaattgttttgttattaaagtacgttcagtacttcaaatatgtgtttgtatatccgatgtgacacgcaaaaacttttcacccaagccatagcatgagatatgacctaagcagcgtacatgccaagcccgatgtagataggcaaaagtagtaatccctccatcccaaaaaagacattcgatatattctaacgtaacaaatctggacataaaatatgtatatattcgttgtattatgatgtataggttttttttgtttgaatgggggagtactattttaggtggcactcatacacaactgcttctttaagatgcaatcgatccaagtatttactacggtcacaactactactgccaaactaaaagaaaacaacttaataaaaaggttatgatttggatggctgtgtgtaaatattgtggttggatttttatccactatatgaaaaaatgatttggagatgccatgactagcatgtgtagctaggtatatatgttgaatgaagcatgttcacaagagcatgcagtgagtcagtgacatggagtccagtattggagggcttgtcaataaatgtttcatctatggtgaccacctacaattctaggccatgtttagttccaaactttttcttcagacttctaacttttccatcacatcaaaacttttctacacacataaactttcaacttttccatcacatcgttccaatttcaaccaaactttcaatttttgcgtgaactaaacacacacccctagtgaactacaaatccaacgcagcttgccgtcatcgcagacatggcatccataaaagtcagcttcggctttcaaatgtcacagatcaagacatcttgagctaccatcacaattgttgtacttcttccctcaccaaatccgaagatccatcatctcccataaatcgagactgtacaaaactgagaagaagcaaacaaagcttatgatatatctagaggattatggggaggggaaaaaaatatggtttctgtatctcaaaagtataggaacggtgggcattgggaatggcgttatcgtaggcaaactgtagtgtcactgatgtgaagaacagtctagagcttttcctgatcgatggcatgaagcatttagctatggcgatgtatgctgaggttaccaactatctcggcacgcactcctcaaccacgctgcccgaagggagatgccacgacatggcctgttcacaaggtagatgcggctcgttgtacttaacggccgctgcttcaggcacgtcgagactggtgctgtggaattgtagacttgctctgcactgtctacacctgaatcgcgctgacgctgcagcgatccccgtgcacgtgatcttcggggagctcgctgcgtccgaggcagccaccacaatggtttcatgctgccgtgttgggctccgatcttccgaggccctcgtgggaagtgaattgatggggagcacgtacatggagcaagcaagcctccatgtcctgtgtaccaccttcatcatcctttccttcagcagggtttgcaatctccaaattagggttttttttggcgggccgggggaggggcgaaagaatcgaaattttggaagtttcggaaaatttctgagccgaaattatttagaagttttacgtatttttaatgaatttgaattaacttcgaacaaattgaaaaaatgaaaaaaaacccgtaaatttcagacgagatttgtgtttacctgtgagtgaggaaatttctgaaattgtaataactgccttccggtcaaagcagcatttacctttttcagcttttcacttcactcagagcccgaagcaacaggttggtagtagtactcaacaatcactgtctagtgttagtttttttttttaaaggaacaacggcagaagattccgttctgccggaatttaattaaggggaaaaggaaaaagtttacaatcccaggaatgggatttcaagtccaaaaacaaaataaaacaatcaagggtgcctaaaggccgatcttctaaggtctagatcttccatgacaagatgagctacctgataaactgtacaggaacgattattgaaaattctcctatttctttctaaccaaatatttcaccaagtagttaacagtgctcctctaacgtcctgcttttgatttgtcgatccatcttgatttacttgatcccaccaagtagagatatttgccggctataggatagggactagtagatttcgccaggaatgaacgagagtccaaacttctctgacatacacacagtcacagaaaagatgatttgtatcctcgaatgtagacgtgcaaagacagcatatccagttgcacggccagtgacgccttagcaggttttgggctgttagggttttgtgatgaaggatcaaccacccaaaagatcacatttttagctcagctggtgacttccatagggcatcaaaatccaatcgtgcaaaagttcctgcaaattgataggagtaggcttctttactagagtaaaccctggaaggattccagttccagttaatttcatccggttgttgggagagttagatatcttggatcattccccccaagttgcactaggtcatgcagctcttccactgttgtgaattgtcagaaagaaacaatccaattgtttgacgaaatttcaaactggacacatcgttgctttcgtttggctaaacgaaaacagagaggagcaacatcctttggacataaaccgttaaactgtctagtgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgctaagtccaaagcactagcaggatcagaagttaagcagagaaaaggcaaaggcacatgaagcaaactggcttatatatgtatgcgtcgttgggctctgcacatacatattatgcatatataaacctgagtatatttatagcagacgcatacatatgcaaagaacatgaagcaaagcactagcaggatcagaagttaacacacaacagaggaatcagttcagactaggtattttgccacatgggtacggacccttgaaatgcctgcagtagaaatgataggaccaattatagaaaaggcatgtgacattatgacattacagaaaaatggtcaccgtgtatttttgaccattttgttgtatgaaaatggtagatgggcacatgggggaaaaaatatttgagaagtaatttacacagcatcatatgcaaaggcgttaaatgcaatgcttgtcgtagcttcaagcccacaagaactaatagcatcatacatgcatgtatgtacggaatgtaactcatctatattccaaaatctaatatgaaattcattttttccagttaacaatgtcgatttcaatgtacccagataaaattataggatgtatagtttctaccaagagagaagggactaaagtcggcaggtttttacaatatgctatgtaactgtaagcaccataagcatatgcgataactgctaacccagttgaacggataaaagaagaaattcaaaatgctgctgtccctgtagaaattcaaacaaagtatacttttttatttctcaaacatatgtcagcacactacccacactaaaacagggaatttttttttactgaacttggtgtcatctcagccatttcatgtcatctcaagcagaaaacaaggacaggaactaacctttggtgatgctaggccatttcacttctcagccaaattaaagcagactctaagtcatcttcgtaggcgccggggagagaaaggaagaagacgatgcattaccggcgagaaggcagcagagagcgcggacgtcagatgggaagaggtcgccatcgccgtcgacgctggtgcgccactgcgtcgcctcctcgcgtcgccagccgcgcgcgctgtctcctcgcttcaccagccgcacgccgccgcctcgcatccggattggagctggagggtctgatgtgaggaattgatccgggccaggaacaggggaagggagggaggccaaaccggccccgtttccaatctgggccggccaaaacgaacgacgcttccgagccagaccagatttggaaatagaggccgtttcgggccttaccgaacgaggcctaaggcgttgtcagggatggccggaatggagcaggcggcgctcgcggagcttgcacatgcaccactccaaaagtgtatttgctatgaattaatatacgactcgaggggctagcggaaggagccgccagcgagaggatttctcgagaggtaagcaaattttattttttaaaattttatcgaatgcaagcaatctgccagcaatccagagaagaaaaaaactaaatggtaaacctacccctaatcattgagtttgtcaagtaataagaggaaacatattcttggcacacatgcttcccatgcacactccatgcacaccaactagcaaatgtcacgaaaaattatagaaaaaattgaacacatatttttaatagtattacacatacctatgaaatctcatgttcaaattcattatattttagccgtaacaaaaaagacaaaattttgacagatttttactcttaaaactgtcaggtttttctcctttttattacggctaaaatacaatgaatttgaatataagactctacagatatgtataacactattaatagtacatgtcatatttttttctagaattttccgtgatattttttagttggtgtacatggagtatgcacagaaagcacatgtgtataggatatgttaaaaaatgtccttattaaggaacggtccaaaattatttctgtgagtagtataatataactagtagagagtacagtagcgtttctcatataaaaatgctagatacatcactgccatgcgcagctcaatgtttaccccgaaaaacaaaacgaattatacaaggattctgacctgcaagcagtatactcgggcatcactatcggtctcatcttttctcttatacttataattatcaatcaaaatttaaattttcacctttacatttggagttgattttgagagctttttcattgaagtttaattttcaatatttgcttttagatcactgagaacttatatataaaaattttatttacaaattatttttcgtttgtaaatatgccgttgggccaatacttcttctgtcctaatatgttgctatctaggataggatttgatctatcctaggacaacgaatctggacataagtcctaggatggggtagcaacattttggatcagacaaagtagcatatagctggaggtccagcatcaaaagcagcagtataccaagcaatctagcattccgcctactgcaccagtcggccggcaaccactaggccgcaaagctcgatcgctcctcaccgtcgtcaccgacgtggcgtcttccaggtctctcagcaaatgtgttgctgagctggtggccacaccacctctcagtctcagctgatatactcttgagctgcctcttggtgatgcagtaggccgcagtagccacagctgaagaatgcccttttttttcacgaagatgctgaatatatatcccggtttctgcatccaagcgccgcctttgccagtcaccgtcaagacgcaacttttcatttggtcgacaggtacgtcggcggcgagagaaagaaaaagaaaaaaaaccaaagaagaagcctgcaggatcgaatctggtgccggcctgtggccttggaacaatgttccccggtccaatccacgctgccggccgctagctcgctcaggcgatcaaatgacacgccacacggattctccaccaatcgatctactttcagtatcaatctgctagcacactggctgactggataagatgtactcgttctatttttaaatataacaacttttaaaatttatttatcatgtcaagtaatatttttatatatttaatctgtatttcttctcaaaaaatatcaccattccacaattttttacctattttttcctaatcaatcgtaacctttatccattgaattttacttgttttcttaacaatctcttatgttatttcttatccgtgaagatatagatggatagatagatagtacttgttgtcgaaacatgaattcggcaataataaaaggggttagcgcacgagacctaaaagtgaatggatgcgaagacaaggatttagacaggttcaggccctctcaatgagaggtaatactctactcctgtttggggatttgaatccgccgggtgtagtatagatctgacgatcatatgtgctcatgcccctcagagggcctcctgcccaccttatataggatggggggcaggattacaagatagaaaccttaaccaatacggtatcggtttcctaaatctattttataatattatcaaatcaggactttaggccgctccataatataaaaggaaacgtaatacctaagtcatgatcggttacatattccatagatataagttatcccctatgactagtcggataaccatgccatgtgggtatggggtacccataatctccacagtagcccctgagaccttcacagtcagaaaaataatcttctctcgaactagattactccaaagccgagtgcttcaatcatcttcgccatgatttcccgagtacttttaccaaatatgaagactgtggagggctgaaaaataaagtcaggtgcatcgaatagatgtacctaatagatgcaccaactgaatggttttgataattgtagtcaaccaagtgacttaatattaatatatagcatatgcagtgtgaatccctgaataacatgatcgagtgatataccgactgctttgtaaaatatgatgcgtgcaacctaaagctgactacatcattgaatacacatagcaaaacagctataaagaagcttgtatgttgtgaataaataaatttccaaagtattgggcatacaccatgcgcacactgctttaacagatgtgcttgagcccctaaaagacacatggtttcaccacacctggaaatatatagcatatgtggtataaaatccgagtaaatgaactcataaggatttatcaatcgtttggaaaatgaccaaaatatataatcagcctaagccataatattggtcaataaaaatgcacacttacgtggcaaaaagcaatgatattgtatccaatcaattgctttatgaacccaaacagcgccttgacttatataaaaagtcagcggggagctatataaagcattactgtttggcaccttttaaaatgtattgtaccaactcctaaaaagttgagtaactgcggtataaaaggattttaaggtattgggcacataatcacgcgcacttttgccaaagcaaaaagatgcctaagtccctaaaagaacgtgacaggccacacctgaaaatatgagctgcagacatattaggcctaggccaaaaaatatacctttgacaccctttaaaggattacgcatgtaacatgctctcgagtaataaatctttcaggtgatatagaccaagtgtagctcatatgaatagcttctgatctgagtgattatcctttatgggatactccaaaatagatataacaattgaattccgactggcgcaagtattaggctgataacccatacggggaataataaatagtctagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgacgcagttggcatagagacaagacgaccaatatagagataatattgcccaccagaggtggcaaaaatattgttagtagtgaagatagtgataccaatcaaaagtgatgaagttgtatagccgtggaggcgaagaaaccagtcggcaacagtcaggtcagccagcaatgaatatgaaggcgcccagcgataaagttgtgtagccatagcagcgaaataatcagttggtgacagacgatgcagctagtgaagaa

SEQ ID NO: 7820 - DNA, 2295 bp, Oryza sativa
  unsure (1)..(2295): unsure at all n locations
caccaatcatgaagatgaagaaaatagtcggcgacgacaaacgcaaccaacagtaatgatgataagcagcaatcatagatgatcaaatataatgacgaagttgcccatcaatagcagtagagtgggctatattgaagaggcttgacaggatgttgattaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacaataatgcatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgataaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagactggaacaccacttgttgtaataaaataacacggcatcatatttggtgacgtatgccaaggtgtcgaaactcttgtagtcgtcatggttggtgaagtagaggcaatagagtttgctgatgccgaagataataaaaatgaagttgctccaccaaggtgacaaaattgcatagccgtgatgaagtgaacacgggtcggcggcaacagaagcaaactagtagtgaagacgcgcagttgtgaagattaaagcaccagtcggcggcggcataaccagtcggcaacggaagacgatgatgtccatcagtagtggtagctgtataaaccagacgtagaggcaagggcactagtcagcagcagaagagatgactagcgatgaagacgataaggccaatcaacactggcagaatcatgcagccatgggagtgaagaaaccagtcggtagaagacgtagacagcttgcattgaaggtgatgatgcctatttgcggtggcggcgacgtggccagccgtgaagacgatagcaccagttggggtcatacgaggtggccggtcggagaagatgtagacgtcctgcaatggcggcataataggccagccgtgcaggcgaaaacaccagtcggttgcagacgaggcggccagtcggtgaagatgtagacgcccaacaacggcggcataattggccaaccgtgcaggcggaaacaccagtcggcggcggacgagacggccggtcggtgaaaatgtagatgcctaacaacggcggcataataggccaaccgtgcaggcggaaacaccagtctgcggcggacgagacggccggtgaagaggtagacgccctacaacggcggcataataggccagccgtgcaagcggaaacaccagtcggcggcggacgagacggccggtcggtgaagatatagacgcccaacaacggcggcataataggccaaccgtgcaggcggaaacaccagtcggcagcggacgagacggccggtgaagaggtagacgcccaacaacatcggcataataggccagccgtgcaggcgaaaacaccagtcggcggcggacgagacggccagtcggtgaagaggtagacgcccaacaacggcggcataataggccaaccgtgcaggcaaaaacaccagtcggcggcgaacgaggcggccagtcagtgaagaggtagacgcccaataacagcggcataataggccagccgtgcaggcggaaacagcagtcggcggcggacgaggcggccagtcggtgaagaggtagacgcccaacaacagcggtgttgtgaccaaccaaccgtataggcgtagacaccagtcggcggcgacgacggcgagccggtggtgatgttctgactgatccattcctggagcgtaagagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7821 - DNA, 478 bp, Oryza sativa
acctgttccacgaactctagtccccatgcgctctgaacgtaacgttatcagcagcaagaggagttctggcgttcccgaggtttttagagagaactggatgagaccccacgtcatctcaaccaggtttccataaaatcacacacacatcgcgcgataatcaagatatttacctacgcctcggtaaatatcacatttgcccttcgcggcatatatttgcctcctctttgactatgccgcagacagctttcgcacttcttggcttgctcaacacagactttcagcacggtgggccaatacacaccctatcaaaatactttggaggccactgttcttgcggcctggtgtgcgccgcacagcccctggtatatttccttcgccatttcttcaccttcggcaaaggagatgcagcgaagcaagggttgaagcaccccggagcgatatagctggcccgagactaacttatattttacggatctga

SEQ ID NO: 7822 - DNA, 728 bp, Oryza sativa
ctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttaacatgctagctttatctgttcgggcaatacgatgcccattgtacttgttgac

SEQ ID NO: 7823 - DNA, 1835 bp, Oryza sativa
  unsure (1)..(1835): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttgaacacacatctctcccatctctgattcatttggataaatataatccctggagcatatatagtactagtgtgtacacccttacagctagaaatttgttcatgcagatgtattcgacaagttcaaagatagcacgggttgtttcagagaaaacctgagcacggacgcaaggggcctgctaagcctctacaacgcagcgcacctcgccatgccccggcgaagaagcggcgctcgacgacgccatcgcgttctcgagacggagcgtcaagtccttgcaaggtaagctgggatcgccgatggccgagcaggtctcccgcgccctcgacatccctctcgcacgggcgcccaagctgctggagacgatgcgctacatcaccgagtacgagcgggaggaggcgcacgacggcgtggtgctggagctcgcgaggctggacttcgagcttatcagacctctttacctcaaggagctcaagaccctctccttgtaatcatttaagtttctcttatgcatattatttttttcttccacaatcatttcttgcttcactgtccttgtcgttctctgcttcacgcaactgtgttataagcaatagccctgcttttactcatcagcagattatgatagtggaatatatattactgtcagtaaaaactatcataaaattactctacttcacttcactgcacagttagcataaatacaattacgtggtctagtaaatatgtgcgtgcgtgaatatgattgacaggtggtggagacaactttatgacagcgtaaagctgagctacgctcgagatcgtctagtagagtcttacttctggtcctgtgccatattccacggggagaagtactctcgctcgcggatcatattcaccaaggtgttttaactgatgactctgatggatgacacttacgacatccacgccaccctggaggagtgttacaagcttaacgaagctatgcagaggtagaaatttgctagttaatgatggcctagtaggttgtcaatttgccaacgagcattactaatcaatgatctagctaatataaatatatcctcgatatatatatatatatctatacagatgggacaaaagtgcggtttctattctaccagaatatttgcgtatcttttacataaagttgctcaatgactttgatgagatggaggacagcttggagccggatgagaagtacagcatgtcttacgcgaaaactacggtaaaatcttgttctccaaaaaaaaaaaaaaaggcatactaaagtgatattcgtgccctcgtccacacattttgattaattttcctgcacatgcacacatgtacacagttcaagcagatgtcggaatactacctccgtgaggcccaatggtcaagcgacaagtacatgcccagcttcgtcgagcacctggatatctctctcatgtcgtccggcttcccggcgatggcaccggtgctgctgctcggcgtgcgcgacagcggcggtgcggcggcgacaaccaaggaggcgttcgagtgggcgaccagcgtccccgtccccgccctggtccgcgccggcggggagctcgcccgcttcctcacaacaccgcctcctacaggatcgggaagagcggcggggacatggcgagcacggtggagtgctacatggcggagcgcggcgtgggcgggggggaggccgtggc

SEQ ID NO: 7824 - DNA, 13235 bp, Oryza sativa
  unsure (1)..(13235): unsure at all n locations
gggtctcgtctccaacctctttcttgatccccttcccgtgtattaggcatgcacacagcaacgtgccgacgtgttcgtccaaatcgtgtgcgtaacttcgatcctacatatatattttattttagttagggtgtctgttctatgttagactctatagttgaatagaattaacatggttttttataaaacaccaactaaatcatatatgccggttttcttcagagcatactggcttcggttctatgtccaactacaaatgtgtgaagaggacatggtgactattcatgctacatgttggaatttataagcaaccgccgtttaaattttcgctaaatttggatggaattttaataataagattattctttgagtaaattgtttctctttcctatgatggtgacatttattattgtgtcgtctctttattctttgttacaaattgttatacttgtttttcagccaataactatgtaataagtggctatagcttctgttgaagtaaatgttagattttatccattatctaaaaacatatacactatacgcccacataataaatactagggtatgcatgcgtatgttacaaacagggccatcctaaattattgtggccctattcaaaatataaaataaggtcttatacgtattggcgatagccaatgtatgctaaagaaactcacctgtctatcagtggcggatctagaaaatcgattcgttagtgtcagaacgtgtctatcggtgtcatcgtgtgctaattatacttacatcattgtgtcataacatatggataagcagtttcgctatagtttttgctgaaaatcgtcggtgtcgcctaacaccggcccttctactgtagatctgtccctgccgtctatgacgacctagctaggcagaagaagaatcgctgcaccaagttcatttttttattaattaagtggacaaatgatattgttattatttagaacacacgttcactaccgtcatgaatatagttctacaaggtatctatgattatcaaacaattgtcagagaaaaaaaatctcgttctaggaaaattcaattgaagcacaaagaaaattttaaaaaagaagtaaaaagattctaaatatattagaacacattggtatatcaaaatatataattttaaggggccaatacagttgtacatctcacacacttgccctggttacaaataagattaatccaccaggagctctatacctcttgtgtgtagtgctttgtctttgtatttgccgatggattgagtcggttgtgataaaaaaaaataaagagaaaacgacccagggcattttgtcacgactccaaaaacaaaaacaaaaacaaaaacaaaaatcgtccttttcctagcatatgatggttcttgcttgttcagttcttctcgtctgcctcaataactaggtgcttttaagcggagtcacggcctcacgggtacatcattctacccagtaaagaactcacatcgtgatgtctacaaatactaagcacatgtgtttaagccatcattctacccagtagagaacttaaatcgtgatgcctacaaatactaagcacatgtgtttaagctatccatagaatttcagtgaggcacgggtcttcagtaagatgcataccatagagagatgataataagatttgacactcaggttgtttagtggctagaaatatatatagtatggtgattcatcggctttggttgtggtagttgatcggaaatcggagcagattggtggtgtcgagcaagctacggggcacgcgagctttttagtgtagtagactacggtacagggaaaaagctcgacgggtcggctcaggtgagtggaggcgatgacttccgcagagagctgcggcatcgggcgctttgggaaaggcagcgacggagctccaaggcagaggaggttgcaagttttctagcagggcgcagcagttttctcagtgaaagtggcacatttaaacataggttttgtgtggccgtggtccgtgaagaagaggagacggagcgcggtatagggaaattaagcagcggaagcacgaggagctgtcaccgtacgtgcgggcgtgggacacatgagtgccttatctctcggtggaccgtgaagtcgcgtgggtgtgggttgtttgagaaagatctttcaaccagtgtaatagctgataaaatatcattaacaggatcaacagcgtcgttcgtctacgcaggatatatcacgatctacaggttggtataatggagatatatcatacatgaaaagtaaggtccaggtttatacgtaggatgatttatgcgcgactagtgcaacaattgtttttttcctttgttttcaaagaacctgtacatttattagacaccacagtacaagtagtgtcaccgcttgcgcgtagtgacgagattgaccaacgaagacaatgcatgaatggtccatcatggaccgcttgccgcacagggacgacgatttcagcaaaaagaagaatagacgatcgaattgtcgtacgagggcctcattttgcatgtgcaccctgtactgttctccctgtagggctgtaggctgtggcccagcatgcatgatgcatgcagcaagcactgactggcacatgcctcacatacatacactcccatcgtgaatacgtgtactgctgatcgaccgatattttcagacttccagtactgattggcacatataacggccggcctaactactggagtactcaggctgtgtttagatctaaaatttggatccaaacttcagtccttttctatcacatcaacttaccatacacacacgacttttcagtcacatcatctccaatttcaaccaaaatctaaattttacgctgaactaaacacagcctcagcacaactcgtcgtctgcatactatacctattcatttggaaggtgactttgcacgagccgtcaaacccttggtatgtttgcatgagttattacgtgagcgcgcttgcgtaagaaactgagaacaccggcctctttcatccgtacagcatatccatccatctaacgtgaaaatataaacttaccctcgcacctctcttcagttatatggtatcacctcaagaacataaatagagatcagtctgatgagcaagcaatcgcgcacatcacgagtgcgcggcaaaaaatgacaaaacagtgtgcatacgaccacaagtttcctctcttccctgggcattcaacccgccacagcgcatgcttgttttttattctggttggactttgagccaacaaacagtatgctgtccagtaaaaaaagttatacacacacacttcataaattaaaanattatacgtaaaactttatacatagatactttgcgtagaaattttgtatatataaatatcatgcgtatgaatttggaaatgaattcttcgtgttaaccctagcccagaaagaaagtttactcatagaaaaagaaaagaaaaaagtcaaaattaacccctgaactattgaggtaatatgatttaatctcttaaatcacaaagccagacatttagcaccccctaactctttaaacctgatggattacccgtgagcatggtttgaagtggttttggcataggattgcacacgtggcacgaacctgacactccaatcagcaacaaaacgtcaaaataaatatccaagtgggctcacatgacatctctcacccctctccctctctcgggaaaaggccaagaacccaaggtcggtgagcggcggcgcttaaagagtaaggggtgcaaaacaactagtttagaggtaaattgtactacctcaatagttcaaggggtaattcagatttttttttcaaaataaataagcataaaaaccaaatacattgatactttgtgtgaaaaatctattccgtgcatatgcacaacttgtttaactcatgaggctcgcggcgcaagggttcttcacatgcgctaattagtcattttgtacaatctgattaaacgtaaatttggtaaccctctatgcggttttttttcctcaaactagtgtttattgttctttttctaaaatctgaaaactatatttaaaatttgaaacttttgaatcaaatttgaaactctacttaaattccgaaactttcaactcaattttcaaaccattcatctcaaatttcaaaaacttccaactgaaatttaaaactttaactcaaattgaagcaatcaacttaaattctaaaactttcaattcaacttttggaactttcaactcaagtttcaaaactttcatatcaaatttacttttgacttggaattcgatactttcagctcgaattttaaacttcaacttgaaccaccttccgcatacgaggcaagattctgtgtaggacttaatatatggtgggccccaccgagtttaactcaaaactattgagtatgcattatccataacactgatagaaactttcaacttaacactttttcgttaatttatattacaaaatgttattgaaccagattaacactaagcgggtcgggggtgcgctaagtaatataggggtcgcttgttgggggtgcacgacttgcccccacagagcagcgcgtgcattaggaagccctggccctactttctccgcatatgcatataaacattgtacgtataactttcgtacatataaatttgaaacaaattaaaaaataataattagcctacatgtgggctatatattgggcccatgtgcccagtgctacaaacacatgaaaacatatcaaattcaataacgggccaaatccataaaatttcatgtgtgtagcccatgcaatatgaaaattgtcaaatagtaaaggaataagttcatatgcggtcccttatttgtcaacgaatccgattttcatccttcaactagaaaaccagatataacgggtctcttaactattacaaccggtgcaatatagatcccatggtgatttagatggtggttttagcttacgtggcgcctacatagctaaattgacccgttcttcttctgacgtggcattgacgtagcaatttgatgtgagaattaataaaaacaatgaccccattgtcagttacactaaaagaattaattaaaaatggtggggtccacgtgggccccacatgtcattctcagccatcttattcttcctcctcctttctccacatattcagttcgaattcaaaactctcaactcagatttaaaaaattcaacttaaattctagaacgtttaattcaatttcgaaactctcaactccaattgaaatgttcaacccaaaatttaaaatactcaaccaattttcaaaacttttaatgtgcctgtgaaaatttaagtgatacacattaatttatttgtttcatgataacataaatttgtatgaaagtaaacacaacattttctatctcccccttgcacttacaaatagagataaaatttgaacatgttgatgttttgtttttgaaaactaatggctacacctcttcctcgatttaagaagcttactttgaggggtcttgatatttcgataattattcgttaccttattcgtttcgattcgtattcactccgtatctatattcgataatattcgattctgttttcgtatccgggtttctgattccaattccgtgaaaagaaatatgaaaacggatatggtagagctagtttccgaccatatttgattcgttttcacccctaaatgtgacaccttcttttcaacagcattagaaccaattttaatagaactttttattcttcaaaattttggatatattttcgagttctgtctcaaaatttattttgcatcaatagtttgtgtaatttatctcttagaaacaactactactataaatcacccatatttttccaacggtactataccttactggcctagctttcacacacctagctagaagcctggaatacacgggtacacaacttatacaggatcgatcgagaacattcaaattcagctcaaatacgtataacggcgaccggatcaaggaagaggctgacgacgaggcccttgatgtcgccgccgaaggtgtaaccgtccctgccaccaaggtagatcacctccagcgtcctcgtcaggttcacgatgagccgcgccgccggcagcagcccggggtccatctccatcaacgcccggttgatcgtcctccacccgtgctccgccatcgccgccaccgccgcgagggcggcctcctcgccgacgccgtgctccgccatgtagctctccaccgagctcggcacgtccttctcgttcttccccacgcggtgggacgcgatgtcgttgaggaagcgcgccacctcgccgctggcggcgatgaccacgtcggggacgccggcggcggtggcccactcgaacgccgccgcggtcgccacggcggcgtcgtcgtgcacgcccatcagcaccaccggcgccagcatcgggaagcccgacgacatgacggacacctccaggtgctcggcgaagctcggcgtgtacttggtgttcgaccatttggcctcacggaggtagtattcagacgacagcttaaactgtacatggacaggaaagggagaatttcacgtgagattctactgattttactctacatattagcatgtttcatagactgaaatgtgatttttactatgaatatttaccgcatttttggcgtaggacacgcggaacttctcgtgtggttctaagctagcctccaactcgtcaaagttgctcagcagcttgatgtaaaacatgcgcaaatattctggcagaatagaaatcgcgccctcgtcccatctgcacatcgacatgtatacatgtgagctgaatcaccagcataaggatcaatcaacaatgcaacatcatgagagattaattaattcagacctctgtatagcttcattgagcttatagcactcctccaaggtagcatggacgtcataggtatcatccatcagggacagcaatccaaataccttggcaaacatgatccgggcacgagagtattcctcctcatggaacacgccgcatgtccagaagtaggactccactaggcgatctcgagcatagctcagcttcacgctctcgtaaagctctctccaccacctgcaagatcatcaacctcttacacttatagcgaagacgaagaagacagtggcagcagcaatgagacgataagaaacgatcactcacaaggagagagccttgagctcctcaaggtgaagacacctcgtgagctcgaattctagcctcgcgagctccagcagcatgtcgtcgtgttcgtcctcttgctcatactcgacgaggtagctcatggtctcgagccgccttgggaaccgtgggagtgggatgtccggggcgcgggagacctgctcagccaatggcgatttgagctcgccttccatggacagggcctcgaggtggcacctcgcgaaggcgatgatgtcgtctagggcgatctctacaggtgctgccatgtgagctgcgttgtacaggctcagcaagcccctcgggtcatcacgtaggcttgagctgaaactacatgtaccatctctgaacttgtcgcgaacacatctgcatacgtacgcaaacacaacataatgccaaattaattaattaactataggtagtatctatatctaaaaattgtcacaagttttttgagtataaaactttcagatgtaactataatataattgaagtgtaattatattgtactatattgtaactacgatataacttatataaaacttgcattcaactatggtttggttagttagtactgaaatcttacgcgtgacacgtgtgaaacattcttttagcaatttttttcttcatgcacaaatctcaaggcgatccgatggttacaatcctaaaagttttgggaacaaaaaacttatagaagttttctagcaaatccgttaactatatgtattgccattcgttcttaaatcgtttatgcaaaaccaattttcttgtattttcctctatgaatcatcatagtattaattaatccaagactaacagttacgtacctgcagatacccagaccccatgctgcctaagcagacgaaaccgaagggcaacagtatacaggtcgtcgtcgctgcctgcaaaatccgcctcctcgcggcggagacgccccagcagcacaccaatctcgtgccggaagtgcccatctagtccgaggcgttcgagcgtgtccaccagcgtcgccgcttcggccacgctcatcgtaactccgccctcgccgtcgccgttgccgccgccggcggcgaacatcctgcggcgcacctccccggcgagccgctccgcccgcgccctcatccgctcctcacaacctgcatcaattaatatatatatgatcgtttaaaacaggcgaaaattgatcaaattttgtctgaaatttgacagaaatcatgtgagccactggatcgatatcacgcccgtgcctgcgagaggggaggggcgtaggtgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatttatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcttcttattcaaaacctcaatcatcacatcccctctctcccacttcacacctcggaacgcactattcttatagagagaaaggggttttcccatcttcttaacccgaaatgaaatggctgaggagagggaggttccttttgagggtaccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactctaagggtcaaagaaagccctttaattcaattctttattcttacattaaagaatgaatccaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcactttctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggtcgttgcggtcggactctattataggtttctgaccacattctccatgggtccctcttggatcttctttctccaatcttggattagggaagaaggagatattcgcgactcctggtggtttcattatggggcagctcatgatctttatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcgaaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaaattcattattggcccaccattgattagaagatttaacttgtatgaatcgctactaaggtcaaagccggcgccgccattgacgacagcgtccatctccagcggctggttcgctgctgcagccttgctcgcggccatgtcagcagcgtgtgtgtgttcagtgatgacaaggaggcgacgaactctactgtgtttgagttgaagtacgtgaagtgaagttatggagagagaacacagctacacaagtgaagtggtgtgcctagctctgatctgaagagttgtatttatagagctgaaacgtgagcccatcttccacgataaaacaattaattaattgacgaggtagcttagctgtagaggcctatatatatagctattgttgtgattttaatattctcgtgcgagtgtgaagcgtgtgcggctgttcccagatgttgtgattttgatatgtttaatttgcccatgattctgtcagtgcaggagaattacactacatgccgacatgccgcgagttggggaaagaaaattacagatcgaaacacacgtacccgttctcggccattggttccgcacgtacgcatcgagcgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaggagtacgagagctcagaaaacacacgctgagccccctacctggcgcgccagatgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgagaagcgtaataccctactcctgtgttttggtggatctgtgtatgagggagctacaaaatgtgagccaacctcttacttgttctaagttccaaatctggaaaagatcatccccctttccctatgggcaaggtcctccttttatacttcaaggggataccacatgcacccctctctttccaaactggacttttcttctcttcataaatggacggagatttgcacggttgtcctccgatcatccttctgacgggacggcacacacctacctccacttctgccgaaggcaggcgcgtcgtgggaacgtggctgtctgccgacgacatgaccagtgtcagactggtcattcttgtcctccacgcgtcagttcaacaatctgcatgttcgcccttcttcatacaacatataggctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgaccggtcacagaccggataaaggaacgcgctgcactgcgctgcatgcagcgtgacacgcttgaccagtcttacaataaatgcggttaggtgagcactgccgtgttcacctatcccatatatgtggcgcaaacttcctcaaggggtcggggtgcctcggccctcggggccgggaccggagtaacccgaccccccctcgggggaaatcaggaggagggcggacacctcaccctcgggcccgacgtccccgaaggtgccaggccgcatgggcgattgtgtctgcctcaagcctctggtcacgatacccccggtcccatatcaccgacaatgtacatatcagtaatagactagattaatagtaaaccaccttaatagtacatctacatgggtatctataactctctaaatccattgtctcgcttttctctatagactatctccagtttagtagatagctttgctctctctcttttcatttaatttcttccaagtaggaaaatatatgctgacatgaatctcttgtagatagcctataggtaaccattgcgggtgcccttatagcatgcggtgacatggacacgctccacggttatggcatggtgacatcgaccggcttaccaacttggcaacttgcaaaaagaaatactactacctccatagccgttgaatttttatccaacgtttgaccattcgtcttattcaaaaaaattatgtaattatcatttattttactgtaccttgattcatcatcaaatttattcaaaaaatttatgtaattatcattattttactgtaccttgattcatcatcaaatgttctttaagcatgacataaatattttcatatttgcacaaaaattttgaatagaacgaatggttaaacgttagttaaaaagtcaatggtgtcatacatttaaatacggagggagtatatacatatatatatatatatatatatatatatatatatatatatatatatatatatatatatatatatatatatatatatatatatatatatatatatatatatatatatatatatatatatatatata

SEQ ID NO: 7825 - DNA, 14428 bp, Oryza sativa
gtatatgtatatatacatatatatgtatatatacatatatatatatatatatatatatatatatatatatatatatatatatatatatatatatatatatatatatatatatatatatatatatatatatatatatatatatatatatatatatatatatatatacctgtcgatggtaaaatatgaacgatggttcctctagcgcaacaatatgctacatcaagggccttatcttttcgcttatacttatacttatcagccaatatttgaatttttaaccgtaaatttagaattgattttgaggtttttcattaaagtttattttttagcctttgcttttagttcgctaagaatatatatatatatatatatatatatatatatatatatatatatatatatatatatatataagtttccacgaataaggtgaaacgatggctccgcaaatgtcaaatagtgcatggcactagcgactaggacactagtgcattgtgtacagttagatatggtaagatgggacctagatagcaatattttagaacgaagatggtaaaaaccttgaaactcttttagataacattttttaagacagtttagattggtcgctacaggtaaaaaaaagggcatttaattatttgtcacttttaagatgtggcaattaaggatttgccactcgctgtctatgacataaattctttagaaccacacgtaagagtggcaaatagtagttaattattcctaaaaaaataatgaataaatttaaaaactgtacctagctacctagtacatggcgtgcatgagtaaatttaaaattaagaatttaagaactgcatatatcaatattctactttatgaaattagcatgcaaaataggaacgggttcctctgttgtatagcatgcatgcctgaaatttttacaatttggtcctttttgaaaacttattttacaaatagactcctgggaaaacttaaaccgaaaatggtcctttttggggcgccagagtggctggcgccgtaccccaacatgtcggcgccagccatactggcgccgtgcccgtgccaccgtggcactagggctgtcgtgaaggtgctgactgggcagaatgggggcgccagccacactggcgccgcccctcataccacggcgccagcatggctggcgcgcccctcctctgtgggccgaccttggtgatctgggccgtttcagttgcggctcagcagtgttgacgtggacatatagacagctctgtgaggcctgttgtcgttaggcaccatcatccaacatgagtggttgtgtgctattgattcagatgtggatgtggttaagactaccggttggaaggcctaagtggaggcaaagcttcactccttggccctacaatgagccagacatggagaagacagtggtctacctttttgagagtactgccactgcacatgctcaccgggatgtggcatacaagcattatgtcaatgagatggactgcttacagcctcaacatgtaagtacttccaatatcacttctagttagacatttacttctttaattgagatcctacccacgccatcttctcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttctcagagtactttcgttggctgcataggacatatagactgttcctccgccctacttggacggaagccgacatagaggatgaccgcgactccgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggagtgtgaatgaaatggggcatgccctccaagctccgaggggtggtgaggacacggagaacacactccgcaatgttttagaggtaaaatttatttagcactttgcattacttgagttatgcctaacaaacttcttttttttttaaatgcagaaagttcgtcaaaggtgccggaaacttgcagcaagattaggttgcaggtcggttggattggacgacgtgtaccaaccggggagactaccaccaccactacctcaatccgcgcgtccaagtatcgctcgacactccatcaggatagaagagcgtgaaggagttggtggctcgtcgtcgtcacgcattaagcaagggaggggaaaggggaaggcgccggctccacctagcgacgacgatgacgacgaggacgaggaggatgaggactacgtcgcaccagatgccgaggagatagacatgtcacagcttcccgacgcgcctcaggggacgtaacccacgcaatacaacttgcgatccactcaggcagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatataggatggacttttggcattgtttgatgtgtgggatatgtgatggattttttgcattgtttgatgtgtggaatatgtgatggactatgtgaggactatgtgatggacttttggcattgtgatttgtgcaattagaacctgttttagtctgtacgaatctgtgaattgtgatttgaattgcgaactgtgaattggtacatttgtgcaatatggatcttcaatttgcagggaggcagagggcggcgccaaccaccctggtgccgcggttggggagggcggcgccagccagtgccgcgaggcagaagggttttgggctgggggagggcggcgccagctaccctggcgccgtgatccatgagggcggcgccagccgaggcccggaggcggaagggcttcgatggggggaggaggggagcgccagccaccctggtgccgcggtcggggggaggcgccagctgttgcccggaggcagaacagggcgaaaatttttgggggggggagaaagttggtggggcccgtagaggaggggcacatggtatgaggggcggcgccactttggctggcgcccccttcggcctagtcagcacctccacgacagccctagtgccacggtggcacgggcacggcgccagtgtggatggcgccgccatgttggggtacggcgccagccactctggcgtcccaaaaaggatcatttccggtttaagttttttcaagggtctatttataaaataaattttaaaaaggaccaaaatgtaaaaatttcaggcatgcatgcattcctcatgctaccacagaggtcaaatattgaaatatgtcagatcctcgtttactctctaacgtataactgacttttaaaatttaaaatttaatttttcagttgatttttatttttatttttcgccattggtttttaagtcgctaaaaattattcacacattacttttaatttagaatatgtgttataaccagaacaagcgtcactcagatcgatagatataaaaaaggcaaaatttgctataggaccctcaaaaaatgtgtaattagttgtaggacaccgtaaagacgtgaatttagacactctaaaagtgcaataatttaccgtaggatactggacgcattaaaatataatatctatcctattgatgaaaaagaaaccacacaaaatgataattttacccttattatctccttctcccttctctctgtcttcttccgatgctcactcctagcaagttccattggtttgcccatggcagacagcacgccagcctcgagccgccacacggctagccgatcgcgccgccgatgatgatggtgccgcccgagccgactgcgcaaggcgtcgccgtgccgtccatctagccggtgcccactggcttcctgtcatgctacaactataacccgacaacccggtgtacaactagtcctcatattacggcgacggctaaggctacggctgcggcggcgcgtgccgctgcggctcgtgcgctggcggcaacaagccggtgaccagtgggtactacggagtggcctcagtgacggcgtcgtacgaccaccagggatggtactacggcaaccggcagccgtactaccaacagcagcaatgctacgaggaccccaacactgggtgcaacatcatgtggcgtgtgccggcaggcgccatcgccatggatggaagcaattaatcagtgcgtgtagtcattatcgctcacactcattcatcactagctcatagtcagtgttaaaaaaatctttctttttttgtcgccttcttgtttattatgccgatgccctttttttttatttagggtgttgagttgtgatgttgagacgagtggctgtccgccatgggtaagtcggtggagctcgctccaagtgagccagaagaagacttggaggaagaacaagggaaaaaatgttattttatatggttctctctcatcaactaggaggatattacatttttgaagtgttctcggacaaattcacgtctttgtggtgtttcacagctaaatacatattttgtaagtgttccgtagcaaattttgcctagaaaaaatgatctcgctcatgtgatcaatctactgtgttacctatactactccatctatcctattttaaatgcagccatgagtttctgtgtctaactttgatcgtccatcttattttaatttttttatgattagtatttttattgttattagatgataaaacatgaacggtactttatgtgtggtttatgttttttattttttaaaaaagaataaataaaacgaaccattaaagttggacacgaaatcctggctgcgcttaaagtggggtgaagggagtagctattagtggaccggccagaaacatattgtttgacctgacaagacatgatatgcctgtatgcacatgatcaccggtctccaattaattggtaagtcagctgaatacattggaaccagcccggctcatgcttcacattttcagaactctggtgtaatgtttagatttttcactagtgaattggaaaatttgggtctgaaaaattgaagttcatcgcgacttctcctggggatgtgatgccttcaaccgtcgtacgtcggtacgtgtggtatatatgaaactatgaatcctccacgcgcgtgggaattttcagttccattttcatactgtgtgagtagtgagtacagggagattctgatagcacatagaatgatacaagttatcagtatataattaatcgagtataattttttataaacttaaaagattgatttgtttgatttttaaaataactttaatttatatagaaaacttttacatcagccaagcctgtagtataatttagtataatcaataggcgtagcctatagtaaacttttacatcaaccacgccctaccatggcgacggcgatgacaacgcctgatgacaacgcctgcaggagctttcggtggtggtggcggctgcagcttcttgcaacggttgcgacaaccgcagcaactctaggtggcgccgcgggggagaggagccggcgtggcccacggcagcggaggatggtagcgtggccagcggccgagcaggacagcgtcgtggcctgtgcgcggcaagatggaaaagaaggcgcatgaaacctggtgatctggccctcaacctccaccaccctcccggtctctggcagcgtgggcggcgtgcaggcgttggcgaggagaagggagaagaagaaagtcagaggacaggaagcgatcgtcacctcctcttgggtgcgtcgcatgtattaatatatgatgcaaacaacctgcatcgtggtttacaagacgagaatagtccggctgatatatctccaactaacctggattacaacgctatctcaacagctaaaggataggatcaaccagctgaacatattcagatatacacatgatatctaacactccccctcaatcacaatctacctagattgagattgtacttaaaattctctaattgccttaccgataaagcctttgtgaatccatcagctacttgatctcctgtaggaacaaaatccacttcaagcaacctgcgttgtactctttctcgtacaaaatgataatcaacctcaatatgtttagtcctagcatgaaaaacaggattagatgacaaatatttagcaccaagattatcacaccataacctggccattagaggactagaaacacccagttctgccaataaggtctgtatccacatgatttctgctgtagcgttggccaataccttgtattctgattcagtgctagacctagaaactgtggcctgttttcttgcgttccaagaaaccaaattatctcctagaaacactgcaaaacctcttgtagatcttctatcatctacatttcctgcccaatctgtatctgaatatccacttacaagcatagactttgacttactaatctttaaaccaagtttagtacactgttttaaatatcttagtatccttttcacagtagcccaatgaatcgtagtaggagcatgcaaaaactgacataccttgttcactggaaaagcaatatctggcctagtcagagttaaatactgaagtgctccaactacacttctataattagaggcatcattgagacccaacaaatctccttcatgcaaagtgagcttctcactagtcgataacgatgcacttacaggtttacaatcaatcatgccaactcgcttcagtaagtcattagcatatttttcttgagtaagaataatgccattacttatcttatttacctctatacccaggaagtaatgcaagtctcccagatcctttaaggcaaattctttctgaagatcttgcaacagagttagaactgcatcctgcctcgaactagcaacaattatatcatcaacataaataagtacaaagattgtaagaccttgtttgttgtaaaagaataatgaggtatctgccttggatccctgaaatccaagttgctgcaatttctgactcaacctagcataccatgctctaggcgcctgtttcaaaccatacaaagccttatcaagtttgcaaatacaacctggatttgctttgtcttcatacccaggaggttgtttcatgtagacttcttcttcaagtattccatgaagaaaagcattatgtacatctaattgccttagagtccagcctctagacacagcaatagacagaacaagtctgatagtagcagctttaacaacagggctaaaggtgtcctcataatctataccatatctctgtttaatacctttagcaactagtctaactttgtacctgtctagactgccgtcttgttttcttttaatcttataaacccatttacaatccatgacattttttcctttttgtggaggaactaagtgccaagttttattgtgtaataaagctgtaaattccgcatccatagcatgcttccagtttgtatcatgtaaagcctcagctaaatctctaggttctccggtagtggtgagaaaaccatacttaccagtatcatcggtatatattttttcttttctgatacctttttgaagccgggtgactggtcgagtagctggacgctgtggctctccccctggcgcagaggaaccttgcgcctgtggttgacaagactggtcagccggcgacggagctgcagatgattcatcggcagcatcctcgtgtgcagaatgatgcgcggcggacagaggactactgtcctcttgtgcagcatcagagatattgtcagctgcttggtgttcggctgcaccagaatcggctgcatcttctgctgcatcattttctgtatttgctgttgcgttttgctccaaattttctgcaggagacagattagcaggaattgcaggataataactcacatgatcatccaactgaacaaccccaaaactaatcatgtcagtcggcaaaaggttgatctccttacggagattggttccagcattaggatttagttcggttaagggaaaaacggactcatcaaatacaacatcacgggaaatgtaaatgcggccagtagatgaatccaaacacctaaagcctttgtgaatggggatgtatccaaggaaggtgcagcgcttagagcgaaaatgcattttgtgattgttgtaaggcctaagattaggccaacacgcacacccgaaggttctaagggcttgatagtcaggggtttgtttaaacagatattcaagtggagaggaaaaaccaagaactttagtgggtgtgtgattaattaaatatacagcagattgatatgcctcatcccaaaattttaaaggcaaggaagcatgtgctaaaagagagagaccaacttcaacaatgtgtcgatgttttcattcagctgagccattctgttgatgtgtgtgtggacaggacacatgatgtgtaatgcctattttgctgaaaaaagtattcaacttttgatactcgcctctccagtcggtttgcatagctataattttcctatcgaacatacgttcaacaagactttagaactcataaaacttttgaaaaacttcagacttgtgcttaagaaaataaatccatgtaaagcgactgaaagcatcaataaaactgacataatatttctttccacccccggcaacaggagcgggaccccaaacatctgaataaatcaattctaagggaaaactaaagacactagaagacttgggaaatggcaactgatgacttttccctttttgacaagcatcacacaccaacattttattggactcagctgacactggtagatcatgattacgaactactttttctgcgatagcataggaaggatgaccaaggcggcaatgccaccgctcgagggacggtgtagtggcagctagggcttccttgtcttgatgagctgaaggggatgaagatggaagcgggaacagccggccacgacagcgtcctctaagaagtatctccttcatggcctgatctttgagagaaaaatgtttaggatacaattcaagaaaagctgagttatcaaccataagccgatatgctgaaatcaaatttttgttggcatttggaacatataagatgttattcaagtacagaggccgagatggggtgttaacaattgaacgacctatgtgagtgattaccatacctgcaccattcgcagcttgcacctgatcttggcccttgtacttgtcccgaatggttagcttctcaagttctccagtaatatggtctgtagcacccgtgtccacataccaattggagtccacaccataggacgcagctgttcctgcatatttttcgtcaggtacaaagtcttcatcatacctgtaccagcaatcaatcacagtgtgcccccttttgtagcacagttggcacttgggacggttgtcggtgttgtttccaccttgtcgctggtaggaggtgttgccgcgccctctcccgcaattttttccgccgcgaccgcattgttgctgctgctgattaccttgattgccgcaacctctgccttgttgttgttgtccacgaccccgccctctgtgagcaaggttcgccgagtgctcctgacggagtttcatgcgctgctcaaagctgagcaactgggagtaagcctcccctaggctcacatgttcagattttgacaccaaagaggaaatgatgggttcaaaatcttcatccaatcccacaatgataaacgagattaggtcttcttcgtcgacgagcttgtcggaggtcgctagctcatcagctagcgcccgtatcttgccgacgtattcggcaacgctgaggtcgcccttctttgtgttcgtcagtgtaatcttggtgttgatggagcgtgcccttgtcgctgaggagaacatcccttcgaccacgctccaaagcgcggcagcagatccgcacgtcgccaccttggagagaacatctctactcatagtggttagcagatatcctagtacctgctggtcgttcgcgatccattcgtcgaacgctggattggggacctcaacatctttgtcactcttcttgatgatggtggtcggcgatggcgctcttatggcgccggtgaggtagccgtcaagccgtgctcctcgaatcaccgcaaggacctgaaccttccagatcaggtagttccccttgcctagtttctccgtgaccgtgatccctccaagagagccaacggccggagattgggacgagctcgccatgagtagattggattgaaagaggagaaggctctgataccaagaagaaagtcagaggacaggaagcgatcgtcacctcctcttgggtgcgtcgcatgtattaatatatgatgcaaacaacctgcatcgtggtttacaagacgagaatagtccggctgatatatctccaactaacctggattacaacgctatctcaacagctaaaggataggatcaaccagccggacacatccagatatacacatgatatctaacaagaagatgatgaggtgatagagaagagagggaggaggaggagagcagacagagaaaaaggatgaggtggatgaatggggacactgatatgtgggtctcactatttttaattttattattttgactgacgtgtgggaccatatattttgttttatttttaaattttatttcatatataccacgtcaatgccacgtcagatgaagaccgagtgaaattagccacatcagcgccacgtctactaaaaccgccatgggacctatatattacaccggttttaacacttgagggacccgttgtatctggttttctggttgaaggacgaaaatcagattcgttgacaagttaaggggcatcggatgaataattccatacgacaatgttctgtgtgcgtacgaaaatgttgacgggccttcctggaacccaaaccccaagattggatcgctcgctaccattcggttcatattactaatgggcttattcggccagataattatttgggccgtatccccaccaaaaaaaagtgtttgggccgtaaactgagacacatatacagttcactcaaaaggaagaagaaaccagaagcccaataataatccatctagtctaatcggcgaatatccctctcgccgaactcttgttcgtcaccttcaccaccctccgcctccgccgccgcctcgccgcgccgccgccgccgccgccatcgtgggcggcgacggcgacgtccaccatgacgatgtggtgatccgaggtgcccatggacgggacgacggcgtacgaccccggcacgaagttgtacggcgagttgggcgacgccaggatgtagtccaccctcgtgccgtacttgcacgtcccctgcacatctgcaccgtaccaccatggaagaagaagaagaagaagatctcagcgatgttaattagcagcagcttcagatcgccggaataattctgcaagcgataagatttgtcagtaatctaaccttggccattgggaaccaccaccaggccggcgtcacgccctccggcgaagtccttggcgtcgacgtagcgcttcgccttgaggtgcctcatcacctccgacttcggcggcggcttgccgatctcctcgtggtactgcacgcacgccgccgccggccggaaattgcccatgatcaggatggatcaggatggtttcttggacaaaatcgattgattgattgtgttggaatgtataaagtgaattgtccatctttccctatcagcttaggcttttagttgcaactggctggtgcatgcaacttaatagattgattggtgtgtggtatgtaccttggcgatggcggcccagcggtcggcggagtagtcggaggcgtcgagggcgttgaggccgccggcgaggatgtggtggtggccgtcggcgaagcggaggatggagtcgacctgcttcatcctgaggccctcgtcgaggtggtccagatgggtgcagtacaggttcacctccccggctcccggcacctcaatggtggctctcatcacgttcctgcaccattaatgccttattaatatgtttgttactctcttacttactgtgttccttgttcttgatcattaacttatctaggattttaaccataccaaattcaggcctaatcatacacatacgctgctactctctccaactatttatgttctgaatgctactagcttggaattaatttaggattttggggacattttgtcttaatttgtgcagtggatggatgagtcacgcttctcacctgctgaataaaataaccattattaattcgattagagtcttaaatgagcccctataatgcatgtttgattcaaatgaacgcattttttgttgtttgttgtctccgagctagaatgtgcgtatgtatactcacgttgggtacaccggcgggacctattaagtgcgatcgaggtgcccgtgtggcctactgtggcagctagtttaatgaagaaccaaagcattaataatttgataatgtcacgctactaatcctgtcgcggataataattgtgacccatcgatcgacactgcagcaacctttgctgattgctagatgttggcctctcgatgcttatgaagcagctaacctaattctccttttagctcagttactagcttagatcaggctgagtccattgggtaagcatctcagcagctgaactgctaagcatttcatcaactactgttatattaagtgggggaaaaaaggcaacatttcagctacacttactccatgactaatcttttgtgattgtacttgccaaagtgcatacatacgtatgcccttctcatctaaattgtcatcgtcccattgtcgtatatgataattgccacttaacttaagaatatggagaaagtaagaaaaatcagctactttttgttgtttctgtcaaaagttttgacttgctctcctatgtatgcagaaatacaaatagtattatattggtggttttctacttactgaagggatagactttgatagcaacgtgtcctcgtttcgtgcatatcatcaaatagtataaagcttcgttattgatagtcaaggggcaatttgtcatctaacacagatgcaaaactaaacttgaaccacatatggaggagggagaaacgctaatttggtcgtaaatagtgtaaaactatgctcagctggatttgatttgattttactagccttaataacagcataatctatagtcattaatttttttcccaaatgtcaaaatttcataattgtttggaactttggatggcatgtatgtaagtgcgcacgtgtaatgtaatgtaattaagatatgagacgatgtaattactgcaatgcaaatgatatgcatgattcggtattgctttcttctaatataccgccgtgcaatccttttacgtgttcgtgaaaaagatatgcgtgattcgaagctagtaaggcagcaaatgtaggcacgcatggtggcggccatggcgtgcgtggtgatgacgatctgacgtgtgtcgcgggtgtgacgtacgtaccggaagtcgaagtggtcggcgaggcggcgcgcgttccagcgcttgatgggccagcgggagagcacggcgttgccgtactccggcgcccagctctcggcgaacacgtaccgcatcccgagcccctcggcgagctccgacagcggccgcatcccgcgcccttcctccgcgcgcacgttctgcagcgccaccatgtccgcgcccgcctcccgcagcgcctccgccacgctccgccgccgcgccgcgccgctgctgctccggtgcctcgccgtcgcctgctcccgctcctgcttctgcttctgcttctgccgtcgctgctggtaatggttctggtgctcccacaccgccccgaacaccgacctccacctgccgctcccgctggtcgccgccgccggcctcgtcacgaggcgcgcg

SEQ ID NO: 7826 - DNA, 8992 bp, Oryza sativa
aggccggggcgcgccacgtggagcacccttcgccgtcgccgtcgtagtcgtcgtgatccggcggcgacggcacggcgggcgccatggagaacatggcggcgttgaacgtcgccacgcggatggtgacgggcgccgccgccgccgccgcaggcggggtcggcggccctcccgacgcgctggcccgacggcgatccagcttgccgctgaaccggcggatgacgacgacgcggggcgccgccttggatgacctccgcgcggccccgccgccggcgcccgcgcgggggcggcgcggcggcagggagcggagcccgtcgaggaggcaccggaacgcgcgcctcaccgtggacgccatggacgtcgacgacggcgacgccgccgcggtgaacacgcgttacacgcgcctagagtgttcgacgacgtagctctcgctctctatacgtggtagagggatgagtgagtactttgtgcgtcggtttagatggtcctcgtcgtagtagcgtaatgacgtaattaaagagtcgtttggtatccgtagtgtgtacatgtgcatatataagtgcaatttttagccgtttgattggttaaaatacgtactggttccagtggtttgtgtaacactcacacagccacggtacacggtcggtatcaggcaatcaaagctgtcacagagtcgcatttttggcaggattttcctgcatcccagaaacacggatatgcttcagcacggatagttacttaaagcaggattattgttataattgatacagcaagtaatgtcttcatttggtaacttttataattggttttgcgatgcaatcattgacaggaatttgatgggttttctatcgaattttggattatcagagccgtgtcaagaatcgtactcggactcttcctctgtctccggaagctccttgtcttctccggaaggataatatactattgatgcaatcatacaatcaaaaaatagttgagatcaaagggattttttgccaaatgttccataggagatccctttcttatacgtgtagcaatagaaagtttgaagtttctcttgggttaatgaagctaagatcgtgggcttttgtggtgaatatgatggcgcagtgcctgctgttcatgtaatcggggtgaaaaggaaacaaagttcaaaatttcttttgaaggccaagcgcttgcaaagctgcaatctggaagtaattgaagggagatattgtcaggactgttcatttagctgaataatcctggtcaatttcctaaacatgagggcccttccctcactgacgaagtgaaaagttgatgatgcatgctcatctaactgctcctctccgatcgattacgaacactgggaccatatgcacacgttggccgtcgccatcagcaccgcatcctctactgtacggatactaaatccgggtggagtacacagtttatctgagcaataattaagcagaaaatcttggtatgcctggaagctagtttctgccactacctgtttggccaaaatataatcaattgtacttcaagttgtttcagaatagtacattttggcgaaccaaagacaaactgatattgtgctgcaagtgcaatacatctgagaaacaaccccactaggatatagtacgaaggatgatttgaatgagcatggagtactttgctaagttaagttattattacctgaagaaattgttggccacacccacatttgtacttaaccagttaaccatatggtttgaatataatataataattgaacaaagcaacgtgaaatacagagcagtaactaatgaaccagattcatttattcattcatttaccattcccagcaatgttaagttacaagtttacagctaaattaacaggagatgaattcatatatggacaaacaggatatgtctctgtgattttattcattattttgtagtgctttccacagctttagccctggggaattcacctccaataataatgacctgggaaaggatttaggaggccggggtgaacttgatcgaaacactgttcacacagtgacgctcatcagtaggcgtcttgaagccttctcctttgaacacgtgacccaaatgcccaccgcaagctgcacacgtgatttctaccctccttccatcaggatccggctacaaaaacgcaatacaaaattcagtattccttacgagaaaaaaagaactttttaaggatttagtaaatggttatgcaagcgtactgttcggtttatggctccaggaagtccctcaaaaaatgctggccagccacaaccagaatcaaacttggttgtggatttgtacaggggtgttccacagccagcacagttgtagaccccatcaccatagaacttgttgtactcacctgttccaggtaacctggatggaaactagagtttagtaatatctttgaaaggacatctgcttcagcatagtagcaacatttctagaaatcatttcacatcaagtaacaaacaaagcggtcatggtcttaataactacgctattttacccgacaacatgccatatgcagtgttccaacatatatccgtcagtaaacagcttacctctcaagtgacgataattgaggaaaatctaaacagcctgaccattcaatcagagctcaatccacctagcaattgaccgttcattttgttatgggctagtagtgattgtttcaatggaggtgttgttcccggcagccagtggaagagaaccgtggcaacaaggacgtcgcgtgcaggaagtcagggacaacaaggcgagggagaacttgagatattctaaaatctgcttcaaacaattttttggttcgtccgtcaattagtccgatcctccgaggcagtgtcctaatcctcattcattgtttccgagtcctgtgtacatcgtccgcatgttcggcccgtctgtgtcagtttagcgtgacttgcgcgctaacgaatcgtttctgttttcttttttacattgtcacagtgcacatcggttttcctatgtcgtgagattgctggatcgagcaatccgattcagcctaacggcctagcaatttcagcataataaaaatactacgtattcatttgaggtggcgaggagccatctggccagaagaaaaaaatagaacgaaaagaaaagggaaattttgggctagtttgatttaggcccgttactgttcaagatttgactagatattgtttactgggttgaccgattacttttccatggcatatggtaacgtgtgcatcaatgcatgggttaggagacagatgatttgaacaatgaaatcaaattttatatgggcaatgggcatagagatggttaatttgattatagttcaagtttgatatgccggagttagatgacaccgagaatttctctcttacagatgaggatgaaaaatatattggctcaatagaaaaaaagatcttagctcacacaaaagcagtaaaatcaatgaagacaaaagatgacaagcgggagaaaattaaatgccatgcaactgcgactacaagattttaggactaatttgcaaccatcagagagaatttaaaataaaatcgacaacctaagttttatcataaagaaaggtatatatcttttctatccattgctagaaattggaatcccaacccatctcactaggccatctgccaaccacactctatttctctcaattttcttgtcttttcttcccgttgcaacgcacgggtacttttctagttaacttatatttgtgcaagtggccctaacaattggaactcttacttattccagttcctaatggcttaaggcccaaactaaccctttccaatttaaccatacttctaatttaaataactaagggctgggatgctgctgccctggtccctataaccataacacattcagagttcaatcaacctagtaattgagaatggacttgcaccagtaaatccatagttccacataattcaatgttctgttcttctacgagacacaggctatggagcagcataagcttccaaaaatatgcagttttgcaccttgaatgtctaaagctcgtaatgccatgtcaaacaggttttggtccataacaactgttcaattaacactacacatggatgtctaattatgtacacatgaaggaatgttgaaggtagcactaacttttaatttcctattcaactaaactctatgagagggcaaccattccatttccaagtgtcacacacttgaaatcatttataaacatgtactaacccgtttccagcgcctgtatattttccaccaggaaccagtgcctgtataaaggagtggacatataaagagcctagattgcatccccatagtggaaaacaatagtgatacaaacaaatacatccctttgttagattaggatagcgctctagtcaccttccagaatccaatttagaattttgtagaacttgcaatgaaactaattccatgaatctgtaattttgggaagtctaacactcaaatcagctctgtcattctttctgcacacactctcattatatcatggtttcagaaaatggctctgttatattggtttgtgaatcccatcaggcatgaacagacttataactaaaatatagatttaacaagtggcactcagccactgaccgtacatcccctatgccctccagattccttggtatctatcgtaagtcaacttggacatgttggcttatatactaattatatgaggagaggccaacttgcagtagtttataggaggctccaataagcattggcatgaagcatagttaagtagaccaacaaagtcaatggcactttagagggccagaatcactcgtggtgtggcaaaaaagaaaaaaaaacacccaataacacaacaaatcgagaacatttgatgaacatctagctccatccaatccaatctcaatcgacaaatccccacggcagcaatccatccatcacgagcccattgaggagatgaggcaggcaggaagggaacgacagcatcgcacggatcatcgattcacaaaactgcgggtgcggctaataagcgcggcgatttttcctcgatggggaatcgaatctttccccatggataacacatggatgatggatgggcgaacatggcgactaataactagagaagattgccgtggctggcagctgcgacgggaggagggggaagaaggggaggagatggatactgactcggtgcccttgaggcggaggatgcggaactgctccggggagaggacggcgcgccactcctcgtcgctccgctgcttgccgctgctgtcccccgacgacgccatcgcgggcggcgcgcggcggccgacgaagcagacgacgacgacgacgacgacacgggagtggaggagtgagtcgatgcaggagggcagcagaagcagagtaggtgagagttgggtgcgtgcgtggccaccggcgacgccgcttaaaagcccacaggaccagtatgtgccaacgggccctccggccctgccctccaaacggataataagtacacaacaacatgacgtttcgcgaatgacggttttgcgaggtttgctaggatgaaaacgaatcacgggtggaatctagctctatcatattttttatattttttttttggaatcagaaatccggatatgaaataggaatcaaatattatcgaatagtacagcttatttttgtatgcggaccagttaagagcccgtatggaaaaatcgatttttttcatatgagcgtcttaagtagccgtatgtgaaaatactacttaatttttctaaatgcggcaaattgttgcccgtttataaaaattgtaaggtctcgtacacaaaaatcgtttatgttgttacaattagtatcaaaatgaactcttttcaaaatttagtaataccaaaattttagtttaataatattgctaaattttggtaggataggctaaatgtgatgttaccaaaacttcctaagtattaccagtatctaataataaacttatacgtatttgttaattttaccgaataatgatatgatttaaaatgacatcaaaatgagcgtgccctaagattttttagagtagaaccagcctatctagatttaagttttagacttgacctacagtgttggcatttacgactaattactatgctttgagaagtagatgttacatccattaaatagctagaaatatgtgatgacttcgttaatattaatattaagatgtaatagtctaatcttttaaaagtgtttacaggggtagagtgcttgtgcgtattcatggagtgagcatgcattgttgtgagctcagcgtttgtagcgtgtttctaagggggaaaaaaagaaagtgcattatctgggttgttcgatccattacgcaaattcctgtgtcgcaacaagataccgtgacattttggctccatcgtcttaccgtgtatacattagagactgggacatattttcacctgctaaacaaatcttcatctatattcactgttttgtactccgtatgatattcccgtttctgctccactgctccacaaaggtacattgaacttggacgagtttccggctcaagacgaacatgactccttttgttatgagtgaactgtctgatcttaatttccgtttctgctacacaaaggtgcaatgaacttggtcaagtttacggctcaagatgaacatgactctttttttatgagtggactgtctgatcttaatttagtcgccataaactgcaacattctttaatactataaataaaaaatgaattataattcgagattttttaacgttagttttcttttagactagatttatctcattcttttacttttgactggtatatgtttatctttgttatacttcggaccatcgaaaagtttgacactttgacgttttgataaaacttatttttataaatagatcttgataaaactataaccaaaatcgaacctctaccttagttttatggacctgggtactgacacccaacatcttggcgccacctcttcggtttcactgccatgactttctcagtttggttttatcacttcggaatagctcccagcctcttgtcaaaaaaaaataataatcatgcgacagtggcgattcaaactatgatcttaatgacaaaacaagaccacttaccaatgcaccacattcacttgcttatctagttgcgtgtagtaccattttaagttttacgttagaggtgtcatcactaaatggatttggtgctgagatattgagtctcaacgccaagggttatgatgctgaggtaaaggaatatttttgttttagtttttatcaagatctagttgtaaaataagtttggtaaaaggaccaaattatcaaaatcgtcgtcggaccaccctaatgcgtctgtgtacccatatctaacctagtccaaaatgccgatgtgccgacatagggtaccgatgtgctcacaaaaagagttttgatggtctaaatgaaaaaaaaatccacagtaaaaaaagattaagtaaatgatggttcgatgtaaaattgaggtaacaaaaggtagtccaaagtacactttactttttaaaaagattaagtaaacagtaaaagatgcagtatgagagagataaacggctcttcttgtggcttcacacgttctgagtttataagaaagaaagaaattattaaatcaaggcaggcttgaggtaggacgagctgaaggatccagcattcatagggaagttctgaagaagatacacgacttctcaaggtgaaataaacattgcactggagtctggagttggatcaaacaagtctgactgatgcaaaagcgaaaattttgagctgccagtgtaactgaaatgactaccaaaacggatttgaagtattgagcctataaaaattggaatgactcaaattgatgagagattgagagctatatatgtaggttgttcagaactgcgactaacttgttccattttgatctaagaaatctatctagtatactactcccttcatctatttttgatagtcatatttttaaatctgaaaaatttatttttgatagtcatattttcaaatctgaaatcatcttaatgactttctcggatttaatgcgtgactctccattcttccacacatgattggctacatgggtattgagaaatgtaaatattaatgaattgcttgtttacgaggaatgactagtagcatgtttaaatggatgataagtagaattacttatccttagtctgtgtgccaatataaaatatgactatcaaaagtaaatagagggagctccttaaagagtgtaatggggacccattgccattagctgaaggtatatcagtgtgaactataagaacttccattgatgattgattaacaggagaaatcaaccggatgatttatgttacttactgagatgatgacaatgtgggttatgcacagcttacacaggcaacgaacgcccgctacttactactaaataatgcacatgccgcgctcgcgtcgcgtcgcgtgtcacggctgcgacgccgccccgatctcctccacctcgccggcgtcgtccacccagtaggcgtgccatagcggcgaccgcctccgcggcggcgtggagccgacgcagccggcgagggtggccctgaacttgtcgtcgcccggccggagcatggccggcagcggcatcctgacgccccgcgcggcgcaggcctcgtggcgcggcgcgatgcgcgtggcgagcgcgtaggagaagtactccgggaactcgaagaggtcgtcggcgtcccgggccatgtcgccgaggaggtactccgccttgggccgcatgttgccgtcgatgccgtagtagaagagcgccgggaagcggcgcgccatggagcgcgcggcgcgggaggggaggccgagcgactcgaggaactcgatccgcgggaggagcttgtcctcgacggagaaggagagcaggtcggcgcggcgcggcaggtccggcacgccgagcgcgcggaggaagtagagcgtggggcggagccgcgcggcgacgg

SEQ ID NO: 7827 - DNA, 13582 bp, Oryza sativa
tggcgcagcaggacctcctccatggtgaagactgtaaacttcggggacggcgtggtgaacacgggagagagaggtcgcgagagagagaggtggttttttttggcgggtggcaagcagggaggaagataaggaggggtggggtaaggtggatagggggtggcgcggggagacgtgattgggccagctgtgatctcccgggatttttccttcgctgctgggagtgggaggggaagatgcgaagctggtccggtgcaatggcgtgggggaaggaaaagcacagccacacgttgagctctaccgctgcaagcctgcaatgtcgtttgctgtggggagagctgtaaaatgggagcgaaaattcatggccacaagcaatgcgagtgttttcttttagctgtagggacatgcatgggatcaaagtcgagtgatagaatgagaaggactatgtggcaatgcctataagagacgaatgtctaaaatgaggggatgtcctctcgagagacaaaaagtcaaaaatacaagagccattgcactgcttatttaacactcgtaacaaagaaacacgagacacccatatggcaagaacaatatagtcttagctcttgaacaaacaagttaatagagtttcatagcaattgtgtaaagctaatcaggccgcgaaacaaaagtggcagagaaaaatattctcaaaataaaattcaaaagcaaatacatctatatgccctatttggcttcagggctttattgcagccgcaactacttctagaatccagaatactcaactctctatctagattataagaattagtaactatggaatttaaaaatgaactactaatcggaagctggaaaacatgggatctctatattcccatcaatcatcagcttccaagaacatttagctcttccaaacgtgactttacgagtccttgaaaacaattgcctcaaggtttcttaagtgttctcgtgaactctagatgatagagagagaaaggcttttttcttcctcctcgacccctctttctcctcagttcctatggccctgtcactggtgatgggaggtagaggggttgggtctccaccctccttgtaaatccacagtaatagtcagatctttcttttccagtttctttctttcgttacccctaagggttatactttgttccctctatttttaatgaaataacacagtctcgtgttgattcctttttaaaaaaatatagttagatcttttcattaggtcatgttatttgggtagctttattcttttggttcccagggaggtcatcggggctggtcatccttgccctggtttccacagagagtgcataggtgctcctcttggtggcattcttcatagtctacgggctagtttccaccaccgcgccagatctagtaaggtcaaggttgtgccagccatatcacctatctctagtgagctttgtacaagggcaaccgtcttttcctttgtcgttgacaacaatttgacaggtaactgagttttgagcaataccttagaagccttaacctctagtcagcggagggctcatttgggtaagctccttggtgccattttctgcagtatgtcatgcaatctttgtcctcattgtcaatcaatgttttggctatcatcctcgatgctcctgctccaatgtcggccaacttcttcggctttagtgatgtttatccaaggtgtgtggctgattgcttctatggaatgccaaggtcttaacctccatcgatgtgaggcctcaactgggtttgtgctaaggcaacatcttcagcaattcattgtgcaatcaccatcgtcaatcgtgtcgtccaactccaaatcttgctgtgggcagagaagatagaagcacctaattatttttccaattcttttaagtcctttgcttaaatttggttgtaatttttccatctttaaactactcttctaaaaaaaaggttgtactatattctaaggcctaaacccaactcaatctctctaattcattttgcgagaacactttaacctgtttcacttattttttggatgaaattgaaattatttggccgtgctctagtttcctaaaaaggtcgagcggagttgaagctatgctaaacaagctcttaaaaagggtcctccaaagaaggtccataaaaacggctctaaggcttttaatgggatgggcctggccctaatttgggcccaaagtggcccagtcttgtgtgcttgctgtactagtttacccgggagcaactcgtagatacaacttgcggtaggggccttccggtaatttgacgggattcactaattggaacttggtgttgggagtccccgtcgactcgcactcgacagtcgatcgccaacaagcccaaacccggagagagccggaggagatccgtcgtctcccgcatcctcaccggccgccggcgatggagaagggcaagggcctcgcccgccgctgggcggtggagctccacgacgcctcctcctctcctcctcccactcctccatccccgacccgcccggcttcaccagatccgcccccgacgcggtactacctcttcttcccccccccgtctttcgtccaactgctctattctcttccccctcccgcctggatcgcgggattgactcgtgtgctctcttggcctcccgcaggacgacgccgccggcgcgcggcagcggaaggattccgagaccgcgtggaaggcgcaggtgagctcgatctccccctctttccctgcgtgattgtacggtagatccggagttttagatttcttccatggctgtacgagaaattcggtgtggatcgacgaattctgtcgaatctaggacgcgtcagatcttgctgcctcgttatctccgcggagtgctcgaaatttcgcttgcaattgcatatgctggtatctaggttttaggtctgtgtgtgttgactatactgtctgtgctcgtggtgtgggcagaaagcgtgggaggtggcgcaggcgccgttcaagaacctgatgatgatgggtttcatgatgtggatggccgggagcaccgtccacctgtttagcataggtatcacgttctccgctctgtggcagcccatcagcgccctccgctctgttggcaaaggtacttcctcctgcctatatttggttggtgtcacttgctaatttagctcgagattaacagtgttagtgctaccgattcatactggcaagtcctgagctcctgatcaatgaatagtttagcctcttttatgcaatttcttttctggcgtccgcgtagtctggctgcttgtacctgggcttccatattgtggtctatcttttgttggtcaacctgatgtgtattcatgttaagaattcttaatgcctggtcacctgctgcttgtcacctagattgtctgtagagcgcaagtaatacctaggcatattatgctaaaaaattaatgtgggatgcttttcatactcctgaaatttttagatgtgtgttcatgctacatcatccctaaaattatagttgttaattttactatattgtttataacaaaatcatcttacgtttccaaaaaaaaaaaatcctttacctgaactgtagtaatagaccaacaaaagtatacgaaaataaaagagaattggacatatcaatgattaataacgttgcttgttttacagtggagctgattcgtaaaaatgaatatcactgtcaacctgaataaaaatatgcaaagatggctattctgttgcataaaatgctaatgattaactcgcatcagccttctatcttctaaaggcacatgatgattgaaccttcagttgcttgtatgtaacaatgaagtattattctggacttgtgactgatattgattggctacagtccacattcatgttgtccatattttagcagccatgtaccagaagttgtgacaacaaaaatgctcgtgacattcagtactgtagtctaggtgttgagtttttttccttaataaaccttctgtacttttgcagtttttgaaccattcaaggacccaagggtggatactctagcacctaagttggtctttattgctctcaacttggcagctatgggtttaggtgtatggaaggtaagttatagtaccatggtttagtcagaattttcatgtttctctgtaagcactttgggcacttagctgcttcttctacagctcaatacgttgggtcttcttccaacaaatgcatcagattgggtgttttcactggctcctgctcgggtatgttgctgataccacccaaattacttcttgaatttatctggtcacttttaggtttgttgtactgggaatgtgtgttactctctctgatcacgaaatacttgtccttttggacatacatccggtctttttttttaaaaaaaaaattgagtattggtatcttctaaaaatatttagattggatatgagagtcatgtgtcaatttgtttcataaagtactttataatatgattactttattggggttttcaagtctataacaatagaattattggtaaagttacaattaggaacccatgaaaatgttaaaaacgaccaagtatttgtgactggaggtagttcgtccttgcataattgatggtaactactgtgaaaactgggactcaatcaacttgctgctaccagttgcttgttctgttaattgcttcacctgttcatggcatctgcaacttcactataacctgcaaactgcccaaaaccttttgatatttgtccaatctcagtgaaacttgttttgtgagattgtttatttacctcctgattggcatgaaacttgggatatatacacagttagtttttgcccaacaaagataaataatacaaaatttgagattgaaacattttgaggaatttagaactgagaagtaccatagcttgaagactccccctaaaatattgtatggtacaattcatgatgtgtggcgactagtcacaacaggttcatgttcacctgtatgatatccacatctctctctctttttttttttgttctggctatgtcaattgcttcaacaaaatagccaaaagcccaaacttgaatttctgttagagacttggctcttttttcttttaatgtatgcacacatttactggtacaaattgtaaatattgcgaccaaaattttatcccttttgataaactttctcccttagccaccgatacttgatatttttccagtcaatatttctaactgaaagtctagaatgttagtttgccactatttacttttatgatctatatggattgataccatgtatatatatagcagtggttgctcgaactgattgagttttattctctgctggcaggaggttgaatatgctggtggagggatccccttgcactgaaacctttatgtgcttcagttagtacttattaaagttttaccacttggaagatggtgtctgtactaagcgaaaaattaccctgcagatgggacaagtctggtttttgtgaggatcatatttcagcacctgtactaaacttgcactatatcttgagacaagtaacttacaatttccttgaccccttttgtttaccctggttatttatacagagtcagttgattcttagtaaagctgaattatgttgttatgatgattgattgttgtcctgcagaggctcttgataccagccttcttttccttaaggcaatcttggtttgattatgagctgtgaggctcaagatggaatatgttggcctgttagtgctagggaccaatttgttgcccttatatacaacacctttacgttttgttctgaatagcgtcagagaatttgaactgcagaacattcagtgtgttgcgcttctgcagttgtcttgtgagactctctcttgctaccttgggttggttcacctcgcgccagttattggttcttgtggtcatcgtggtgcccgctggtagcggtggcagacgcccgcgctttccataccaatggagattggagaagacatagcaacgcagcgttgatcagggtgttgaagactcggatgacgatgctgctgcatccgccgccgaagtgcatccactacaacactgtcgtggtagatgagatcatgagattgcactcgagtagagtagccgaaggccggcgccgacccagaatgtaacggctggcgtcggcgagctaggatggagagcacctcagggattacgattttgtgaggagagggaggccatgagacgattgaggattagagcaaaaccaaatcgagaagcctcaccgccgtgactccgtcctgcagcaccgctccgcttcctcgccagttcgcgactgcaacgtaccttggcttagggttctgaatcctcatcccaatgccctcaccgctcagtccactctcttatgtctccacttcggcttcgcggtttgcgtccgatgttgacaagggtggaggccacgacgcctggccggccacgcgagctggatacttgcgtgcccaggaaaaattgactcattatttggggtggccacagcgcgccgagcctcggccgggggtcacttcgccccgctcaaaaacaatatcaattggagcctcgctgggcgggacgatggatcgggcggcggcgctgtcgattccaaaaggaggactacggtaccgcacgcacgcaccaacagttgcttgtaacaaagatcaacatatacgagaactgctatacatacgaggaaacctttttcgcgaacgtgcaaaataattgcacgttaatatattagaagaaaagagttatagttacacgacgcaatcagctagaccagcttatacaagggaagggagaaaaggcaaaataaaaggctgagctaagaaaactacggcggctaaacacaaactccaagcagcgggaaggggccaagctacgctagactcccaataaatccccaaaagtggtaatgccagctaaaaaccacagatggccctccgagtggatggactccagaaccacggagacagaagagagcgcagagtcgaaaaccctagagtttcgttccttccacagctaccaagagaccaagagcaccagggagtcaaagctagcacggagatgctctggtaagcaggccctggaggacggccaccagttctagaaccagttgccactaggggagagagggcagccatccaggaggcgacagcacacggagccagacctgccgagcaaacacacagttgaggatgtggttcgccgtctcaacgtacaatactgctaagtctcttatcttatgcacgtggcaaacatggagcctagcatgtttccatggcccagttatacgcatgccaaaaggcgactgacgaaatcgcatgtgatgataagaaacttgcagattttttaagtagttaagatcacgttttatttgaagtgtacaagtatggaaaaaaagtttaaaactaccaagaagggcattcgcttaacgtcattgactttttaacgcatgtcttttttttcgaacgtttaggccgttatcgacgttagaaggtgactcattctaaggacaaaacgagactaaaccttacagtgcacagttaattaggaaaaatgggacgaaaatcacaactacaacaaactcacaactaaccaacctaaactacaaggccgcaaaagcagaacagctaggttcactaagtaaatgttgttcaccacaagatttgcaaaaagaagcaaccgagaagacaagcaaaggctccctcacatgggcggagacatggcattatcgtcatcacacaggtacccacgcgatcgggcaactccaacttcatcaagaaacgctagggatcaggagagacttgcaaaccaacaagcttgcaactctacaatggagcgaaacatgacagttatactctgacttaagtcatcgttgccaagctcgtaaccgcgtagcagctccgactaccctaaaggacagcatacagaacctcttagaaccgaccatagctttgagtcatcgttaccaagctcgtcaacacgacgcagcagctccgaattcccaaaagccacccatagaagccaaagtggagcatagttgctatgggttagctccaagcacgacacgatagagaaaccaaaaggacgtctccaaggaggaatcgacgcccgctagcgtcgccattcacgcttttgcctaggcctccaccaacctaccactatgaagacaaccaactatcgatgttgcgcccgctctcaagtgtgcaagcaaactttagcattgcagcgtgctgagatgaccttctctcctgcatcatggccacacccaaccaccaggaactggaaccgccatcaccaccaacagagacaccggatgtccggatgtcccagaaccagtggcccatcacccctcgttgctgaccagcaaagcaaaagccctactgccaccgtcttccactggacccctcaatgccattgcctgcggaaccgcgtcgccaccactccgtcgaacgggccggcctgctgcagtcgcgccgtcgtcatcccgagggcattgtcgttgccctgtgagcaggagctgttgttgatgtccgcacgctaggagggggagccctctctaccgccaccaccatccgcttgccggccagtgggaggcccgtcacccacagtcggaaccaagggcacaggccccagatccagcgacttccctaggttgcaccggtgccatccagtggctcgagcggtgacggggcaggaggtggaggagcccgctacctcctattatcactgctgctagccacgccggccatccgacactcgcaggtgcgtcaactgctaccttggccaaaattgacgcggagacgccggatccaaccacgcaccggatctagatgtgacggcactataccagcgccccgcgccttcagcttgtcgtgctcctcaccgtctcccttgcgcaggaggcgagcctcgccaaggtttggccctactaccacaatcccatgctcgccgcctagagaaggcaacgtgctccgacggtggcgaggcggaggatgagggggagtgggtggtggcgggcggctagagtttcgtacatatgcatgatagattaaaatatgtgctaatttatagttgtgttatactagtaataacatatgtgcaaatgggatgtgttgtatgggcacataaaattggatgacctcgaagtgtgaatcgagcctagctaaagaattagatctaaaggttgcgcaacgtgcggatgtgaattagatctaaagaattaatagtactaattaatttcatgctacaccaaacttttctccacgtgtgaacattagtggacttgtggtgatctatgttacactgtgtcatgctcttcttcacggttaattaattcattaactgaacatctaatttgtcaagctggcggtggagatcgacggtttaaaaggagacacttttgttgtccttttgtcttgtggatgtggagaatgcgatgccatttctcgtcggttcatgcatgatacgccgtctttttagtttgtgcgctgggtatctgaagaaaaaaaagaagggatacaacacaatgcactccattcggttcacttcgcttgtaagttagtaattttttttcttcttttttttttggcctatataaacactacgagttcagtctccatttcgctgcagttgaagacttagtttgtagtttgtgcaggatgcagacggagaagaaggagtctgccggcgccgccggcgagaagccgccgagcttctgtgacaggctccagagagctttccacgcccgcccggcgttccggcctctccgccgcctcggcgtccgccacggccaggacgacgacggtggtggtggtgcgcctggaagtacagtagacatgcagcctgcgacgacgacgacgcacggcggcggcccaccgaggccggtgctgccaccggcggcaggccacgctccggcgcccgtcgtgctgccgccggcggtagtgaaaccggctgccaagcctgcgggcggcaacgctccggcgcctgtcgtgttgccgtcggcgccggctgcaaggccgccgccaccgtcgcgtcgccatgggcatgcacatgcgtcgacgaccgggagcgcacctgccgccgagaaggtggcggcaacgacgacgaggccgccaccggggattccggtgcccgtgccgccgccggctgctgctgctgccgctgatgtcaccaccgccgcggcggacgcgaaggagggcgatggtgacaaggagcagcaagggaaggggaagaccagggtgagctccagagtgcgcaaggccttctcctccaagtagagacacatcacaattcacacatccatggccaccgtagtgtgaagcagaagcaacccaataactaactactgaaaaatatgtaccttgaggactttgtgtgaacctaagtactctatccgttattgttttttaacgtatgacatcgctgaattttaatatatgtttgatcatccatcttatttaaaaatattatgtaattattatttctcttattatgacttgataaattaaatgatctttaagtctgacttaaataactttatatttttaaaaagttggaataataagaatggttaatgttttaaaagtacaacgtcatatattagaaaagaaggtagtatatttccataagctttgtaacactgctttatgcaaaatctgtgtgaagcagaagcaacatcgtttttttttgaacttttgcgattgattcatagcaataggtcagattttgttttctttttgcaaaagaagaggtgaaaatttttcatccgtcctaataaaaaataataggtcagcaacggtttgcacgttgctacgtgataactaaaatggactttcaactcctcagtcatatggctggggagattgataatcttccaactaacctgcatgaacgtattataactacaacgatgaaatgcatattaatagaggagaattaaaggtcttttaacttcaatttcacatcagctgagacttccgttttgcccttcaacgatcaaaattcatagaatgatgtggctagataaatgttgattgtgagagcacttcagccagttgcacttccattcactacaacaaaaaccttatatagaggctcttttgtagagacaattttcaaaatgcctttaatcaaaatgcttctaagttttgaagctctatagtttagagacactttttagaggcactttgaaaattgcctaaaatatttttactctagagacactttagagacatttttaggatactttgttaaatttatcttgtagagacatcctttcggcactttaaaatttgcctcatatgtaaaggcattttcttaaggcgttttaaacgatgtaaaggcatttttttttcaaatattaatatatatcaagtaattagatataagtaacacaaatcatatatttatatgtaattaaatgaggttgagatggttagtgtattgaagataaaaaatagtcaattcaagaggtcatgagttcaaggattggtaagggataatatttttcttttttttcatattgatttgctatagttgcctcaacatattaatgcctctacaaagtgcctctatttgcatagagacatcttacaaaatgactcttagtttgtagagacaatacaccaaaaggcacttatgagacactcttcaaaatgtatctataacactgtgaaggcattttataaatgtctctatagtattaggaaaatgtctctacaaggtatatttgttaaaatgtctctacaaggtatatttgttgtagtgattttggacggagctgaaaccatttggtttggttctagcttcacaagaggtaaagctagagttgagactgtgccaaacggacaaaaacctttgaagtaactattaattgggcgttcgttttgtttctcgaaaatcaggcgttgttttactaatcggaaaaaaagtttcatatgctagatcgaaaatgtttcaatctcttaaaatgttggaacacatttgaactacgactgaaacattttgatataacatatgaaacatccaatttcaccctaatagaacaccaacaatccatatcagtcaaggacatggatatgaaacaccatcaaaaccccattgcaatatttcctcaaaaatcgggtattgtttcacctctttgtaagaaaatgtatcagtacttgagaaaaaaaatcagcatttaaaacaatgaaacataaccgaatcacacttcaaacattctgctacagcatataaaacattgatttctaaccattgaaacatcaacaaactctgtgtacatcaacgattaaaatatgaaacattattaaaatatccactgcaatatttgatccaaacacgagtacactagctgaaacacacacaaaaaaaaaactggtttggactgcatctttctcctctccggcgaacacagggttgccgacaactacctctcggtgctcaccttcggtcttagcgggggccgtcagggtcacagaagaagaggacatggccatcaagaaatgtcgcggtgcgccagagatccaaggacgacgagaggaaggggtaggtgaaattgacaacattgcgagcagtggtgggttgttgatggcgcgtatccgatggaggaaggagggctcagtgatgacgcagcgaaagccggtgcaggcggtggcggtgcgggtgaggtcggcggtgaagagaaggcatgcggaatgagcgactgacaaggcactcgatatttcgttaggcatggggtgcccaagcctaatcgttttcgaaaaacttttagaccagcgggaacaaaggggaagtgcaaaggaataagtccactttgactcccttacgtacctagtggttgaatataattcataaccttaaaccgcaataccgaatatctcgacccctcaactattaaaagtggtgtaattttaactcccttggtgattttgaaggcagtttcattgacgtggctcctatgtggcggtgttggcgtgacgcttatataacattagaattaaaaaatacgtgggacccatttatcattcacaaaagaaatattgtgggacccattgacatggggatcccacatgtcagcctctctttctccttcctcctcccccctctctctctcccctttctctccctatccggtcgtctacggtgagagctgaagccccaggtggcaggcggcgggagggtgggcggtggaacggcggcggtagcggtggcggagcaagtcagggaactgcatcggcaggggaagtggtagtccaagcccgccaccggagcatgggccggtggccttggccaccaccttggtaaggttgaactcatgcccgggcaacgtggcagcgtcgtgcgggcgcacaacaacgttgcatggcaaagaagtatggcgcgcccagccatccacgttgtacagtgtgcggacgagaggtaggccaaccacgtagtcgtgttcggcttctccgccaccgccgctgcgggggtggcatggcctagcagtggcgtagggaagcgtttcgtgtcgcatgtgaaggcatgcgcgacaggtgcagtggcgtccacagtgagcgcatgcatctcgtcacaacggagaacgctaacaccccctcc

SEQ ID NO: 7828 - DNA, 19011 bp, Oryza sativa
gacgaacggtcaaacatgtgctaaaaagtcaacggcgtcaaacatttcgaaacggagggagtatacaatagctagctagtaatcttttagatccagtcatgcatacatctgaatcgatttccacggagcttctcagcatgctcatctatctacaacggcgggtcactgtatattgcctgatttctggatctaatgtagtgtcaactaggcaatccgcgttccgtaaaacattttgggcatcgatagaagatcaccatttcattcttctcgacaggtgccttagaaattactagaatccaaagcaggaaaccaattaaccaaagcaggtgatgctaaaggaaaaaccagctcattaattctgaactcaattttatccacagaactattccccacatgtaaaatgtaaaataatgtagtaggggtaattgctaagcaacggatttgaacaaattaataaagtgtgtccaactcctcgaaacagtatgctagtaagttgtatcaacaacggtgagatgatttggcgactttgacgagccgaacgaacggagcaaggtgaaaacgcacgcacctcgtctcgtcgacggggtcctcgcaggcgagggccgcgtggcgccggaggccggatcccgtggtgacggagcaggagcagtactgggggaggctacgaagcgcggggcgccacgccacgccacgccaccggaggggaagacgacgacgcgcacaggagggggaggcggaggcgggggaaacaaatgccgctccgcttctgccctaggccagtaggcccctctccccgtctcccgccgccgccgccgtctcatccatggattttgccgcaaagatctggcaccctctcctctctgggcgccgccggcgaaggcggaggacccaaaccatggccgatgggcggatgtcgctgcgggttcccctggattcgacgagggaacgttgaggcggccggcgcggggtgcagtgcaggcccgccggaattcgagggctgaagcggttgccgttggggtgtcggcttgggcgcgtaacggcggcggtggttgtcgtctcgtcgtcggtgacgcgaatgcggcgcgcgtggtacacgggcaacagggtaggcgtaggcgggcgcgcgccaatgcctcgcgcgtcgcgtcgcgtggcgtggcgtgggaaggcaactttttctctacacatacacattggatggtcgagatgtgatgggggccttcctcttcttcctcctcgactccatcgtcttcctcttccatgcgcacacgcgcacagctaagaaggaaaccgatgcccatgcgcgcgctgtccagcttacacttcccccaaccattcccgctcctcccatcaacgatgcctcgccgctcgcatcagcgaatcatacttgtgccacaagcaatgcgcacactactctgctcaaccggccggtcggacggcgagctccaccaccgcctcgccttcgttagtcatttccaaaatcgtgctcgacaagcaagatatcggcgttaaatacccctcccctccaccgcctctccaaatttcgaacccccccactccctctcgcaaaccaatcccgtacgctccccaccgccgccgagcggagagagagagagaccaatcgaggagtgctcccgcgatcgccatggttagggttatccgatcgctgggcgacgtcaaggctcttcttcgcacgcacggcgacagaatcggcctcaccgtcagcatcaggtgcttgtggcgcatccgccatgccaggaggatgcgcgctctcctccggcagcagatgaagatcgacgggatgcactgggaggtggagggcatagagcacctcaacgctatggttcgtgtccaccgcgtgatcgccaccgccgcccctctcctggaccagatcatctccccctcacgacacgcctcctcgacgccgggacgaagctgcgccgcctgcacctcggcagcgccgccatagaggagatcgtgcatctgcttggggagttgctggaggatgtcgccacggcgatcaccacggagcggcacccgcgccctacgatgatcgattatcttcgccgagccaagttgctggtagaccaggtgtgggatctgaggattccggccagggaattctcacggctttgagtaagccagtctactcctacccttctcatcgtctcgtcctcctcctcctcctcaatctcggtctgtctggtgctactgcgtgattgctacccctcctcccttctcctcctcgtcctcctcctactcaatcttagtctctctggtgccctcctcgtcgtcctcctcctcaatctcagtctctctggtgccctcctcgtcgtcctcctcctcaatctcagtctctctggtgctactgcgtgattgctacctctccggtggccgcggcgattgactacggttgaatatattgatttttgatttctgaattctgaatgagcctacggttgaatatattgatttgtgaattctgaatgagactacgattgaatcttcaattctgaatgagactatacggttgaatatattgatttctgaattctgaatgagactacgattgaatcttcccattatcatgtttttgctacctttcggattcttccttgggggtaacttggtagttgcatgaattcagattttgtcaatcactccaaccatgcatgtcatctcagggttttggaagctgaatttaattgtttttgtgacggaatttgaatttgaatcatacgtattctcagaaactgtaacccattagtatcaacagtgctctacaatctagattgtgaatatgcagtacacaacacataacagagaaaaaaacatatcaacattagtactgtccctaaagaacaaaattcgttgcactcattttgtattgtgcatctatttgcaactatttcatttcaaactccaaaaagacgcaattcttataggcacaccctgtcatgtattttcagtaaaggcagtttccctaaaccagctattccattaattcaagtgtctatgctgatgagcaggccagcttctgaatcccctgaatgattagattcctctcctcatcaagttcatcttcgcctatgaaatgaagtgaaatcagttctatcaaacacatccaaaaaacatttccttacataactggtatgaccttatggtgctttagcgaaaacaatttcggtccttttgaatttgaaccgaagtggaggtaatagcatatcaaacaatcaagcgccgcggctacctttacttgtaggaagattttggagtagcttcagcagttctctgcgattttcgatcaaagcctcgatgatactgcgaggcttgttcggattggcaacaaaaacctgtggtatcacaaagaaaaaagaacccatcaatttttcaatttttcagcatcatcttaactgaactactacattctgatcaatgtaacagaaatttttgaatattcaaactaaacaggccttgttgtgcgtgtttatgtgtcgttttgtttgagtgcacatcaatttatcctatgtgtacttcatgttatgtacctacagaatatgcacacaatcaaatataataccttaaaaacatggaaggcgcatattctgatatttttgcttgaatcctacaaaggctgcaggttagtagtgacatggaagacccccaaaaaaaatcaatggaaattttgactattatgcagaaagtgaacttataaataaatgcgaagatttgttcacttgatggtttcagaagatctgcaacaatttatttaaaataaacatatcttttttatgtacttctatgtatggaaggaggacaaccgctggtgctcttcagataaggggtagaaacttgtgttcaagagtagcaaaatgctcaaacaaaaggatgtaactggcttactaccatagtctgttgttaaatagtttatgaatgaatagtaagaagattataaagaataccttcagtagagtaatcataatatttaagaaacgaacttccgtaatataacgcttcattattcgagcgtttggagcctccaacagaaattccgaaaggaactgagacaagatagatcactttaaatttcatataaattgaatgatgatcaaagaacggctgaacgtagtctaaccttcactgattgtcttcttgttacataattaggtgatgttaagagccttgtgtagagttcaaagaactgtacaagattatacaatcagaaagacacagaacaaatggaatatctcaacttctcaagtatgttagtaatacgattcaggttttcgcaaagttggaaaacagattttgtaggtcatttggcaaacaacagttggcatgcaatgcaatcgttttgatccactggaatatcaataatatatatattaaaaaactcacaagaaaattttgttgttttatttttctgtcatgaaaatagagtatatttcagaccacctgctcgtagtgggaactcaagaactcagcaacaactgtttcatgtttggtaagcagatcctgcaaccatcttgtcaagaacaaccatcaatcttgattcttcgacctccaatataattctttagtttctatacttgtaaatctgaaaatttggattaaccttgaaggtgttcagagcatcagaagcaatatcgaagtttggcagctccacatactcaaaaaacagttcgaagctactggaatccaatatgtatctgaaagtgggcgacaaagtcaaattcatgcaaattaataaaatgattattatgattattaattctttctaatccaggtaattcttattaattctttctacttcaggtaattctgtactgttgatctgttatactacatactctgtgcgcgtggtaaggatgtgcccatttttttatatataataattaacaacctattaattaaatatctagtaaatgatagagggaaattttaattgtaggatggacgctaagcgctatagcgtccaggaatggacgctcttcgtaacaatgtccagacctggacgctgtattgaacgacgtccagcatcccgtcagcctcgttcaacattcggttattatcatttgaagaaaatcaaaaaggggaaaataaatcgaaaataaatcgagaagagaatccgtctcgtctcgaccctctcagcggtggcgcggcgcctcttgtccgctgccgctgccctcctccaatccagtggcggaacctgctctcatcgcctccgccgtccgcttccaccccagatagctgctgtgcgtcgccgcaggcggcgtaccgctgtcatttgcctccttgcgccggaggccgccgccaccagtgaccgctcgacagcgacatcctctatgcggaccctagtcaggttttttgtgtggtcgattgtttcagcaataagattgtttcatcctgatagatttactattgttgtttgtggtgccatggttctgttgagatctgaaaaggcataaaatcctttccaagtgcaccttaatctcacttattgaagttaatcctgacatcctgttcatactactctttgccaagatgcaggtgacatcatgcatttttcctgccttctgatattcgtttgttgatggactgatctccaatatgctggtcactaatttctgtagagcacagaaataagctctatcatactgaattttgatatcaggattattacatgaaacacatcccatttctagctgcagaggaacatgagggattcagacctaaggtgttctcgaaggttcattaattcatgccttttgtattgagtatatatattaacctgaccatcacattactaaaatgtttgattggatctggttcctagtgtctttcaaagtccttatatatgtgctagtcctacaacagcagtccatacagtcgatactacttccatgcataaatggaactgatgatatattcagttttataattatactcgactcttatgctatatacttccttttcatatgtacaacatggaagatgaatctaatagtaatgttactaacttttgtgaaatgtctagcacgggaaagcgtttatgaaaatacaaactaccagaggtgcatgactactaattatctcagtgatttgttatatggatgcctcatggtcagcacgcaaagtataaagatttcagaatacgagaaatgtttttagtctacctatttcttcaacttctttttgccctcagttttttgcatttaaacgtcaagttctccaaaattatcaatacaatgaagtatttgactattgggtatactcaggattgcagtatagagcatggagataggagtgcccacacagaagatagcggaggccaagctagtgactcaacaaaacaaacagtaactctgtgagaatcagctagctgccttacttcatcttggtaaaactaacattttcgtttgatttacgttttcgggaagttcaacacaagtagttgagtgccaagaaaagtttcaagaagcacagtgcaactagcttatatatttaagtgagcttttttagattgtggatgtttcttcgtatgtataagaacttatctagtgtccggatatatacttggtttgaatcgttttgtttgcctggttgatgcaagaacgcattgtatctatccagattgtttgtcctgtctttgtaattgacacagttggctagattattgaaatatatgagtataatttatctagaaccatattacgttgatacgatgtgcagcgctattaaaatgaatcgacatacctatatataactacaaattgattgatccaacaacaagctatatatctgttttagaggcagccggaccagataaagaaaaagctaacgcatgcgtgggcacttcaaaggcagtgatagcatataattaagtaattaaacatgctcaatcgccaacaaagtgatcgagctaacgttgcttaggacaacacgaaggctcgctagcaggagatgtcaacaagcacttgcagtggccggcgtggtaaggcacattgggtcgcaccagactgtggacgctgttaggaagtgcgtcccgagctggacgtgtattctaacagcgtccacacctggacgctgatgacaatagcatccttactactttggtaaatccctacagataattactacttatttaatttgtgaaggattagttcttataaataaaaaaatcggaaggatgtgagcgtgcaaagcttctttgaaacgttaagtggtgacagacttataattctggtgaagaaacattagcctaccaatataataatactattgaagaaacaaagacatgtctagtaacataaatattatataacaaattaacaatgcataaggtgcaacagtggttttttagtagcaggcacaaacataggaaatcactttcatgatgttagaattctgtttttcatgattactgccattaaataataagccatttttatgtttcattgtcatttaaaaccagagagttcgtagcaaacgaaagaaaaatcaacagttcaagcacttgttcatttaatatcataccttagacatttatataggattaaccacatatcatgtaaaataaaggcaggcacgataatgttagtaaaattgcaagacagaataatgtcccaactgaatggaaactttaaacccttactttgtaagtgttgggtattttatgcattctctcaacatgttcccgcaattcagtgcaacgtccaagttcttgtagctgtcacaagagttgatcaattataattatccttcaaaagatacactgtaggcagaaaatgaccaagaaaccacaagctaggctccaaagtgcaggacactttgaatgtacgctatggctaaagcaataaccaacaattacaaaagtttataaaggagaaaatgtgacaactgactgactaaaggccgtgagtagtcaatatcctgtaaatatctgaacgatcatgttattactacagaattgtactagaagttcgaaagattatctgtgatattaagtcaagaaattgatgtgttaccagccaactaggaaatctaaaagctccagatggttctcaatgtacttcacacagcagtagctctcatcaaacttctgcctgagcaaaatgcaccagcagtgaaccagatcttttcgtacctgcaattcagagctaacgatttcaacaggctggttaaatggagaatgcaaacagattttaagtgataaaacacttactccccaaccaagcgaaggcagattctgaacaaagagggaaaggacatcctccttgcaaatctcaagggttatttgcaagacttgttcttgatttggttctgcttctccatcaccagacagcatttgcctcaatgacgagaggtttttctcaacctcttctagagcctaatgttaaaaaagtgaatcaggatgcattcggaatttcaaactatgtacagcagtacaagaaatcttcacaatagagtgaacaaacatgatgaacaatatcatgacatgactgagcacagcaaaccttacaatcatcctgatctaaaattcactggtttctggaccattgaacaatctaccgaaataatacacaattacacattctgccacaaccacaagacttaaaaaaaaagcacaaaaaaggaactcgtactattatcaccaggtttgctgaaacctttggttcgagaattacaatgaataacgctgcatctccccacttaaacatatactgacatgcccagagataatctcgccaacaataggccgcaatgagcaatctcaccgctaaaaggctcaggtgcccctcaattacgaagaaatgatcctcacgccgaggaaagaaaagtctttaccatccgaccaacgggcagcaagatcgccggttttgatctacctccagctgcatgcgtgatgaagggggctaatccgggatcgggcacgcacggatcccctgccttgatcgtcggacgcggcggcgagcggcgggccaagaagagaagaggaaaaacagaggagaagagaggagaggagaagggggatttttaccctggcgccgttcttggtgtggagggcctggaaggagtccttgatggagcggaccacctcctccggcgtcgacggccgcagccgcgacgccatgcggaagaagaaggacatcgccctcgccctcgccggccggggggggcgacggaacggaacggaacggaacggaattacggtgttgctatgctatcgcgggtcagagaggcggctgcgatggccctttcttattggcaaggcaacccccgcccagggccgttttgcctttaaccccctcttatttaacttttttgcttcttttttccctttttatttttatttttggtttctcttctcttcctttcgatgatgttttttacccattgttttgtttattcaaatgcttatccgaatcgcttattagcaaataaaagatcattcgtgaggaaaacttttatatatgtattcttaacgactcaaatgaaaatgatgtcaaataaactacaatgaaaaaaaatcaaattcaaactttaagttctaaagtttaaattttgacttataaatataagcataagtcatgctccagcataacataggtgcatatccttaatgatgtcttggttcaatgagaattactacacaacttcatgtgtacaaatagtcaaagaaaattgtgaacatcagcatccaaaccggatttacagaagaagaaaaaaaagcaacagcagtaggagtgcacatattatggtttcgacaaatatgaccatatattcaacattcgtctaaaccacaatacatggttgaatatatggtcctattcatcgaaaccataatatatggttgaatatatggtcctataatagccgaaagagggccaacgggcaataggttcatgccatattgcctttacggtaaagctcttctatatcgatgcatctgatatgcggtggcggagctagaaattattgaagcctaagactaagctatggcttaattgataggttgttgattttctcctaaatttacttgtgatctaaatggatctaaacttaattttggagataagactatggcttaagccatagtagctactctagacttgcctttgcccccgttgacatgcaaaagaacatgtgatctccaacttttgtttttcttgttttccttgcattttttttatcttagcttctcctagaattgataggttgagtaacctagtcatgtagttatgtttgtttgcatggctagtttctgctcactcctagaccaccataagttattgagtaaatttcacaaaattacagatatgttgaccaaattatcacaaaactaaatatttaaatcggcgtatcataaaactatagatttagcaacaaaattatcgtaaaattatagatttaaaaagtatcagaaaactatagatttgataacaaaattatcataaaactacaggtttggcgctaatttaattaccaaactacaatatttgtagcttcaacatagcaatagtgctaaagatttaaaatacaaaatctgttgttttgtgatgactctcattctattcttaaatctatagttttttgataaatttaatactaaatttgtagtgtgtaatactatgtcttaataaatctatagttttacaatagcctgttcaaagtgtgtgtagttttgttaaattcactccaaatatttgtgttgcttcatttttttttatggcttatcagctgtagattaaacaatcatatcaacgtgaccatattctaaaggcaaattttgctataggacatcgtggcttcgcggtttcagccgtaggatactgcacgaagtgacttttggggaaagacgctatgtaaagatgggaattagcttgtggacaccgcgcccattagaatattcatttttaattgaataggagaaagaaaccgcatgaaaatcctaaaatacccctggtcccaaatgacatatcttccatctctctctgtttacctctctcgcacagaagcgtctcgacgagcacgttgtactgtcgggaggtctgccgcgtgcacaagggcgggaggaggcagagcaccttgaccgcctagtccatgaaactcaaaatcacactacctgcatgggcaactgtggcctcataaacactcgaaccaaatgcatgatccacagtccccaattcgacaaccccaaagcgacattcccaagaaacgacttacatgaagcatagttattagaacccgaccggaccggcggtccgaccgggaaaaaccggaaccagggcgccggccagtccggttcagataaaagatcggcacgcaatcaaaccggcgataaaccggttgaaccgggcggtttactgcagaaccggtgaaaaacaggggtggttcgaccgctcgaacggcgtcacacgtggaggtggcgacgctgcagagtactggcgtcacgtgaattagataaactaggtaaaaaggtggcgacgctgcagagtactggcgtcacgtgaattagagaaactaggtaaaaaggtggcgacgctgcagagtacaggcgtcacgtgaattagagaaactaggtaaaaaggttgcagagcttgtgagtagaacccacaacctccatgcttctaccgagaatctctaccaccaggctatgtgatgggttgtgaaacaaccataacacacatctatttgaacctctttaaaccggcggtttgaccggtccaaccaataaaccagtgacccgactgccttaacggttcgatcatcggtccggtcttaataactatgacatgaagacgacccatccgatgacggagacaacgaggatcaccgagaagaacttgtctggcgacgacactatcgccgccttgccagggagagagctcgacgggatccatggtcaacccgcccgaatccaggccatcgccatggatggccccccacccaaccaccaccaccgacgcagccaacgggatcgagacccctgtctagctcactccctcgaggcggccgcaggagcgatctctcgccaggagtcgcgtcgggaggaggagggatgccacactgcactatgggcaccctttagtgcgagagatacaaatagagagatgaaagagctgacatgtgggctcaggggtattttagtactttcacgcaatttctctctcctatccagccaaaatgaatattctaatgcacgcggtgtccacaagctaattttcagagtgctttcccccaaaactcacttcgtgcggtgtcctacagttaaaaccataaagtcgtgatgtcctgtagcaaaatttgcatagtctaaattcaccggtaactatattcagctcaattactcattttgtgtattctgtgtttgcaatttgcattaacaaaatctgagtataccatattatagtacaattagtatagtacatacatttgtcagagtaagtcggttccttcccccacctagctcccagtattcacactaatcctcacaaaattaattacaacattgtgtcctatacaagataaaccaaagagatcatgaagcaattcgcacgttcatatcctcatcgatttttgcttaatttcccaatcgagaccccccaaaacagcagctagcagcacagatcatagcacccattgctgattgcacattaatttcttctccttttcctttgaagaaaaatcaatttcttcatcatgttcttgccaacttctttctttttttttaaaaaaaatcttttaagcttctgcaagaacaaagtaggagattgatcagtttagcttgtgcatggctcgatgctgctgctgctcactcctcgagcaccggcgacgatggccggaagaggtcgtacggcgcccagaggtagtcgacggcgcacgggcgccgcgcgtcgagccggatccatggcttccccttgccgctccaatggaggaggctgatgggccccgggtggaggccacggcaccgccccttgacgttgtcgccgccgaggccgtgctggttccagcggtggtcgacggcctggatgtcaccggcgagaacgaggaggaacggcggcagcgagccgaggtggtagatccgcgtctgcttctgcacctccatccaccgctcgacgcggcgggtgtagccgccggcgcgccacttgccgacgtccatgaccatgacgccggtgttgaagtagcacgggcggcggccggcgaacgtgccgttgagcgccgggtccgaccagaacgcgtcggtgaagtagttggtgaagttggcgtggcagtactcgggcgcgccgacgacgtggccgccgaggtcgacggacgccagcgcgcggatgtcgtcgacgaccaccacgtcggagtcgaggtagatgacgcggcgcacgtcgggcgggagcgtgtcggcgaggtagatgcgcgcgtagttgagcggctggtcgagcgcgtggcggatggagcgggagatgcggccgcggacgcgggacgggtcgaagcggtacacgcggaggtccaggtacgggaacgtggcgcgcaccgccgccgcgaggtcggcgtccatcccggccgcgaggaagtggaacgacacgctctccgggcacgccgtgtgctgcaggatggacagcacgccggccatggtgccccggaggtagttggcgtccagcgtcatggccacgtccaccctccccccgccgccgcactcctcgccgttgcggaacgcgggggcctcccggaagctcgggatggacgacgacggccgccggatcaccatcccggagtgctccacccggatgcgcgcggccgcgtgcccgccgagcaggacgagcagcgccgcgacggcggcgatggcgctcccgcagcgcgccatggtggcggtgcccgcggccgttgctacgacgaccgcgcggcgggcgggggtggagagagcgaattggacaaggaccggtgggtggccgagtggtggtggtggtggtgggggcacgacgacgtcttcgtcgccggcgagccggcggcgaggggggaccgcggcggggggaggaggagaggtggccaccctggtccttgggcaacgttggggtcggtgctctaggcgacgaggggggccaccattggagatggtggggaaaggatcaaaggaaggcggagcggtggaagagagaggaatagggttggcagcagcaatggcgggtacgtacgtgcatgcgcggtggagggacgggagggaaggtaggagaagacgacgacgacaacaacaacaaacaggtgcatggctgccctgcccattcttggttcaccaatttcctccatttttttttttgttagctgcttgtgttttttttctttttcatggaagctatacttgtgttacaagtgtgttataagttatcccgcaaaaaatacggaatacaagaatttcatataaatcggtataattgccatatggttccgccggtttttaatgtctaacgctgttgacttttaatgtatatttgtttacttgttttatttaaaaaatatagttatcactttttttttgtggtttgttctattattataagtgctttaggcatgacttttttttacatacttgtaataaaaaataattagtttacatgaatgatgaaacgcatgtctaaacgtcatatattaaaccggatgaggtaattcggaaaaaatattttattccatatgagatttaagataatgtaaattgatggctatgcaatgccaaattgctctattcaacaacaaggctgtctgggaagaggacgaagattagttgcgttttacactttagagagacttcttcaatgattcgatcttttttttttgtaggtttgtgctctgcgtctttaatatgaggcggcttcgctacgggaggggctccacctggatgcctgcagccacagagcaccagcgttgagcttgcttgcgtggcaaattcagttgcattgtcatacatcacaaaaaggtttagtatgaatcatgaacagttgatctagtctaatttaattcttatatatacacagatgttcctaccatttccaaattactttggacatgaagacaacgaagaactaacaaacgaacagcgacgtatcaacagtcctacgaaaacagataggggagcagaaaactgtgccatcaactaaccatggccgtcgatcagatatcagatgtcgaatttgtttcttgctcctaacaacaaaaccatgttgctcctaacaacaatgaatgaacatagctggaataaccagtatcgtcttgtgtttaatatagttgaaaacaatttgctaactttgttactaaccactaccagattaacataagtattattgaaacgagttaaaactaaattcatacttaaacatttggacaaacatgtacgtaccttcacgatcttgcagcatacgtttcttcaattcctttcccttcattgtttgcacactggtgtggcctccaaacgtggaggagattaacataacgcaaaagagaatcttaaaaaagataccggggcgcctataaatcggacgtccgatttttgtaataaaaattaggcgctattccaccaagtagatcggaattgtttaactaagtagatcaaaaatgtttcaatcatttaaaaaactgaaacacatcctggaacattttgttacaacgtatgaaataaacagtttccaaaaatcgggtgttgtttcaccatatataaaaacaatgtttcagcaaatagcgaaatgatgtttcaattcactacaacatttgatctatacatagtgaaacatcacgagtacacttattgaaactttgttggtggaacaaaaattaaaacgaattccctgagcttttccataatatgtaggtaatttattgcaacagcgcatgtggtggggacggtgcggaggttcgggaggcacgggaaggggcgtccgatccccagcattttcgaaaagatattggtgtaagagcaattcgagaattaaaaaagatattggtgtaagagtaattctcaattatccaatctctgctcattttagtatcttctgttcatatatctgaaagaagaatttctgcaaatcctgttcgttctatgtttctgtttgtcaaaaaaaccgacctttatggacaaccgataggaacaatatttcagtttggtccgaatcatagggaatgtacgtgtgtgctttactaattcaagttattataagcctcaatttaagaaatgagcttaggacatgtaacttctatagtcctagacagcgttgcaacgcacggacatcttgctaatatatagtgaattcatgcaatttgattgatttttgttcatgaagagtaaataaataattaatagctatgagaagacatccttgaaataacaaatccattttctggtgccttttctgccgctacttaattccttcccagctagctggtcatgatcatcatctgcgatctcgatcgaccattagttacagcagtgcatggaacgcaagaagaacaccgccgcagaatgcaaaaatcgctgccgttgcgtctttacccctgcagttgagcagcaaattaattaagcacgcgatataaatataatcaataaatttcaacagaagaagagctcatagtatatcatgcagcgtctcgatcgattaattacgtggaagcctccttaaggtctgagataatctgatcgatgcctctccgtgaaacgtaaaaccgtccaagttctcttggccgtttaatcagaactgttccgcgatctttgtaagcctgtccgatcgaaaagaatgcattaattaaggtccattatttaatcacaataatatatggttattactacctctatcctaaaataacagtagtagtgagaatccatgtccaatgtttaaccgtccatcttatttaaaaaatttatgaaattttttttaaaaaaatagtcacacaaaaagtactagtcatgttttgtcatgtattaacaatgcaaatactaatcataaatttttttaaataatgaatagtataaaactagactttttttgggacgaaggggagtagcaaacagaaatttcacaagatctgtcaacaaatttcgctccaactgatgaacgaaaattgacggattacctcaccaacaacagtaaatgttgtgccggttggaagaacccgctcagttcgctccaatccaactacctgtagaatcaagaactcatcatcatgaagataaattatttctctcttttttgacaaaaaatattaaattttgatcgatccaagtgtcagcagaagtactccctccgtaaaaaaaaacaacctaggaggaaatgtgatccattctagtacaacgaatctgaaaatgtgtcacatctatttctaggttggttttttttttttggaacggagggagtagttaaggtttagtagttaacctttaccgaaccttcttgtccacagacttggcacctactgcataattgtttgttctcctcaaagacgctgctctcacgattcagagtaaaaccagttgccttatgtgcttcaacaacatgcaaacgcccggtagcatcttcctagtaaaagagttagatatggtgtaacagaatgcctgaaaattaatttacctgatgacagttttatacatgtagaacatgatgctacatattctactccctccgggctgataatattagtcgttttggacaagggtaaaatcaaactttaaaatatttgactgcaaataatttctaaaatatttatcttaaaaatataaaaaccatatgtgtagatttgccttaaaatgtacttcaataaaaccatatatttgttgatattttcatatatattataatagaaaatagttgtcaaagttacttttgggagaccgcactggtggagaaaccatctttcgttgatcggccgatttccacaatagtcccggatgcaataaaaaccggggctaaagatgatctttagtcccggttcaaaagggtaacgggcatatttgatctttagtcccggttggtaacaactaaagatcatctttaatctcggttcgaatgctgtcagggcatgtcaggcccccccgggattaccaaccgggactaaaaatcgtaactttagtcccggttggtaataccaaccggggctaaagatccttgtgatctttagccccggttggtgctaccaactgggactaaagtcccacccctatatatatgtcttcttcctcctccagctgcccgagcaagcttcaaaatttcttcaaaaaagaggggaggtcatgccaaaatttatattgaatttattttggtgattacatacaaatcggaggtgcctaaaatgtttgcaacttcatcctccaatgttttattttgtcatactatatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtatggttttttttgactcatgtagatggatcggcaatggatgtacactgaccggcggtccaaagagtttattgacggcgtgcactattttttgagagtggccgaagctaacaggcaaaggggttttatttgttatccatgcaataattgtaagaatcagaaggagtattctacatccaggactattcatttccacttgttgagtcggggttcatgccaagctataattgttggacatcccacggagagcaagatgttgaaatggaagaagatgaagtggaagacgacaatattccggaatttg

SEQ ID NO: 7829 - DNA, 3699 bp, Oryza sativa
tgatcttggtgagatgttgtagcacgccagggaggactgcgaaagtgaaaaggaggcccataaattggacaagatgttggaggaccacagaacttcgttgtacccaggttgcgagcaggggcacaaaaagttggataccactttggagttcttgcaatggaaggcaaaaaatggggttagtgacaaggcatttggcgatttattgaaactcgtcaagaacattcttccggggggaaacaaattgcccgagacaacgtacgaggctaagaaaatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgacgagcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacatcccaccgatggttcgcagtggcaaaacatcgacagaaaatttaaagaatttgaaaaggatgcacgaaacatacggtttggtttgagtacggatggcatgaatcattttggagagatgagcagcggccatagcacttggcccattacgatgtgtatctacaacctcccccctggctatgcatgaagaggaagtacataatgatgccgattattattcaaggccccaagcaacctggtaacgacatcgatgtgtacctaagaccattggtcgaagatcttaaacagttgtggaagaaggaaggtgtccctgtgtgggacgaagacaaacaggaggagtttaacctacgagcgctgctattcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtatgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacacaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacattcttagcaaggcagagaaggaaagtatgtttgaatgcttggaaagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaataataacaaagctatgtgcattcatgaatgcaatttcgcagaaggtcatcgatccagatagattagaagcccttcagaatgaagtggtgcaatgtctcgtcagttttgagttaatatttccaccttcatttttcaatataatgacgcatctgctttgtcaccttgtgaaagagatccgtattctcgggcctgtgtacctacacaacatgtttcctttcgagaggtacatgggcgttctgaagaagtatgttcgtaaccgtgctcgtccagaggcaagcatcgccaacggttatggaacagaggaggtcatcgaattttgcatagaatttatcgaagaccttcgcccaattggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgtgccaggaacatcggtaagtccgatgcatggattacacgacatcacattgatactttccccacgtggctacgacaacatctcataggtaacgagtcgatcaaccaacaacttgccttcctagcgaggggaccgtctgggtcgatcgcgacattccagggatatgagatcaatgggtacacattctacacgagagcccaagacataaagagcatgaaccaaaacagcgttgtttgtgtcgatgccatgggacacgatggaacaactgccacgtattacggtgccatcgaggatatatgggaacttgactatggtcctctcaaggttcctctgttccggtgccaatgggttaggttgactggtgaaggcgtaatgattgatgatagtggtatgacaactgttgaccttaacaaggttggatactcggacgaaccttttgtccttgctaatgatgtaacgcaagtctttttcatgaaggacatgtctagcaaaggaaagaagggcagagggcctgacgagcctaagcgtcaagtggttctcccaggcaaaagaaaaatcgtcggagttgagtacaagactgacgaggattacgatcagttggataggcaaccccctttcacggtgacgattgaccctagcatcctcctatcaaatgaagacaccccttactcacgcagcgatcacaaggagggaacaatggtgaggagaaagtacgtgcggtcaaccgtcaccgccgatgtaatgctgtaattattgtgtacacgatgtaaactattttggatgtattgattatccatataaatcaattgatgtatggcataatttactatcattcatatgctacatttaattgactatcattcatatgctaattataattgactagagaatttttaaaagtattaagtcattcatgtggcatttacagatgttaattagagtttttcacaatttaatttactatctttcatatgctacttatatatgactagtcgaatttttaaaaggtttaaatcatgcatgtggcatttacatatgttaattagagtttttaacatttaatttaatataattcctacgctaagtatatatgatgattacaatttttattaattttaaatcatgcagtatgtatatacatatcttaattagagtttttaccaatttaataatatcattcatatgctaagtatatatgattattggaatttttattaattttaagtcatatatttgcttattacgatttatctacttaatttattacagacaaaaataatttttcgaagtaattgtcattaatctttgtacctttaataatgttaatgcattaacttctattttagaaacacatatataagcaaaaataatatgcagtgctataatctttagtcccagttcttatccctaaccgggtttaaaaagaatttggaaatagcaagaaaagatctttactcccggttgatgaga

SEQ ID NO: 7830 - DNA, 9212 bp, Oryza sativa
gaaaatttttaaacgtgaacgagaacgacaatgaacgtgaacgagaacgaacgtgaatgagaacgagcgaacgaacgtgaacgagctagggaacatgaacgagcgaacgaacgtgaacgtgaaatgcaatatatatatgttacttcgcatttatcctaatacatattttttgtatcttgtagaaaagacgtgttgtcggagtcgtccctcaagccggagtggaagagctagccctagaagtaattcgtgcagacaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgagtacggaattggtgcgactcctagcaattgactattgtagtcttaattagacttagcatatacgcacgaaacacttagcatacatggctattttagtcttagcatgtaatattatttgagttttaatataagattattttatttgtaattagacttactatataattattgactacggaattggtgcgactcctagcaattgacaattttagtcttaattagacttagcatatacgacagttacacttagcatgcatgactctttcagtcttagcatgtaatattatttgagttttaatataagattactttatttgtaattagacttagtatgtaattattgactacggaattggtgcgactcctagcaattgactattgtagtcttaattagacttagcatatacgcacgaaacacttagcatatagatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccagccgaagccgccaagaactatgtacgtcacagcggttgggttgtgcgggataacgtgcctgtcagtacggtgtactggcgaagaacaagggcacgcggagatcatgagagctttgtcccatattcggagaaagagatgctgtggaccacaatgctcgagacattcacccttcctgctggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgcatataagacaggtgaacaagggcaggcgatgatggaaagaaacaaagaaaatgccgtcaaaaagaagtaccatcaccacttggggtcaggaggctatagcgtcgcgatgccgaagtgggaggagatggaggctagcttgattgagaggggtatcgaaccggcaaccgccaattggccggaacgatcgaagttttggtactatgctcacagtggaacgctcaacccagctgatggctcactggtcttcggcgatcagatacgagaggctgcgcgacgactaacagatgcagtggaagcctcctctcagggcacgttccgaccggacagagatagggacgagctgacactcgccctgcagactccagagcatccaggacgaacacgagggaaaggggtgattccttggaagattggtttcaaggaggacatctacacgtacaggagtcggatgaggagcaagaaagataccgaggcgaagattgcagatctagagttccgggtatcgagctacgaactcagaatgcaagaggaggtggcaaggaaggttgatgaacgcatggccgcacatcggtcccatgatccccagccgaccattcctcttgcaatggtgagcccgtcaggaaaacgtagcagttgcgcctcaacggggcaggtaggatcacagagcatggacgccatgcaaacacaggacgaatcgacctgttccgttgatgacatcactcagcggacaccatatgagctgcatattccttacaagaacttatcaataaaggtaagctcgtagtttatatattttagatttagcaattccgctagttgctgcttatatatgttgattactaataaataatctctcacaacatgaaggtggcgtcgggcatggccatcccaacggacccttcaggtacttaccactgcaggcagattccagcaggatactcgaaggtcgaagttgagttggtcgaaggcgcgtacaaggacctcgagctggattaccctggaggagacagtgagacgcatctacgagacacaagccatgccattattctatggcgcaggtggtacatcatcctccctgggcgaaaagcggcgtctcgtgcaccatctcctcctcaggatcctgcaccgtctcctcctcatgctctgccagcaccgtctccacctcaggctccagaactaactcctcctcaggatcctgcaccgactcctcctcgggctcctacacctactcctccgcaagctcctctttcggcaccttcaaagtcaagggcatccccagctccaccgcctacccacacaagggcaacgaagaaggcgaaagttgacgccgccaagaacaaggacccggggtacgattgcacgcaagaggagcttgacgcttacattgcatcagaagtcaagagacaattcaagcctcgaagtctagaaaagaagattcctatagaccccagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagattgagccgttggtgaccggggaagacatgacgatagaagaatttattattgacaccggtctaactacggatcaattgctaggagttgaaccaatagaaaaggcggaattgaaatacatgtacgaactcggtaaaccgcttgtcaagcccgagctggtgcagtccctacccacacaaatgtacaagttacatcagctgtacatggagatgagcgccaccggtagagagatgatcggagcgaggatcagggacccggacttcttgcaaggagatgatattctctggatcaatttcaagggaatctacgaagtataccagctggacgccctcgacgtctctattatgagttgctggattttgtaagtatatcattcagttatatttcttaattactacgtctcctttaattaattaggtccttgtatataagtaaactatataaaataaaatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcaacattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtatgacaaggttttcgaacttatagacaggtactagtataagttcctctgttaattaagaaattcttgttatgttaattatttctactacgaatcatatctttacactccatgtagggcttggtatcggttccgtcatttggtccgcggcaactggagagaaagacttaggcgtaggttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattatgtaacgatttcttgtttaattactaatcaatttcatacattcatatagtttattcgcatgagggataacctgaccacacacaaggaatttatcacggcggttcaagaacaactcatgggattcatcaacgaagaaatccttgatcccaatggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatgtatatgtatacatatatatatgtatatgtatacatatatatatgtatatgtatacatatatatatgtatatgtatacatatatatatatgtatatgtatacatatatatatatatatatgtatacatatatatatatatatatatatacatatatatatatatatatgtatacatatatatatatatatgtatgtatacatatatatagatatatgtatacatatatacatatatatgtatatatacatatatatatatatatatatatatgatatatatgtatacatatatatgtatatatatatatgtatttacatatatatatgcatggtttatatatatatatataaaccatgtagcaacagggccatgcaaaaaaaaaaggtcaactcgatctttagtcccggttggtagggactaaagatggctcagccggccacgtggctgagccaaagatcgatctttagtcccggttatttcacccgggactaaagataaaccgggactaaaggggggttacaaaccgggactacaaagggtttctctaccagtgccgtgtccttgtccaaaacgacaagtattatcaacccggagagagtaattaactactcctctatctcaatataagtgtaacttaatacagaagtggcatattctaataacggtctagatagatttatagtactaagatatatatccgtactatattgtacttatattgaaatggaaagaatagaatgtaagtttgagcagactataaaaaaagcaaggcataaaccacagctacagcatatagggtaaattcaatgtgattgttccgtctacaattgattttaagccgtaacacttgtaactgaacaaaagtaattgcggttaaattttttatatatgtgttcttagttacttaaagccaatgctaaaaagtaaattacaacaaaattaaaaacatcaaaatcaactcgtatttacatttaagattttggttgttataagttatatagagcatgcagtaaaatatgtagtagtagtggtgaattaccaagtaccaaagaacctcgtttttggtagaagaaaccacattggtgccatgaacccactgttcaacatctatgtccctcaccctcttggtcggtctatgttcggtgccaacctttacccttgtcctctttacgaccaagtattcatcgccgtccgtcgcctttgtcctccttaacaccaagaattcctcaccatccttctcgttgatctttgtctttgctgacttcgttacatgctttgtcttgcaatgttgtcgtacctatgaaagatatgatattaccgtgttaattagtaaccaagaaaatacttaaaggacattgtcttgtaattgctcagactgttgtttggagtgtgtaacattttccctctaaggtttgtcattgacggttgatgagatgaattggttgatttatgtgaacaaccggtggttcaccacttgaattgacaaaagtactgggtactgccagctcaaaaactggtatattgcttatgccagtgatgttacttttgaatagctgttagcaatattggtttttttagcagtgttatagctggtgaaatatttattctagtactattttacaaatatgatattagtagttaattacttgttgctcagctatcacagcctgacaaccgctttggctagcgacgattcgtgtctctgatccaacttgtccacgtagggttactagtggcaaggctccttctgagtccagggccgcagctgtcaaaaggcatacacgtttctttaggagatttttggtcagctaagatattagcgtgcaatgcatcaaacgagcaaatcaaaagtgatttccgcaaattaattagtacatccattttaatatacgatacaattcatgttttaaagtttatttgactattcgtcttttctagagaaaatatttatgtaaatagaaaaatattccagacatgcttggatgagtggctctcttttttactttaatagcatagtaattaaataaatattatatatatatatatatatatatatatatatatatatatatatatattaattataagtattcattttggttaagtggttaacttttgaatacacatttgattatgccatattatttaaaaattttatatgtaaattaaatatacaaaatataaattaagtttaaaatgtcattagggataaatgaaatcataataaaataaatcataactatagattaaacatgtgtttaaaaattaaccgcattatctatgaaaataaaccagtaataaggttatactatacttacacaggtcggagatgcgggtgaacctgcgcgccatacgcagctcggtcgcgcccctgcatccattagtcaccattagccaccattaggcaaagagaattaaggacgagaaacaacaataagtagtattaattaataattcgattaatcgagtcagggcgagacggacacgaagtagaaggccgcggcggcgcagcagcacgcgatgccgctcagcaggcagccaaccccgccgccgccgccgcagtcgcactcgccgccggcggtggcggtggcggtggcggcggcggcggcggctgcggcggccgtcgtcacttgttgcatgctgtcctccatatcgatctcgatcgctttgctagcgtagctgcaggtacgttgcgcgcttaatccggaggaacaagacgatattaattacctctgtcttcgatggcggaggttataattactgatcaaccaaatgcttctcctacaagaaattataagtatatatatgtgacctgatatgatacgtatgggaaatacgcaaggtaatctgttatcttaattagctctatatatctacctatggccggtttgtgcggcgtgcttaattagaggcatcaccaagggatgtacgccagtttatagtttgttagcgtgcgactgcaggactgtctcaagactaactaaagccgatatcttcatgtgtttcacgttataagagctaagtctactactagctccaatttatctatagccaatctaatagccaatttaatatatggtcccacgtgtcatacacacagtgtatcttggagtccgtgctgcagctgctacatatctgtagcctgatgttcttctctctcatcgtttatcttattaaaatatatttatagctggctaatagtctgctattatacctgctctaagatattttccgtttcagtaaagtacacgtcccttgtctaaatttactcgtttgtgtcaattaggtccctgaactcttaaaaattttattttcgaataattgaactggttaaagtatgttattcgatctcaaattgtcacgacacctctggaatcccatgtaggagtaacatgacatgccatatataaatattccgatcgcagattttattctttcttttcttttccttttttttttgccatatgaataagaaaggaagaaaagaagaaaaatggagaaaagaaagagttaacacccgtgggacatgccacgtcaacatcacgtaggatccaaaaatgttataataatttaggacaagaatatcatactttaataaattcggagacccgaaaatacaacttgagagtttagagaccaaataagaacatatttagagactgacgccgcactttactcttttgggttttgattagatccatacataaacccattacccatgcatatgtttaataaatgtgtccaaattcacaaatatatgctaacctttcagcacttgatctgatgatataagttgcttcaaaaccatttttacttttttttttcactgctcgttcgctggattaagtgttagcatttttttcaaaaaaaaaactcatgcatttattcaatataagaggtttacatacaacatacatgagtggacaccacatctttcaaataaagagagattaagttgcctatggtaggacagacatatacacatgcagtatgatttacataaagacccctcaaagataaacaagtaacacacactactaaaaaacaattttcctatacaagaacccacttagattataggcagaccataattggtcacgtctggaaaaatagtcccattttcgtatgcggtccatttaagaggaccgcacggaaaataaatggaccgcaacgaaaatgagcctattttcacgtgtggatctattaaaagggccgcacgcaaaatacccactccctcttt

SEQ ID NO: 7831 - DNA, 23208 bp, Oryza sativa
gtacgggagcgacgtccttggccaacgacgaggaggaggaggaggaggaggaggcggcggccgggagcggtggcagctgccaccgattctagggtttttatttttttttgaatttttttcggatttttgtttttccatgcggatgtcataaacacccgcacacgaagcaaaaaatcacgatttttgcagacacctgggtgcgtgcgggccacctacccgcacataaaaccggttttgaccgcacacgaaaatctttctcgtagtagtgacagggttatgaaaataagcaaataattaaggactcaaagaaaaaagcagtcgagtccctccttcacttcttcttctaatccgatgaccaagatgacaaagctgatggtgacgactgtgaggacgaggttgactgctgaagatacttcccatcaagccacaaacccaacatgggcctctcacaagtgaaggttgaagcgaacccgatgaataacagaagattcagtctaaccttaaaaaaggtatatcggagacaagaaagggcatcaaattggtagcagcaaactggagggagatgatttaaacggccaacaacaccttgtcattgtggaggaagaagacctctcaccgttgggcaaatatgctacacttgttgactcaaacaccaatgaagaaccccgtaccagccttctagatggcacaaggcaaagcaatctatgaatttagagctcaagtcggtcatggaaggaggtagccaggatgaaaaagacgggtgttggcatttccatcgagctatataggaaaggggaagaagtggacctggtactaagataaactcgatatacaataggatgaacctgactacgggataaacctgacggctcccctaactctccatcctccctcgtcggtgactagcggccaccgaagacggagaggaaaggggatccagtggaggaaaagaggagtcgctcttttcttcgctcactaacagagagaggataaggtcaagttgacccctggatgatgtatcttattgttacttacccctctaaattgttagctagaattcaaattgtcaaggcctgattgagcacaaattctcccacttaattgacatgtctcaccgctcgctgcctatgctttgtaggtatagacgctttgatgcgcacacagtgacgataatgattgtaacatgataatacccaccggttagcaggtaaactagacaatacaagagagaacattgcaatataggagtctactacattcattcaaaaataaataaatctaagatatgatgagatattttctagtacaataaatttgaagaaagccttgtctaaatttgttgaactaaaattatcacattttactctaggatgtttattttgagacatataaagcctgttcactttgatgctattttcaaccttactaaattttagtaaagttaccaaaaaagtggctacatttagtttgttgccaaattttggtaactatataagaaatcctgccaaaattttgataagttgccaaatttttggcaataccaaattttgataaggttttttttggcatcaacgtaaacaggcccatagtgtagttgatatgagtcgtgacaagacatgcactagccaggaaggtcgcagtggcagatgagatggcttccattcccgttaaaaaaaaaaaccatgcagaactattttctgttgtggcacattggcagcgcccgaatgaagggccacgtcagctcctttgtccggtgcgtaacggttaaaagcggtggacccatccaacatggccggaccggaccggaccacccgctgccactatcaaccaccacagtatgccacttccactgtccaaccttgtcttgttaagagcaagtttagcgcccctttgaattataggaatgaaaaaacggagaaataagaaaaatatagtattttaatatgaatgtaagtgtaaaacagaggattgtagaacacagagaaaacgtagaaatgaccgtttgattagaccacaggaaaaacacaggaatttgaggagagataaagactcaaagattctatgaatttcctttgaatcaaaggggaccttaatagtataacgcaactaacaactctaatttatctataatcaatgtaatagctaattcatacaatagttatttactatactattaatatatagtttcacctgtcatatacatattacgtcttagagtccgtgctgtagttgtctatatatcggtagaccgctgctcttttatcttattttttatcttattaaaatatatttatagctggctaatagtctattattgttgtacctgctctaatgctaatgctaatctaagaggaatcccatcaaatcagcgagtaagggttcaccaatcaccattgacgccactctttcccccctcccgagcacagagcagagagagagagagagagagagagcgctgcggaggagaccgatgccgccgccgccgccggagccggagccggagccggtggtgatccacgcgtggtcggcgccgcgctccctcagcaccagcctcatgtactccttcgcccaggttcgcgccttctccttcgcctcgcctcggactcgcccaccccgctgcgcacgggggatccccctgggccggcggcgagtcggcgaaccgggggccaccgccgcaaccagctgcattacctgcacggccggctcgcttcccccgtttcgctttctgatgattttttttttaattcttgtgtttgggatagagggatgacatggaggtgctcgacgagccgctctacgctaatttcctgcgcgtcaccggcgtcgacaggccgtatcgcgaggagcttctgtctaacatggtaaaccttgacaaatggtttgattatttaatcacactactaccgttgctactggagaaggaaatttttgttgcgtgatctttgcggcatttagtaatggatgtttatttgaagtagcggtcgtttggaactgaaccaaatcagctgtaatcatgctcttctgacatgattgaaacttgaaaggatggggagatggttttgacatcctgcttcgtgaattaccttttttttttggttgcttctagcacttccctgactactggacctttctgtccaaatgttctcaatgtcttaattagatcatttccatttcaatatcgaaaataatactgtgcaccatccttgtgtgtgctttttaaaactagctctgctaagttaccataaatttctatactagcaatatgcatggagcatggagccttctatataatagaatcactaggaatacttccagtgcaggatcctgatggtaacaaagttatcagtgaagtcatttttgggccagggaagagaaaatatcgttactgcaaggtagattttttattttctaagatgttgctcacagatttataaatgatcccttaatccctcaatcttttgtttgtagcacattgcaaagcagcgcctccctaacctgtcaagtgacctgatgaaaaagggaaaacatttcatattgatacgcaaccctctaaatatcctggtattactgccttttgttttcagtatcacatagacacatacatttttactcatttttgctttgcatactgtattgtgtatatatttcctcctgctaatagcattcaacatacctcagccatcatttgacaaagtcgtcccaccatcattctttgagctcggcatagcggaacttgtctcgatatacagtgaattgtgtgagcttgggagccctccgcctgtgatagatgcagacgatctacaacgggatcctgaggtatatctattcttggatattcaatgatgttattactgtggacactatctacttaatatagtgtgtggcatgccattattttgtagtgggctgctttgaagggcatggcattgcagtcctcaagcaattagtctaggttatactacactaataaaaaaatgaagttcatattatcttcatttttttgaaatcatgggggcctgaaatgatttttcatattagattgaaaaataataatccttgagataatttctaatattatgacattatctcaattcctgtattgcattcgcaaattgctttgtttttacttcacatgcaggctgtcttgagtggactatgtgaggatctaggtattccttatcagccacaaatgctccagtaagtatattctacatggtaaccacgctaaaattttctattgttaagtatgcacgttagaacaagcatggttggacatcaagattcaaaggcctgttcttcctttttagatgggaagctggccccaaggactttgatggtatttgggctccctggtggtataggagtgtacacaagtctactggtttctctatgccacgccgttatcctttggtaagcttgcatcaaacatttctttcaattttcagcatctattcttgtggtttttgcaaagttagtatccatatcatctatttttcaagacaagtattgcattggtatagatagagaacagaggacctctgaagcaacatgacgatgtaacagggagttgaaggggtcgcttgcagaaaatgtgcttagatattgtaaaacaaacgtgttatagctaaagcgagaaaaccagatggttggggataataccttagatgaaagttatttgaagttatgtacgtatatcttcatttggatagcctgatcattctgctgaatttctagatcatcccatctaattttttgcaagtagtttttttcaccattgtattgaatatgttatggttcttgcaggttagctttttgagaacatacaaacaatagggatatttggtttgaagaaataacttttggaataaataatagagcagtgtgatgatgctggaaaggtccaagctgaacttacaaaaatggtacaaaccacaaacatgaaaacaaacatacatatatggctaatctgaaagcaagaaaagaaaacaccaatgctgttcaaaagttcaccagatagattccttggttttgtccttaaatagattatgatacctacacatgatcatggactttttggcatttgtacactccatttattcgagaagaacatttttgcgtaccattgaaccccatgctgcttcatataggagtcaaccatcaaatatgaaacaccttatttgaaaagagctgatctgttaagtaaatatgcattctaacaaaatatccattgagatgtaaaagagtttaaccttattgagtggcagccctgtcaaacaagtttccgttcctaacaagatgcaattcatttcatcgtgagttggtgtaacatttggtacagcttttaattatcattgactttctctattcgatttcagacttttccatttgctttgtatgatctacttgaacaaagcttgccattttacaacgtgctgaaacgccatgtaagcaaaaccataggatccccgcaaccaacattacctgatcctcctcttccagtacctgaaaataaaaaaattcttgtttgggttggagatgagcttttgccccgtgatagtgcaaaggtacatcacttataacttttggtatgctctcagtattataatggtcacacttgagcagttgttccttttttttttattctaatcatttatcttgtaaaggtttcagtatttgattcagttgtacaaggaggggatgctgtgtgggaaggattacgtatatacgatgggaaagtgttcaaacttgatgaacacttggataggtgcaataactatttctgtatttccattcttttttctgcttgtgatatatgagaagattgtccttatgtttttatctaggttgtttgattctgcaaaagctatggccttcagcaatgtgcctagtcgtgattgggtaatttgacttgactgctctcatctatactgttcgttacattgcaagaaatatcaaattaatctttgttaagaatctttgatgttctgttgtgccttttttgcattgatgtttcagcttgtgtagtaatagtctctgaaattttggtttctaatattaacagttgtatgtccaatgaaaagattattgctgtgggccaatgttgaagtttgaactactcctgaatcaagcttccattatgtgcatgtttctatgcagattaaggatgccatctttaggactctcaatgcaaatggaatgttcaataatgctcatataaggcttacactcacccgtgggaagaaggtaaaaagatgaacctagattcatcagtagtgtcacttttcaagtatatatatttgtcgacatctttgcatatcctgcttgatcacttcattcgctaccttcaatttcaaaaaactgcaggtgacatctggaatgagtccagctttcaacctctatggatgcaccttgataggtattcatcctcctagtcctatcttgcttgcatgagaatgccaagtatttgttttcagttttccaccttgtggcataaggacattatgtaggacaatgtgaaggtttagctgcttaatcacctgtagtgcttggtacccatactgaaaatctggcgttgctactgttggctggccagtgctggtataaaaccacataaccaatgatatagagtagcaacttttgagtgcctagcggtggtatgctattaataaattgaccaattgtattgtgaaaaatatatgtatgccactatatatgatttgcaattctgtggaaaactaagtgggtgcaataatgctaatttctaataagacctgttctttcagtgcttgcagagtggaaaccaccagtttatgataactcgcatggaataaagttggtaactgccaccacgcggcgtaattctccgaatgtaaggtccatttggaaacatatacatgatccatgttaatttgaaagttcacaaagcatcctgtttagtttcctgtttgggaataaacattgactttggctgctcttacgacttttcagagcatagattcaaagatacatcacaacaatcttatcaacaatattctggcgaaggtactttatcctttagatttgtatagctgtccttacatacatttttttaaatggagccctttattaattgtaatagcactaagttgctaatgcttttatgcagatagagggtaaccttgcacaggctgaggatgccatcatgctagataaagatggttttgtatcagaaacaaatgcaacaaacattgtaagtgtacatggctgttatcattaacatatctcgaatttgcctcaatattttttattgaaggagagagtttacctcaattttattcataacttttgttttctaaaaatgccactgtgttaattgcagtttatggttaagaagggcattgtgttgacacctcatgctgagtactgccttccaggcattacgcgtgcaactgtaagtctaatcaggttccagttggaaaactatcagcagagccaatctaaaaaattggatacctccattggaatgacatggaagagaatttattagaacttttctgtctaattgcagccactactttttcaaggagcgttattgcaatacacatttcatttatacactattttgacttgtacaactatatttgtactggaaattattgtgaaaatcagagaaatttttgtttttactgacaaagaggcccgataaatattgaatatgaggaaccacttctgttactccctctttttataatatatcttgaggttcttgaatcacgggcattttataaattatcttcaagagaaaatgtaaaatatctgatagtggctttgtaccatgagatctaccgagttactttgtttggcactgatagtgccttttttttttcttttcgtttcctatgaatgcaaaattgcaaataccacaatatgtttacctaagcctatagttatatcatgtagatattttttactggcttgctgcatcatgacttcaagaaatatgttgtatctacttacgtgcaaggaagacgaaatttgtggtttcagttagcatgaagcactatgtgattatcaagttgaacaaacttcttttctggaaaaatcagaagagtcatatttgctgatgctaatatttttcatgttggatgaaattaacaggtcatggatcttgtggtaaaagagagcctggtgttacatgaacgtcgcattagtttatcagaatttcatgctgcagacgaggttccagtcttattcatggacataagttcatatatgatttttccctctatgcaatggtgaatctttgttaggaacaatgaaacctgccttttcaagaaaaaaaggaagtgtttatggttttaaggaaacctgcttttctagggtaaaaagggtagagaaaatgccatgtgcagaggtctgaattggcttgaccatagaacccccgttacagcgtgtagtactgtaatcctctgagtaaacgaaatgatcgacaatactccctccgtttcatattataagtcgtttgacttttttcctagtcaaacttctttaagttggaccaaatttatagaaaaaatatagtagtattttcaacacgaaacaaacatattatcaaaatatattcaatgttagatttaatgaaactaatttaatattttagatgttgctaattttttctatgaacttggtcaaactttatttctataaacatattatcaaaatatattcaatgttgctaaatttttctttaaaaaatcaaacaacttataatatgaaacggaaggagtattattttgcttacttgaatgaagcaattgtgattatcaagttgagcctacattgttttctgaaaaaaaaatcaaaataatcatctttgcatatgctaacatctttcatgtttaactagatagttcttatctaccttttcatgaattactataataagatggacatgttgagatgttctataacatttacttgaaatctgaattttgataatgggggttttcacctgcaggtatggactactggaacgatgggtgaaatcacaccggtgagtttacatttttgcactatgcgctcatgttttcccttagccatttaacagcacagctatctgatggttttgttgaatttaataataaatatctagtttacttgcatgtattctgttttctaaaccagagtatttagtcactctagtcaagtggccattttacacctaagttattatcataaaattgtgttccctattaatcggggttttccattttgctagtattttattagatacgtcaagcataaatagactgcgaacttgtaacagtgttggcacgtactgcacatatgctcgttgctgacataatctattctacaacaggtcgtaatgattgatggtcgtgaaattggtgacgggaaaataggtccggtcacaagacaaatccagaatgcatacaaagtcataactgcaggttctggagtaacaatacccagaaatgccgatgaataacaggtgtatatgccttcctggtctacctgccggaaccagtataaagcaaacttgattgttagagaaataaatgtgaaaagatgcatcactaaattgtcgtgccaattggaaaatgtgtatgaagcatgtactctgtttttcttagactcagtaggggttttcgccaaaattgcagatttcatttgtggacgattatgaattcaataaacatgtccaatgctagtagctcagtttggcactgtggtggcctttctaaaaggacctgtgcattatattttttttcttgaaaagttagttcaaagcatttatcttgaggccgatagcctcgtgaaaatgactaaatattccttttcagaggatttcacggtgcggtaccaccccctcattcggaacaaaggaatatagtaaagttgcatgtgttccaaacatgaactgtcatttaaaaaagtctttatgcattttattcgaccccattactcaacctggtaatttttttcgtgaagaaaacggaaacctagatggttgttttattcagagtttgatctccgtcggttcatcccctaaactgagattttaacattagcataatagtgccccccaaatggcattcaaatttctgcttttgttttaggatcaatacgccaaacaaatacgtgccacatggtacatacattggtactcagcaaaggaatgcttcaaccaggtaaactgtaatcactaatcagaaatagctctgtccatgcatcccatttactccaacatgataaaaacattcagatttccaaagagccaaagcaggatgcacacagaacataacagtaaaggagagcaaaagtagctgcattatgcatagatactgccagtacaagttaagcagatgatccatagaacgaactcctgcaacaaaatactaccttgcatcaactaccaattcttaactttttcgacgaatttgctcctgtacctggagcgcgacatatttggcaagatcactaatgatgctgttattgcatctctctgaagctaagttttattttggtcggtcaatcatgtttgatgaaccacgctaaaaaaatgtttgaccgcggcgcacggtccagtccaggtgaaaatatgctgtgtacaaacgggcctttttgttagcccacataaaaaacagcccaattacggcctttgctgcatatttaatttggcccactgagcctacaaacaagcccatgtaagaacggccgaatagagaataagttcacttttgatacctcaacttgtcttcgagcctgaaattaccccaactcacaataccatgtcactcaaggtcataggtaatattatacccaattttagctgacatggtgggctgagtcaacgtggaatccacgtggactaatttttacttctttctctttccacctctcttcatatctcatttggggcagcatgcagtgggcagcgtggagagcacagtgggagatgcagagaggacggtgggcactggtaggaccgtaggaggctgtcccgtggtgatggaagtcagacaagagaggagacggcggctacatgctccccgtgccaatccgcggtccacatctctgactccgcttccggccagtccccgcctccgccttcgaccggccctcgccttcggctagtctcgcctctacttcggctctggctagtaagcgacggggcattgaacgagaaaaaaaatcgtccacaaataatcaaagtatcatatgccttgaaaatgatataaggtgctcggaaatggttgaagaaaatgaataggagaatcactatgactatagtctatagcccttggtagagttactaaagaagtaaatgatttatttgatattatggttgactagttacgaagggttttagacagctagcctaatttccttgtggaggatgtaagagaagaggaagaaggagaagggatggctgttgacatgtggagcctacatggatcccactcattatgtcaacaaaaaccaaacactatcctactaagcgcaagtactacaatgctccatatgctacccctaagagtgtcacattggattgagtgatgaggtggaggagagaagtgaggagagagatgatgaaccacccctaaattaataggcaacatccacataaattttaaaaaaggtgtgagagtattagagacattggtatttgtatactagaggtgacatattgtatgggtgaatgatatggataaatttggatgtggtagtccacaacacttgccatgtagactcatatgattatgtggaggacagaagagaatagagagagagaagaggagccacccctcgtacaaggagcaacctccacacaaatttcaagaaaatgggagagagagaaacggattggtagcaagtgtattgggtgtagtgtaagtaaatgcaatctattatatgtattacctctaagggcaagtacaatagcaggctataagtccgctgtaagcacatgtggagaagagaagagtgagaagaaagacatgatacagatttgtaaccagctgcagcgcggattccaatacattgtgtgtgaatgagatgtgtgaccatatattaatgatgcagtatatgttaatagataactattgtataaataaactattatattggtttatagataaattagagctaatagttggctatagtattaaacttgctctaaattaatgtatagatggtttaggcaaaattaaatgtgaccactacctctgctataacacatgctctaagggcagtcccaatccatagtgtccataagtagtgtctatggtgccatgtcaataagacatcacaatagaaactacactatacaacccatggtttcttaaagtgggccattaataaatacatcatctctcttctctaccaatcatatttattcttcatctattatgaagacactattatctcccaatacaaaacttggtagtgtctagtacataggttctcgtgttgaagctgtgtcttgcatgagacccagtttcttcctctcttcactctcttaattaatatagtaccacataagctaaaagtcctacatgacaatgtagttaataccatagacaccatcctaagtggagggttgggactgccctaaggaatcaaagtggagatggtactgtgagttaggggatgagttatccctaatatatttcggttcatgtacgaattttagacttgatgatgtggagggatctaaaagtggacttattccccgaataaataccgcccgaaggccatatggccaactcatcggtggcggatagagagctggaattgaatcgcgtgagttgagttgaatccaggccgttgatctcccccctcccggacggcggcgcgagcgacggtacggaggcgcggcctccggtgggcttgccgtcttggatagaggtgggcattcggtctaaccgaaaatttcggtctcggtcttcggtctttcggtcttttcggtatttgaaaagtgaagaccgaatttcagtgcaaaaatgtcagaaccgacaaattcggtctcggtcttttcggtctcaatctcggtcctgaccgaaattcaacaatattttcatatatgcaaagaaataatggaaattttcaacacaaaaatcacaaaaaaattcgtaagcacttatgagtaaagactcttattaggttgcatgcctagaagaagtagggatgtgaaaattagagtttaatcctattaaacatagtggattgtaggttgcatttagacattttttttagtaattcggtcttttcggtctattcgattacccgaagagactaaccgaattgaccgaacaaaatttagtctttcactatctaggaccgaattgatgaccgaatttctcggtctcggtctcggtctttcggttcaatctttttctgcccacccctagccttagagacggagaccgaagcagttatgcaccgaggccgagaaagaagagagagagatatggtctccactctccagactccgaggagtcaaccttcctcggtcaaaccgagggagcagcagcgccagctggcacagaaaaagcgcccgagccaatcatgggccgctgcccggtgggcccaccagcccagccgaagcctgggaagcctcgggccatgcgaccgtgcagggcccacccggctctctctcccggatgcaacggggagatctccggccgcacgtaccgaggaggtggcgtacccacccaccccgccaggtgggccccacccgtcggtctcggggggtctccacctgcgcggtattactccagcctagttgcagttgcagttgcagttgcacttgcgccgttgcgttgcgcgctgggctggctggctggatgcccccaataatgtcctgcacgtggcccaccagcactggctgggcccacctccgaggcttttccagtaggggcggtttatttttgcacatgagacctctctgtttgtgatttttttttttgtttgtgatattcaattattatgtttgggttttgttggctggctgaaagaatgagaatgtcaaggatggacaacagtgaccgaaatggtcgtttgtatgatgaaaagaatgtctggatgtgccttcacgaatactaatactactatgacatgtggttttgggtgactatgacatgtgatgacggatgactaagaggaagtaagtagtttgtaatgtaataatcctatatacttatatagttcatccccactaagtgtagttaatgatatttctctcttctctcattcaaccacattatcccaatcatttctagcttttggatgatagatctatggtttaaatcgtctcttctttactttctcataacaccatgcaatcttacttatttttaggctcaaaattcataagtatcaattaattttagttttaataattacattgcatcttatgtgtacacgttatgtaaattaatttcccgcagcaacgccgtgggatattcatctagtttatctttagaggatgtttgtaatagtttaatactcctatcgtttaccatttagcttataagcagcatctaaaatttaaatttaaaacttatttgaagtagtatatttttcaacatttattttagactgctaagaacacacatatatatacaaattgtttttttttccgataagctgttacgacttacaaccagcacaagcaaaatgatcacggtgtaattcgatatttggtcaaggatgatgggtttaatatctcgagtgtgatacatcgccatcagtagagtcattgtgttgaggtttgcgtaattaagcgtccatgtaaaaaaatgagagaaataccatgcgtcaaatttggtgtaatgaatttcataaaactattgggcaaaacagatcactcattatggctatatatgagcatcttacacaataactgatccaatatttattattgaggtggcctttaactttgtttaatcactacttcatttgtcctaaaataaacaaacttagtactctatccgtcccaaattatatggtgtcttttttaaggaaaattaaactcggtaacttttgactaataatcatactaactatatatatatatatatatatatatatatatatatatatatatatatatatatatgctaagtattatatatgttacataactagattcatattttaaagtactttaatatgatgtatttgtaactagaacataacatgaaataaatcaatgatcaaagtatgtcattgaaaaccgtgtaaaaaaaatatagaccttataatttgggatagagggagtacgagatataacacatcgtagtatctagatagagacatctagattagtagtactagattgtgtcatattccgtattagatttgtttattttgagatgaacgaagtaatcgcttagcttggctaaaaagtaagacaaataatctagtctaattttgctttggccgttgcttcttcctattgttgctgcggtgtacaaacttaaactatctaacaaagagtttgttgcaagacacataaatttattttaaaaattaatcgagagatagatgcatacaaaaacgacataattatatgatatataatacctctgttttttaatagatgacgccattgactttatcatatgttcgaccattcgttttattaaaaaaaatttacgtaattatatatttttttggttgtgagttgttttaccagttaaagtactttaagcatgatttatatattatatatttacatttacataaaatttttttgaattagacgaataataaaaacatgtgtttaaaagtcaacgcgtattctattaaaatagggaaggagtataatccaagcaagacagcaccaatcggtgtgaaaacatcaaacacagtcacagcacaggtgacacactgtgtgacaactgacaaatgacaaaaatccggtaggggagcaatcgtaccaaaaataaaagaacagagggtccaaaacggcaaaaaaaaaaaaaccggtattccccctcccgtcgccttcccgtcccctgctgcgtttgccgtcgcgtcgcctgccgtgcggagccgagccgtacgtaggccgtgagccgacgagggcggaaaaggggaaggcaaactacgcaagggaaaccccaaccgaagcaacaattaaaaagagggaaggtggccgtggtggcctcgctgggattgggggatcagaggaagcaaggagatcgagagacgcacccaatctcccaatcgcctcctcctcctcctcctcctcctcctctctccgtcgccgaagatttgccttgcctccgtctctctctttctctcccgatggaccagctcgtcaatttcatcatccgcccgcccaggtgagagcctctccgctgacctcacctcccgattcgtggatctggtgggggggatttcgctttgcgtccagccccgatttggttgctgccggatttgggggcgtaattccggcgggatttcgtgggttagtagtggggcgtgcgggaccaggggcttttgcagctcgattctgtggagtgtctccccccgtgtgtggggggttaggcttctgctgtgctgcgaatgtgtgggggtttctttaattgtgttctcttagaaattgtttagctgagagtcggtggatttctctttctagagtactttttttttaagcgcgaataaggaatgtgtgagctgacatacttgccaatcagcttacgttacgggatgcttgtcaatcgatgttgtagttcatgggcttatcaatgtggcatttccttgcgtatccttaccagcaatgcgtgtgcatccgttccagcataacaaagcgttctacttgaccgaatacgacggtttcgggagtagttcttgctaccatgaactaacaagctaatattgtttttttgtgaccttttatttcacgtgtacaagacgttatgttcctttgagcaactcccaaattatatgttgctgacttaattaacttgtctgttatatgtcggtatattgcagagctgagtacagtccaaatgatgatctattggagcaggaattcatgttgaaaggaagatggtttcagaggaaggatttggaggttatatgtttgcttcaatctgctgctaaaagattaatagaaaccttaggattatctacttctttttgcgttttagtaatacttttgtattcgtggttaacgtaataaaatctacatattgtcacatttgtgtctcaaaattttaataccaacatatttttcttgtcctctgcttcaaaaactagaaaagcaattcttgcctctggtgaatagcactgatttgcacaaaaaaaatggcatcagtttttatttcctcttcatttggtgccccaaccaaccgggttgcattggtttttgcatcttaacgagaaaagagcttcagctaaacaggataaatttagtctcttagatttctccttgtttctttcatggtgctctggtttaatatatgcaatatctgtttcaggttgtaaatggccagggcaagaaattgcaatgtagccactacatgcctgttgtgattcctgaaggaaaagctcttccttgtgttatatactgtcatggaaacaggtaggggtatactatatattacatgttaaatacttgatgaaaaatataattactattgcttattataggtcgggtgtcagttttagcaaaatacttttacacatgtggcgtccctaatgaagcgaaaatataatccttacatatgctaatatattatattctttgtattttctaggcattaattaaatggcattattttttttccagtggatgcagagccgatgctagtgaagccgcaattattcttctaccatcaaatattacagtctttacactggacttttcagggtctggactctctgaaggagaacatgttacattaggctggaatgaagtgagtcattcttgtacttatagaagataaatatgatacttgttcttttttaaaaccttctgtttgtacttgttcttttttaaaaccttctgtttgcttgtaaactttgtgcattcaaagctagttgaatacttcatatttcttcatgttgtcgttcagaaagaaataacctggaaaatgattataacagctattaaatggagggctagagagtagagactgaaatataaacctttctacagaaatcatattgacatgcttcttcttcaattctgcatcagcttgtctcagtaacagcacattgccagcaaggcaccaagcatagatttttttaggctaatgcaattcttttacactattcgaagagcataatggtagatgatatctgtttttctttacagagagaagatctgaaagctgttgtcaatcatttgcggacagatgggaacatatcttgtattggtctgtggggccgctcaatgggtgcagtaacaaggtatcttctttaaatgagtaaattatgttaggatggcattcatctttagtattcttttaggacacctgctatcccaatacttgagctgctaattggaaaagagtgatgccgattatcatcctttagtatgtgaaatattatccttaagtatgtagcacctgccgcccccaaaaaacacccacagtcccacacaaatctcctcacatttacagtcgttgtcctattgtacataatacacatcatcattctatataattttagccttttagtgtttatgaaatctgctatctttatttttcagtctgatgtatggagcagaggatccatcaattgctggaatggttcttgacagtccattttctaacctggttgacttgatgatggaactagtggatacatataaatatccactaccaaaattcacggtaagcatcatttgatgaaatgaactttttgcttttcggtgatgaaattgttggtccagtaactattatagttgatatgtgctttaactttactgtgctgttattaacagttgctctaaacattactcccttgtggcacctgctaccgtgactgcatgatgcttgcaatcatactgcattgtaccgcataagctagcttatatagatgtcatccttggctgataatccatatctaatcgtttctctgacaaataaaactaaacaaacaactaatcaggctttcattgaattaataaatccgttcttataatctcttagctgacaaacttggaaacaaactgaacttgtgtagaaagcaacctagtcttgccattggatgattgaccttattggggacacccatggcaactatcaagttagcaactacaatttgttccaatggtgcataaactgtttccagccatctgtgcatttctcagaagattgtgacatctgttttttggtgtttccagttatatttaatttgttaactgtactaattttatttgatgatagatatgcttagtctttatgacagtgtcataagggtaggccccatatttgtatcttatttattgtggaacttttgtttgtttcttaggtgaaactagcaatacaacatatgcgaaaggttgtcaagagaaaagccagctttgacatcatggaacttgataccattcaggtttgctaccgtccatatactaaatattgtgttgctccaatgttttggctggtgtagtgatttgcccctccttgtctagattacacgcattgtatccatgggggaagatttcatttatcataatctttgacctctttatttgattttgattcagtttgcttttggtattaccctttttctaatctctattttgtgtttgcattcttatttttggttattttgcatgtcttattgaattttaggagcttttgctatagcatctctgttctttttcaattttgatgcccagccctagattgctaggttggctttcatatacaattctttcttcattccccccttgtgcccttgagtaaacaagagcagaaggctgaataagaaacaaaggaaggcaaaccttttcataggatgtgcatgcattttcttctcccaactgtgaatgacactgcaattttatttgaatagccaaatacttgtgtgttgcaatctattccaaacaaatatgtgacaatttctaaacttaaatggagatatatatttctctagaaaagaacatgtacagtttgcaccaaaacatcaccatacaaatagagtcttatatctatccacagaagatactgatattcaagtggtggtagtgggatggcatactgcctccaccactactatatgttgatttatatagttgagataatcagataatgctgtaaaacacctccgctccatttatttgtgacagttgtgaccatacatcagtacacaattaatatctgaaatttaatttttcaggtagcaaagcggtgctttgttcctgctttgtttggacatgcgactgaagatgattttatactgccccatcattcagacaaaatctatgaatcctatgttgtaagtttccaccttacccttcaatgtggacaaatgattcctttgtctgataaggtagtaatatatggttgatttaaatgcatctgcagggagacaaaaacattattaaattcgatggggatcacaattcaccccgtccacaattttactttgattccataacaatatttttccataatgtgctaaaccctcctgatgttcctgatgaccattatttcctgacacctcatggaagccttggtcaggtactacaaattgacatttcttagagtgattgcaatatgttcaacatatcttaccttaggtcctgctgacagggtcattgggatacagaacatgacatagagtataggttcgctcaatcaccaacaggtatgattttgcaaacctcgatctgcagttatgtttggtgcatcaataacagtatgaacttatgtgctatttgttatgggacagcccgcacagctaccacagaagatgccattgcgcagttacgttctagaaggctcatgagtagaatggaggtgggtattttcattttgttatcattctgaacaatgctaaaattctattgtatctttgtgccagtggtcttggaagtaaccgatagtcatttctgtctgtactgcacatggaaagtcaatcactagaattattatattggtgatcaaaatattactaaataagttttcatatctgaggcagcagtgatgtctcctttgtggaggtggagcagcaaaagtaactcatggtttcttttgattgttctccaggtcccaactggtgccactgcagaagacagggctgacagaaatgaggtatattcttttttgctatttttcaatactttagaatcatattcaagtcatccgtttctttaaaatcttctacctgatcatccactaccagaatttcacatggtcactgttctttctagaaaaaagaaacaaatgagatgcttttcacctagaagtgcaatgctagctcataatgatttcccaagaatcatctggtttaacgtgtagaatgattcgacacctgcattttcgggatagttaaattaatatattttacgggaaaaaaatgtgagataggtggttgtttcagagcaagaggaggtggcagtggtaaggtccagactccataggggctactgctactgctaccagtgtcaagtgagaatggtgggtttggaagagaataatggggcttaggtgatgtttactgaaaagaatgatgcatagaagtaatagaaggggttagggccctagttattcgtgcattctactgattaggactctgtttggtagcagagtattacacaaatatgttcatatgccaagttcctaatatatcagtgggagttgttcctaataaatcacgcaacttaaccataataaaataatatattctttgttgactggcactgaaatcgatataattcaaatgaaataattttgcactatgaaaattgaatctcatactagtaatagatatgtcgataactcgatctgaaatagaaactaccatataagattattcactttttccaactgaagctgtaatcaatactgagttgtagtgccaattggatctgagtagaatggatataccaaatacatcttgttcaaataagagcacaatcatccttgacggtgttgggattgtggctgtagtatcatcattatgacacatcagttttctttcagtatatatgtggatgatacaaatcttttgagctttcagaatataatgctcagagtatcaccactggcattgagattgctattcgattctgtttgtacaggtaatggacagtgataatggtccttcctcttctagtgtatctactgcaactcctcctaatggccgcaatggaaggctcctgactccaacctctgatgatggcgagtatgtggagtactcatttgatagtctatcagatatgccctacactgaggaagatgaggatagagtaagttataccttaacatccttcagatttttcaccatgtcatcatgttgcactaccttttgttgtttccaagacaccctcgtagacggttcaacatgcataaaaacattgtgtatcacagaaaaaaaagatctagtactggagaatggttgtgttggcctgttgggagatgtggagctgattaggcccaatatatttaactattgatagctttgctataagaaaattggattcagcatgtggatgggaatattacaaccatctaactttttttttgttggccaaagcttaacatgttaatatggacttctctctaaatctttaattgatatgtctctaaatcttaacctgttaacacgtgttttaagaaggatcacaattaccggttgatgtttccattatcagctgtttatctcttttttgctatactgaaatgcagatgctaatgcaagcaattatggagtccttgaaggatcttgaactgtcaaatacaaaagctgcgcaatctgccgcatctgatgctgcatccaaagaaaataaagaaaatggttgcaatggtgcaaccgtgacagtattggagccagatgcatcttccacctcggcgcgtcccactcccacagatgctcctggcaaggatgtaacaacctgcagtactaaagcaaagtcacctgaagtgcaaagtgcaagcaaccacaccacaaacaacgccgcttctgtgaacacctctagttccttagagtccaatgcatcaacccatgttacgaacggaaaat

SEQ ID NO: 7832 - DNA, 1310 bp, Oryza sativa
tgcaaatatggtgtgaagtgggtgtgcgtgtgccaactcgttgtttcttgcagctgtaaatttttgacggaatgatcattttttgctccagctgtgacaatttgggccattacgtttacacctatataaaagactggagccaaaactggatagtattgaattgtagatttgtagctaaaatgagcattttcagatggtagttacccagtttttacttatttttatagtgttgacaggagccatgatgtcaggacccgacatcttggtgggtcgtcatcccgttaagtaccagggatttttttttcttctgaccgctgatgtgtactcgctctgtcccataaaaatcaaccagtatcagatgtgacatattttagtactataaatttgtcgtattagaatatgtcatatcctattttttagacggagggagtaaatatataactagtgacattggtagcaggctgatcacacccctattggggcaaaaagaagggcaaaaagaaagttttgaaccgggagatattagcttaccatttactcaccctttactcattgcatcaggacaggcaagaattaatttcacacggttacttttctcaacgtttttaacttagcttcaatcattacttttttaatattatacatgaaaattataacaataaaaaaatattatgaaatcatgtttccagtgacaaatatagcgatatgagttctcgaatacaaattggtaccgttctgaacatactaatggttaaattttagaaatgtaccagtattatttttttttaaaaaaatgctaatagtgtgaattatatatggtcacaacttgcgcttcttcctctcctcctttcccatcctcactctaccgctgccgaaccaagccatcggcaagccgcggatggcagtggcggggcaacatcatagggcgtgagataaggggttgtggtgaaggtggagtttggcgcgacggtcggcaaagagcagcgcagtgcatcgaggcggcaatcgacgaggagtggcgcgacgcatagaggtggccatcggcaaggtggcacggccagatccggtgttcccttgactggatctggcgcctcctagccttgttcgcaacatggaggtttctcggtggcggtagtggctgccggacgagggattcccagcgccgtagtggggttggctatgacaatgaacttggtggcagcgatgagtgccggtggtattggtcggagacaggagctagtccttcgtccccctccctttatcaccgatagcgtgggctggtgacggacagcgggggggggggggggggg

SEQ ID NO: 7833 - DNA, 8163 bp, Oryza sativa
  unsure (1)..(8163): unsure at all n locations
tagttcatgcacatggtgaccgcagtggatgattggttcggcgacgacagataaagttggcggtggtggacgttctcaatggcgacgccctaggggtggcggcaacaagcgagctccagcgcccagatctgactgcgcccaagataggatggcagaatggtggtcgttgatgacagggatggttgacggtgtgatggtcgtcggctcgcctagcacaacggaggctcttagcagcgaagccttggtggagatggctgccaagcgagcaagcgtcgatgccaagatctgacagtgggtaggtgtggacagtggtggaatatctttctcgagctcatggcagtaaaggtaggtgctcgtcgtgctgcatggctctgagatgctctaggaacggcggagggttcgacggtttgtggaagacagtggtgatgtggaatagcggctttttggcgcactaggggcgttcagaatgcaccggtggcgtaaggggatttggacgacaacggcgaatggcacgcatgataattgatggcagatgttggttgtgacatgcaggggtggagatggtgtggcgacggacagtggggcttagtttcggttctccctttcctcttgtgttgtcaaaaagagtatgccgtatttgaagtttgaaactaagtcttctagtagttttttttttgtgtgtgttttatgttttcctctatggaggtgtagagtctaagaacttgtatatgttttggccgtgtatatccttcctagatatataagttggattaatgaaaatccattattaaaaaaacaatatggattgtaggatgttaaggcctagtttgaaagggcttaatgaatgacgatggattatcttattttggtatataatttgagggtacaaacacaaataaatatcaattacaaataaaaaagctgtttaaaaatattttaagcaatatgtatatagattttctttttttttaaaaaaaacaatcacacactttatgagctctgtaattatgcccgcaataatttctaatctataatctacaagtaaaaaaaagagcagaggtaatactagactccatgcattctgtatatttactttactctctaagatagagttccactaaattatggatttcaggatagggatatcagtactacatattttcaggcataaataaagaataaaccatgctcacattatacaaacttgcgtgatagatgtaaatagatacaacttaccaatcattcgtcccgatgcatcaactttcctagtccattcaaacccaggctaaaacattccatgcaaacagaaataatctatgcagtacacatgtaagtttaggtattgaaccacatgcttgtgttatgcactactatagcaaattaactgaactagagcaaataggaatacaaaatccctcagatgcaactgagttttggcattgaatcagtacagaagctactgcttgattttaattctttagtgcttgaaccatcataaaatagccgcaaagattaaaaaaaaaacaacaacacaatatatagagaccatcatagtaatttgatccttccactttcacttttgtacgaagctgctgcatttctgctgtctaatcaacattctataaacaacatcataatgttctctcattacacaactgtaacctagagtatcagccagcttgggctaggatatagacctaaatttcatcaatgagtgccacatcgaatcattttcacttacgtgcattgttttggcccgagtttgcacgagataagcaagtcgttctatctacttcacgtaacatgtgagtttgtgcactgtgagtgcaatttactcaaaataaattgcatcatcatctttttgtgatactccgtggtttcgaaactattaagattcagatagttgtattgcatagtttcaaatataaacaaatcacattttttttttgtgtgtgtgtgtggggggggggggttaaattatggtgttccatagtttcacttgacaatttcactttaaattcaaatttaaaatttggagcctttaagtttgtgaacaaaagtacgagattggtcctccacaaattgaatcatgtgcatgaagttgtcacaggctcacagcgactgcacaacagcagctggagtaacacaaaaaaggccatttttatcactatgccattcatatgtattaaattatctctactctttctgttcgagtgatttgaacattttcacatccaggtataatccatgctaacaccaggacgtgttctcatttcagctataaatagcaaaaaaaattcaaatatgtataaacccgtcaccgttctcatccaaaattatctactttcccgataatttcattttcattaactccattcccgatcagtgagattttgctacgcattgttattgatataaaaagatggctataccttggatgcgagtgtggccatggagcactgcaatggcatcgccgccgttgggcgctggttgtccaccaagcccaaggttatcttcgtgctcggcgccaccgccaccggcaagtccaagctcgccatccgcctcgccgcgcgcttcgacggcgaggtcatcaactccgacaagatccaggcgcacgacggcttcccggtcatcaccaacaaggtcaccgacgaggagcgtgccggcgtcgcgcaccacctcctcggcggcgtcagccccgacgccgacttcaccgcggaggacttccgccgcgaggcggccgtcgccgtcgcccgcgtccacgcggccggccgcctccccgtcgtcgacggcgggtcgaacatctacgtcgaggcgctcgtggccggcggcggcggcgcgttcctcgcggcgtacgactgcctcttcctgtggaccgacgtcgcgccggacctgctgcggtggtacacggcggcgcgcgtggacgacatggtgcggcgcgggctgggggcgaggcccgcgccgggttcgacgccggggcggactacacccgcggcgtgcgccgcgccatcgggctacccgagatgcacggatacctgctggcggagcgcgagggcggcgccggcgccgaggacgacgacgacctcctcgccggcatgctcgaggccgccgtgcgcgagatcaaggacaacacgttccgcctcaccgtgtcgcaggtggccaagatccggcgcctcagcgcgctgcccgggtgggacgtccggcgcgtggacgcgacggcggtggtggcgcgcatggcggagggcgcgccccacggcgagacgtggagggaggtggtgtgggagccgtgcgaggagatggtcagccgcttcctcgagacgcccgccgccgccgccgccgtcgttgccaacggcaaagtcgacgtgaacgtcggcgacgcggccgccggcgtgcctgaggctgccgccgccgccgtcgttgcggcgggtgtggtctaactctaagtaggatacgcggcgacggtgcatgtttgcatggtgggtggcggctcatgttgcggttttgggttggctttggcgtggctgggccaggtggcttgcaatatttcattatttatttatttttattttgagctgcagtgatatgagattttgagtgagaaaggagagggagggagacacaagtatctttgagcttgtttaagcttagtgttacaagagattattttgttatgttttcagaatatataaaatgctagcgcctctagtataatcggtagtatttgacaccgcacaaaatagtagagaatgctacgcagcgtcaaatattaccagttgagggaatacaaattctaaagtgtttacttgtcttttgatttgaagtttaaaaccaatcgaaattcttaactgtcttttgaaattcgaagtgttttctcccttattagggcctgttcggaacaaaaggataaaaaacacagaaatatgatagagcgtaaattggaaagctcagggactgtaaaacttgagctgtttggaacagaggaatgctaggggatagatacacaagcacacaactaatgtgaaggaaaatttcctttaggaggaaccttatttttctttgtttccttttaaagtatatgatttcaaaaaacaatatttggagggagagatgtccctccaaacaatttttaagaaaaaaatatgagcgtgttggagattaaacacggagttcaaacaaacaagatttggagggagagacgtccctccaaacattttttaagaaaaaattatgagcatgttggggattaaacacggaacctcagggttgaaatcatacatctcttgtcactgcactatcaagtacatctcaaagtacagagtttctcaatgctcttttctttgatccaaacaacatcataggaagattttccaaaggaaactaaacctccacaattcctttaaaattcctttgatccaaccatgccttggttactgcatatttgttttagtataaccttatattgcttgaaactaaacttcccttcttttcatactacctgacagattgttagttctaagagtatgcttatctaacatgcggattataagccatagacaattttaaaatttcgatcttaattttcgaattaatttagttttatttcttattttcagccttagtttttgaaatgctaagactagaagtataaatttcttactagttgctttggtcacgcgttgttggcttataaaccacagcacacaagaggaaattatttatttgtatttacaaatctgtaccttcaagtattcttagtttaccgcacggtggcaaagaaatggagaaaccaaacaaaactgaaccaaaatccatatcttttttattactttgttaaaacatggttgggattaccgcgcacccattgataaacccgatatggaaataacaacctgcttaatgattaatgaagggaatcagataatctgatgtagagaatttctatatcagaggaacgtcctcaccggatcgtcgtcaattctgcatccaacgggcaacatcgtttctaacctctccttgttcggccttagctcagaccaagtccagggaaacgctttataccgaatgtcctaagaaacggaaatatcgaacgtctcgtctaccctacggacgaaccctgtcactgcatcatacatgcttagctgtttcttttcattctttcctcctctctttaaatattttttcttctaaattacttatccgatctacgaaccggtcacaccgttgtattcgttgcaattaaatttttacaacaagatatcatatgattatattatatcaaaagaaaaatatgtgtttcaaactgttaaaataaaatgttccatacgtgatagtgatatatttcaatgtgcgtcttcagtgtgtttcataaaattcttaaaactacctgctactactctctctccacctcatctatgcacacatgcatgtattttagcaagcttcaaaataatttttctcttaaattatttatccaatccatgatccgatcacatcattatatttgttttaattaaatctttacaacaagatatcgcatgattatattttgttaaaagaaaaacacatgtttcaatccgttaatacttgttgtttcatacgtgacagcgacatgtttcaatgtgtatcttcactatgtttcataaaatatttaaatgtttcagttgctaattttttttgttttaccatatctctactataaaaatttaacttgtttttgccatgggtttctagtacgttgttcctttccatttcgcatttggacgcatgcgtttcaaacgttgtttccgattctgttccatgggagtagtcttccctcccgttaaattttttctctctattacggtagttaagttaaaagatgctcttccattgatttcctttttttttcctcttagttaagttaaaacatactacctaatgcatttacggtcatgcatgcgacataatggtctcgtttggttttataactctatacctacttaaaaacacataaggcttccgatcgttcgtttcgtccatcgtcgtcgtgtgagtccgagtccgtcttttttaaaaaaaaatccccgagcagatcagcctcctaacccctttgcccccaattcccaaaaatcacaaaatcactcaattgcaatcccaaatcaaaaccaagaatcctcacaaaatcaacatcccaaatcaaaaataaaatccaaatcctaaccctagccgtctccccgagctaccctcctcgtggtcgtcgtcgtcgtcgccgtcgtccgtcgtccaccgccgtcgccgccgtcgtcggcattgccgcctttcaccggcaccgccaccgttcccgagcccgccaccgctcccggccgcgtcgccacacctgggagggggagcagcagccgccgagcccacatgcggtcgccgtcggcgctaccactgccgtaagatccgccgcgggagggaggcgagaggggtcggagggagccgtcgccgccggatctatcctcggccgccaccaccgtggctggatccacccacggtcgtcgccgacgccaccgtcgccggatctgtcacgcgagggaggggagggggagcggcactgccggggagggaggagaggcgccgccggggaggggaggtgaagcggcgccgccggggaggggaagaggtgccaccactgagagagagggagagggagggaagggaaatgtttttaaggttagggtttgaatcattgaacttttatataggtcgtgatcaattaagaccgtccatcagatcgaacggctcagcttctccagcgttcctaggctgcccacactattgggccgcttgtaatctcctcagagaataagtttactttatgtccctaaagtcgtccccgaatatgttctcatgccgcccacactgtagcccgcctcatgggccacgtgcacgcacagaataagttcacttgaggtcccttaagttgaattgtttttatttcattatgaatagattttcttaaagagctcatatcatgtaaaactaaaccctaatcatctaatatttttatattttgtataattttagtttacccgttgcaacgcacgggcattttttctagtataacttaatgtttcacttgttggtcaactgtaacatttgaccgtccaattattttggggcatcggacatccgatgggtagcttcctccccaagtccacaaggaaaaatagcgtagcgagaaagacgaaggtgccactcattccctatggctaccagctgctcgatcgtcgcactccttgaacttgtccgggagcacgcgcgctaggcgtcggcagcgatgtcatatgcgtaggaggagcagagcacgttcttggcctcgttgtagccatcagctacgtagacgatgtctcgttgcttcccaaccgaagaagccccgggagtccgggatcactgtgttgtgtcgccaccacacgcctccacctcctctcccgtgaaatccatgtgccgccactcgcccatggtgaggttcgtcgcggccagcacgtacgcactccatcaccgccaccggtctcatcgcccccacgcacgggtgtggccaagacaaggaacacaacgtcctcagcttccctggtcgtcgtcggaacgtctccggctcacatgcgcgccaggcaccttggccatttcgtccgacaacccaggatgagcttcgccgcttctggctcccaccctccccatgcagggtttaaaatttctgactaaactttctgaaatttggggtctatcagatcccctgatatgaaattattcgcatggttttttggtttgttttcatttagccaaattttgttaaaatttccaattattttttcagactgaaatcaccaaaatttaggtcctctcggtatccctaatacaaatagcgaaaacagattttgaaccctgcccgcccaactagaagcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7834 - DNA, 429 bp, Oryza sativa
ctggtagagaaaccctttgtagtcccggtttgtaacccccctttagtcccggtttatctttagtcccgggtgaaataaccgggactaaagatcgatctttggctcagccacgtggccggctgagccatctttagtccctaccaaccgggactaaagatcgagttgaccttttttttttgcatggccctgttgctacatggtttatatatatatatataaaccatgcatatatatgtttcaatacatatatatgcatacatatatatatatacatatatatgcatatatatatatatatattatattatatgtatatatatattatattatatgtatatatggttcagtacatatgtacatgcataatatatatgtatttatacatatatatgttatgcaaatgcatatgtgtatatatatatatatgta

SEQ ID NO: 7835 - DNA, 660 bp, Oryza sativa
aatcacatttcagtctatgaaacatgctaatatgtagagtaaaatcagtagaatctcacgtgaaattctccctttcctgtccatgtacagtttaagctgtcgtctgaatactacctccgtgagggcccaaatggtcgaacaccaagtacacgccgagcttcgccgagcacctggaggtgtccgtcatgtcgtcgggcttcccgatgctggcgccggtggtgctgatgggcgtgcacgacgacgccgccgtggcgaccgcggcggcgttcgagtgggccaccgccgccggcgtccccgacgtggtcatcgccgccagcggcgaggtggcgcgcttcctcaacgacatcgcgtcccaccgcgtggggaagaacgagaaggacgtgccgagctcggtggagagctacatggcggagcacggcgtcggcgaggaggccgccctcgcggcggtggcggcgatggcggagcacgggtggaggacgatcaaccgggcgttgatggagatggaccccgggctgctgccggcggcgcggctcatcgtgaacctgacgaggacgctggaggtgatctaccttggtggcagggacggttacaccttcggcggcgacatcaagggcctcgtcgtcagcctcttccttgatccggtcgccgttatacgtattt

SEQ ID NO: 7836 - DNA, 260 bp, Oryza sativa
gaggggcgtaggtgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatttatcttcattgttcaactctttgatgaaaagatgaaaaaaccaaaaaaaagctct

SEQ ID NO: 7837 - DNA, 267 bp, Oryza sativa
aaagaagagaggaaaaactggaatatgtcaggaagacgaggaagtgaatccaacatagctcaagtgctaaactgcttatgtcagctgtctaccttggacagtaagcttcagattgctgcgctttctgcaatactattcccaaagctttcgcagtacctgcaatttgataaattcagcatctaatgcgaacaaaatagcagttcaaaccagtacttgtgaaatcatgaaaaggaagcgctattttgttcgcattagatgctgaattta

SEQ ID NO: 7838 - DNA, 388 bp, Oryza sativa
ctgctgccattcggcgagtcgccgggcggtcccttcaacatcctggatcagaggcctaggttcgtcaaccgccacggtcgcctctatgaggccaacacccgcagctttctcgacctcgccgagcatgacattcgcgtcacagttgtcaacatcaccgcggtgtgtttgcgtcgtcgttcacgcgcctcgccatgcaccctcgcctcactgcgcattggattgattggtatatgatcgcgtggtttccttgcgttgtattgcagggatccatgaacgcgccattctacaacacccggtcggtcaaggtcgcgtatgtcctaaatggcgagggggagcccgagatcgtgtacccgcacatgttcccgcacatgtcgcccggtggccgcgg

SEQ ID NO: 7839 - DNA, 9598 bp, Oryza sativa
  unsure (1)..(9598): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcttaggtagcgtttgggctcactaaagtgcttcctttttcttatcttttagacttccactatgaattatttaacacccataaaagaactttccttgcatgattttctttattatgaaatcaacatttatattgacaaacctgcttagcttcagttggacaatgatacgctgcagtaaggcatctcattgaaggacattggtggattctgcactgctattctattacttaacttcagtagagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggagtcaatggtacgcagtagtgaaaacatagttaggagttgcatgttatgttgatttgctattccaaaacgtgtttgaactgtagcaggatgtttgttcctattaaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgtagtattgcttgatgttaaaagtgggtcacaatttccagtgttggaatctaattcagtacatggcaatgaaatttcattgacctctgaaagtgaggtatcaaacttaaggttggtttctattcattcagggttttgactttcattcttctcatacaagtattttcctagaaaatcatgaaaaagcatggtgttttaaatagtggagtactaacattcctctctcaaaattcgctacaggtatactcccatggtacctcagatacatcatgttctaggtgttgaaactgaaagttgcattcattctggtgattcaaactttctggatcttgaatggctttcagcttcaggcaactcaagcgatgaaaggtgtttacttttgcattgctattgtatttttttagcgtttttgactgacagaatatcatcttctcagtgacagtcaatttgatttacacacattttctttgccttagtgtaggaaaaagtgaaggataattattagttgattatcctgtaaatttcttacccttcatgcttaattccatatcaatctattctagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcatttaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattactccgatcattatgtaaaactttattttcattttttatatgcattggtgcttcatctttagattgtaatgtgtaagagttttgttctcagtagaatctgtacaacgatgtatgcaaaattactcatcaacagcatcccctgcaaatgtattcgtgggttttttccttacataatcattgattcagcctgaaaacaaatgattagtctacagtaatcaaccaatctatgtgtaggtggcgcgccattggcgcgccccagcatctagtataatatgaagccgagcctactggcgagtcttaaaacaaaaaaaaaaagtacgatgagtgtgtaatagtttcagagaaacttagtaaagaatctatgtagcgtatgatgcgcatatctaacatggcaacaaaagctcagccaacaataattcaggctgtgtttagttcagcacaaagtttggattttcgttgaaattggagatgatgtgactgaaaaattgtgtgtttatgacatgttgatgtgatggaaaaggactgaagtttggatctaaactttagatctaaacaccccctcagccgctcacttgatcgaatgtccatgtggaagcgaataatggcgccacatatcaaaaaccgttgactccacaccaatcaagcctgtcaagctcatgcaccagattgtaatgcacatgtacgaaatcacctatatatatcgaaaaaaaaaacgcgtctgttaattagatggccggaggaatgtcagctgggaaaaatcacatgcccatgcttgtcagactgtgcagtggtgctctttcgcaatcaactatatataaatatttaagcaacaagtcaaattctaaaaaagaaatagtaaaatacacggccggtccttaaagttgagcgcgggtgtcacttaggtccataatcttgtaaattgcacatctaggcccaccatcttgtttaagtgactcattgaggtccaaaagacctctgaccgggttgactggcttacgtggcggtccagcgtggcaacatatttgcattttgccctcctttttgattccccgtgtccgatccaatcccttctttgcgtggcgcatgcaggaacgcgccgacggcaacgtgcgccagcacgcacacctgcggcacccacctgtctcaaccacgctgcgcccgctggcgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccccgctgccgccatggagctcgcacccgcccagctcgtgccgaactcgccgacgcctcccccacacacgcggccgcggtaggcgacccctccccccgggcatggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaagctctcctctagttccctccgccgcctgccaactgctgccacattcgcccgtcgctgctccgctcgcaccccgccgccgcgcttgccctccaccgttccgcccgccgcccattcgtcaagaaggatttgaggtccacgacggcgcggcgtcctgatcttcgagctcgtccgccgctcgcttcgtcccctctaatactgcgtcgttggcaatcatgcgtcgcttcgtcgaggtccacgatagcggcgacggaggacgctgatgttggcgaggcgaggccggagaacgtgacaagcgaggcggtgcagccgtggtgtgcgactaggcgccgcaacagctcagccatcggtatgacatggccagcgaaggggctgacgatgaggatgacgtgcggcggcggtgggcgatgtgacgacggaggcagctgagggatttgggggttctttttggtgcccagggctctactgaatgcaatgtagatggtcagcttcggtcaaaccgggtttggaccttaatgagtcacttaaacaaaatggtggacctagatgtgcaatttacaagattatgtacctaagtgacacccgcgcacaactttaaggaccggccgtgtattttactaaaaagaaatattaagcgacaagtgagacgtatattcacaacattcgacggttgcaacggggccaaattctacacggagctttgtattaatttttgggaacttttggagtagttgcctttcgtcgtgggtgctgctggctctcctcgaaattcaccaagcaaaatgtcaagaattacacgtgcagaggatcaggtccaaagggcagatgttactacggtatttgcccactatcagaagggacaagtgatgtatatgttaattctttaataattattagttagccttattagttagcctcatcgagtaatttttggtgatcatagtgccttggagatgtttttgtttgtcattgattaggatgatttaatttgtcgctccaatgttatgtgcccctacggatcaatctctctgtaattgtttttctgaatttgggtgcatctatcagtttatcatatcttcaacctcgatgtcatcaattttgtaatttttgtcgatggccatgatctcttccagtattgatgcacaaattagttgagaacagaaaaatgtttggaatgaatgaacaagcatgaattactaggctccactgtaccagtccaggtcaccaccgattgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgctacagtgcagaactgcgccggcgaactagggttcaccaatccacccaaatccaccttcgaaaagtacatcaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcattgggtggcggccagcgtgcggtgaggcttttccgacccctgatacacatgagatcgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgtttgtgaagcctttttagggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatacttggaactctcttccaatcggagatgaagcagtacaagccttggagttgttggatcgtatgttaaatcttaaagaacaaggattacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaggcatcttgttcaggaatatgcattgatgaagtcagatccaccagtcactcatcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgtaccatgcccaggaaaaaactggctggccgtgcaatgccaaagatcagaacatcttccaggtatcagacctctcagtatgattccgcttcggaatgttttccgatgaaaataatgctgaatattgaaagaacactctgcaggaaaccatctgatatagatccatctgggaaagaccccgatcctgccatgacagagcaaaatatatccaaggaccccgagccgactgctgaaaaccagccgactgctgaaagccagccgactggcgcccatacttcgggcgataggaccaatccgagtgacctgccgccgactggaaaccagtcggcaacaactgaaacggcaacaactcaagagcccccgactggaaatcagtcggatgcaggtcctgatcaagagatccccgaagtagaagcgcagacgacgacttcgcaaggaccagaggctggtaacgactcgataatcgggtctccaaataaagaacaaagatcacctcacgctcagctaggtacatcttcaggttagttgtcttctcaaacaatggcgatttaaataacctcagtttatccgtctaacgtcttggaaacacatcaggaccatcaggtgatgacggagaggaaatccctcgcataaaggcaaccgacgactctcgtcctcctatcttgatcaaatggtgggacgagaactcacaagccgccggtatagtcataaaccgtcaaaaagaagatgaagaagtgtgccagctgaagaaagcgctcggagaagccactcgtattgtaaatgtaagtcctccgggtgacggccttcggtaactttgttttctttttagcagaacctaaccgtgaaccactatgcagagaatccatcttcgcaatgaggccaaaaccgcaactttagaaaggctggttcctcatttgggaactcttgaagcggttagggaccagctacatgaggccaaggagcacgccaagaagacggagaaggaattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccggcaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaggaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaagg

SEQ ID NO: 7840 - DNA, 835 bp, Oryza sativa
  unsure (1)..(835): unsure at all n locations
ccggaggcggcgaggnagatggcgtgggagcagctgcacgacgactgacgagccgccctccgtgcgttcggcatgggcctcatcatgggtggcgacctcctctgcaccgagctggagtaagccatcccgcgggtggtgtacgaccatagccccggtggcggtgncggtggcgatggcgcgggagagaccgtcgcctccgtgccgcccgcctgctgccgcccaccgcccgcctgctgccgcgcgcaagagagagagaggaagagttagagagagaggaagatgagagagaggaggtgagagagattcggtggccggtgcgatgagatccacgccggcggccgctctccatggcctctagccttgagctccgccgcccacaccccttctgccctctctcactctctcgtataatcagaataggtgcctgactggtagggcccaccatttttattattgttatttccatgttggactgccacatcaatcaaactagtgccacgtgtgcgccacgtcaaaccaaaaccaccccggattgacttaggggggtaatttggccggtttgaaaattttggggtgtaaaataactggttttagagtctaagagggtaattcgaacgacccaaatagttcaggggggtaaaacgtacttttccttaaggaagataaataagtagagagaaggacagtgggctatagatttatagccagctgtagcacggactccaagacgcagtgtgtgtatgataggtgggaccaggtattaatagtgtagtatataactattgtataaatgagctattaaattggctatagataaattggagctagcgattgg

SEQ ID NO: 7841 - DNA, 20041 bp, Oryza sativa
  unsure (1)..(20041): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgcaaattaaatttgtcaaccaaaagttagagttaaatgtgctgaaaattaatgccattaccagtttacttgtaatttctcaaaaatattttagtgaactcatccgtccaaaattgatattaattcaatcaatattccagtttaggtcatgtcaaatccgagcccaatttaagcccacccaattaagcccggttaagtcgatcgagcttggcgaaaattaagagcatgtgtaacagtgcaagcaggacagccagggcaggcaaacccaatccccagaaattccaaggaagcttcttaatcaggcatgcaaagccgcaattagaccctggcttaacggttaattcacacacacaatactagtatacatttctgtccaagttaacaacaattagcagcactggccctgcagcaagcagcaacgggctaatagctagaatagctatagctcttcattaaaagtgtcccacatggcatggactcgatcgacgcacacggtgccggcagattccccaattcttcccaagctttttttaacccaagatcacacctccattgccaagaaatttaatgcccaaatcaggtcaaaacttgcagccacagctagtgtactactctcccagcataaaataatagtaattaagaacaagccaagccagctactacactgtgttagctactcctaaccagtgcaaagtgttagtgttaatctctctataaaaccctactagtggcctacctgatgccttactctggagtctagagtctggagcttgtagtgcagcagctagctagcatcagcagcagaagaaaaagaagaagatcaaagtagcaattggtgtgtacaccctagtgctacttctactactactgatcaactggtagctagtactactctccactgtatctctactatcctcaaatcagctagccactgagtgagctgatctctagacaccagagtgagtgctactagctcttgtgtttgtgtgtttgtgtgtgtgcaactgtgcattggtctcctccaaggcagtctagtctgcacctttcttggatctgaagctcataggcaccttaattagccagggagagtaccattttcttggttctctcatcatcagggtcacagaacaaagaattacagggtgagtagtactgttcatatttgatggttgattggttggttctgccaaaattattcatcttgttgtgttttgtttgtagtagtgtttttagctcatttgatttatctttttttgtttgttgacaggtgagtgagtgagtgagtgagtgagtgagtttgttcatcagaggtaagactgagaaattgaagttaaatcagcagcaacagcaacactgcactgaaaagcacaagatcttgtacctgagggggcaagagggcagcaagcaagggtaacctaaggaggaagcaacctcacatggtgagttgctggaaccaagcctagcaagctgcactttccaacggctagctcatcgtcggcttctccggcgccgcgacacggacaccgaggcgacggcggcggccgcagaggaagagttagctagctcgagctaggtgaggcagccatggcgcctcctccgaacacgtacttcgagtctcggtggggtggcaaggaggagcggggcacgccggtggtggtgaagatggacaacccctactcgctggtggagatcgacgggcccggcatgggcggccccgtcggagaaggcgcgggggaagaacgcgaagcagctcacgtgggtgctcctcctccgcgcgcaccgcgccgtgggctgcgtggcgtggctcgccgcggggttctgggcggtcctgggcgccgtgaaccgccgcgtccgccgcagccgcgacgccgacgcggagcccgacgccgaggcctccgggcgcggccgcgccatgctccgcttcctccgcggcttcctcctcctctccctcgccatgctcgccttcgagacggtggcccacctcaagggctggcacttcccccgctcggcggcggggctcccagagaagtacctccggcggctgcccgagcacctgcagcacctcccggagcacctccgccgccacctgccggagcacctccggatgccggagaaggaggagatcgaggggtggctccaccgcgcctacgtggcgtggctcgccttccgcatcgactacatcgcctgggccatccagaagctctccggcttctgcatcgccctcttcatggtccaatccgtcgaccgcctcgtcctctgcctcggctgcttctggatcaagctccgcggcatcaagcccgtcgccgacacctccatctccaacgacgacatcgaggccaccgccggtgacggcggcggctacttccccatggtgctcatccagatgccaatgtgcaacgagaaagaggtaatcaattatattgacaatgttttaaatagcgagctaaggcatttagcggttagcttctcaaacagctatagcgacagctgtagcaggctaaatggagctatagcggctaaattgtacataagaacaaatagctagaacccttctaaaacagctatagcgggagatttaaaaccctatgtacactacatattgatatggagttgtttccgagcatatgattatgaaattaatgttgtgttgcaggtgtatgagacgtcgatatcgcatgtgtgccagatcgactggccgcgggagaggatgctggtgcaagtgctggacgactcggacgacgagacgtgccagatgctgatcaaggcggaggtgaccaagtggagccagcgcggcgtcaacatcatctaccgccaccgcctcaaccgcaccggttacaaggccggcaacctcaagtccgccatgagctgcgactacgtccgcgactacgagttcgtcgccatcttcgacgctgacttccagcctaaccccgacttcctcaagctcaccgtcccacacttcaaggtaatatacataccccttcattctaaagaaaagtccaatcctatcattgaatctggacgtagctagagtttgtctttttttttttagacagagtagtaaatagtacatgtcacactcttcatcttctttaagcaatatatatgtggagatttcgttgagcaactgaaatcatccgatttctgcaacaaaccgtacactgattgagtaatatcgaaacactcttctgcaccctgtttataaattgatactagctagtctaatagtatatgtgccaaatgtgcatatatataagtatatgtccaatgggattgaaagatgtgtgccttcagttccaagtctcagatctcaatggccagaggattgcattactataagttagccagtgttgaatcgcgggtagaaatattccctaagagctcgagatcagtatagtatacaaatgtgttgagattatgctttggtattagagcctaataaaagccatggcgacttacaaggtctgtaataaacctctgcctaattaattagttagtgattatttataatagtactactactaacaacatgttaagaggggtatactatttggactttggacatgcaagtaataagcgtttctgcagttagggcatgcatgcatggaccatgtaagtccaaatcatagattcggtacagtagttgacctccaaagattggctctccttttgactaaactgatgcgtgcgttcacattactatacatgttgcacaactgccgaatctagcgatacagtagtctcatctttagaataaacttaacttcatgatgcaaaatatgggacccatcagtcagtgagacacattatcacaatccattaatataaagggtctcttatgtttcattaattttatgcatggattatacatttttagaccgttttagatcggagatctacaagtcgcgaaagatgaggctaatacatatcgaatcccaaggtcaatggaatcattttgtgatttaatttgcttcttctagaataaccaattaattaattaattaattaacaagcggataattaggtcaaacatgttggagatcgatcaatcaaacaaactaaactaaatcgaaatgaaattttgtgtacgtattacaatagggaaacccggagctagggctggtgcaggcgcggtggagcttcgtgaacaaggacgagaacctgctgacccggctgcagaacataaacctgtgcttccacttcgaggtggagcagcaggtgaatggcgtctacctcagcttcttcgggttcaacggcaccgccggcgtgtggcgcatcaaggccctcgaggactccggcggctggatggagcggaccaccgtcgaggacatggacatcgccgtccgcgcccacctcaacggctggaagttcatcttcctcaacgacgtcaaggtatgtatgttaaccatgcatccagccatccacatgtccatgctccatggttgtttaatcagggttttaaatctccgtctaaaaagtgttttagctatttactctcatgtaaaatttaattgctatagctgtatttatttagcccgctatagttatttgagaaggccaaccactaaatatcttagcctgctatttaaaacattggctatggctactatgattgaacgatgccatttgttgcattcttgtattattctaggtcctctgtgagctgccggagtcgtaccaggcttaccggaagcagcagcaccggtggcactccggccccatgcagctcttccgtctctgcctcccggccgtcttcaagtccaaggtaataacctcatcgacgccggcgcgccggccgccgccattgctaatgagatgaggatgatctcgagctaattcagctctgacactatattatatgatatttgcagatctcgacgtggaagaaggcgaacctggttatgctgttcttcctgctgcggaagctgatcctgccattctactcgttcacgctcttctgcgtgatcctgccgctgaccatgttcgtgccggaggcggagctgccgatctgggtgatctgctacgtgccggtgatcatgtcggtgctcaacatcctgccggcgcccaagtcgttccccttcgtcatcccttacctcctcttcgagaacaccatgtccgtcaccaagttcaacgccatggtctccggcctcttccagctggggagctcctacgagtgggtcgtcaccaagaaggccggcaggacctcgtcggagtccgacatcctcgccctcgccgaggccgccgacgccgacgcccggccgccaccggccaagctccaccgcggcgtcttcgagggcggcctcaaggagtgggccaagctgcacaaggagcaggaggacgccacggcggcggcgtcggcgcaggcggcaccggggacaccggtgaagaagagcaaggcggcgaaggctccgaaccggatcttcaagaaggagctcgcgctggcgttcctcctcctcaccgccgccacgcgcagcttgctctcggcgcaggggctgcacttctacttcctcctcttccagggcgtcaccttcctcgccgtcggcctcgacctcatcggcgagcaggtcagctagcgaccaccaccacaataaagaaaaaaaagccaccgccgccgccgctgccgccgccatgcgtgcacagcgcgccggctggctggccggaggcgaagacgacgacggccagccaagacacttccatggatcgacagaggattacatttttagccttcttctccttatttttatccctttgatatattttttgttcagagataaaaaaaacagagtgcgtctccatgttacaaagaactcttcttttctttgtgctttaattagctagtgctttgttgctaggagaggcaagcaggccgcatcaggttgttaattacattcagattaagttgtgtcaattcagtagccacatcttgctaatttgccacattatgttatgatcaacatggtgatattttgtaacagatactgtactacatatcaatggataaatcaaatcttgtatgcaagtttaaagtgttcatcaatatctgtgcttgatgttggacgaaattgctatttaggctgtgtgttcggaggtgggtattgggaacctatttcccatgcacagaaaacggagcggtccattagcacatgattaattaagtattagctatttttttaaaaaaaaaggattaatatgatttttttaaacaacttttgtatataatttttttatataaaaaacgcaccgtttagcagtttgaaaagcgtgcgcgtggaaaatgagaggtgagtgttgggaacttgctcttgcaaccttagcgcagctgcgttcccaccgcacaagttttcaggttttgagttaaactttttttctaattcaagatgaaagtttgcacaactgaaagtttcttataattctaagttaaaagttgtatgatttaatttggttgaaagtttcatatggaagtgctattaaaaggaaaaatagtgtgcgctctaattagcaatcacttgtattgaatgatttatttattataaggcaaaaggcctgtccccaatagtatggagtagtacgacggagtagtagagttgagctgaaatcagttgggctgaggacgcacgcatggtgagcccaactttgtgcatatccagcccaaaactaggccacaaatggaccaattgcataatgacataagacaacaaattccaacaggccagaatcaacattcaaagcccattacattcatgttgcagcctgcaacagtagcgtaacaactcatctttctgccaagcagtgggctgggaaggagtacttctaggggaataagttcaccagagctccctcaacttaacagcgagattttttgaggtccctaaaccacaaaaccagaaatgttaatcccttaacttactcaaaccatgcaaaggaggtcccatggtagtatttacacctgattttgctgacgtggcatcctagtcagcaaaaaataaaaaaataaatatgcggggcccacatgtaagtgagagaaaatggtgtaggcccacatatctcctttcttttatttttctcttctcttctctcctctcgagctggcgcgatggcagactcgggcgtgaggcgaccggcagcagagctagggcggcgacagcgggagagggggagaaagacggccggtgcgatggcaagctcggcagcggagagtagcggcgcacggcgcggcggcaggggagaggagcggcaggagagggggcgccggcggtagaagctacttctgatatgtgccacccctgctgtcgccgccgcagccgagcatttggagcacctacctccgcgtggcgcccgcagcgagcaccagggagacctgaacggcaggggcagacacggccgcgttcccggtccccgccgtggcgaggatgcgccccgcgagtggctggcagaaggtgcgctgcgccgcggctagctgctaccgccggtgtggccgacttgttcttcctcttcgtcctcctaccccttctgctcctcctcttcctcttcctcctcacgccagttgcccttgccgcgctcgcggcggcgctcctcgctctcaccgccgcggccaccgggcgacatgtgcgggaacatgtgcgggtacacgatctcgggctccccctcgccatctaggacatacgcgaccttgaccgaccgggtgttgtagaatggcgcgttcatggatccctgcaatacaacgcaacgaaaccacgcgatcatataccaatcaatccaatgcgcantgaggcgagggtgcatggcgaggcgcgtggacgacgacgcaaacacaccgcggtgatgttgacaacggcgacgcgaatgtcatgctcggcgaggtcgaggaagctgcgggtgttggcctcatagaggcggccgtggcggttggctaacctaggcctctgatccaggatgttgaagggaccgcacgacgactcgccaaatggcagcagcggctagtgctgtccatagccgccctccgacacgtagtgaccgacggagtagagtggagtggcggcggcggaaaccttgtctccctccgtgctcgtccgtttccgcctgcctgctccgcccgctgccccacccgcccaccggcctcttaggctcggggaggaagaaaagaagagggaggaagaagagaagaggagacgataggacaaagaaaagagaagaagaaaaaagaaaaagaaaagaggagaagagaggacgctgacatgtgggtcccaccatatgccacgtcagtgaaaccgtagaaaaattaggtcaatactgcctagggacctttttttttacacggttttttatagtttagggggtggagatttctggttttgtggttaatggacctcaaaaaatctcgctgttaagtttagggacccctggtgaacttattcctacttctaggcgatgcaggcatgctgggcttttacctagcaggctgcagacgtcatcggggataagctgggctggccaggggcagctggaagccgctttgctgatattaggccggcccgatatcctaattagctttgtgtccctaaattatgggcaagtctgttttgtctccctgaaccacaaaccagatgttttatttcaccggttcattttgtgtccctagcagtttagactacgttttagtgtcggcgtatattggggtgtgcctatgatcgctcggagtgatcaccccctattcaccccccccccccaatacgctcctctctctcttcttcctcaccttattctcttcctactacaccataaattttaaaaaaaataaaaaataaagttggaaaaaattatgtatagaaatactatatgtaaaaaatatttaaattcaaatttaaattgaaagggatatataaacttttgacttataaactttaggtctataaactttaggtgtataaactttaaatgcatagaactactatatataaaaaatatttgaattcaaattcaaatttgaatctgatatataaacttttgacttatatttggatctctaaactttagatgtgtaaacttgaggtgtataaactttaggtgcataaatttattaaaatagaaaagtaatacggtgccaaaaaagaaaaccacgtggaggaggggaagttgatcgctccaagtgatccatcgccctttagcctttttgcgtctatttggcacattaacctgttcttcagttcacttcagaaaaaaaaaaacaattggacgcaagtgtcatcctctctctctgttgacaaaaaaatcgaacacatcggcctgggagatctgcttagctcctatgtaggtccaaatattgatgagatgcgggcgtgccagtcagtttgatcctgcaactgacaagatatgcaaatagtagatcaaaacagtcgatcggctgataagccgatggagtagttccagccgatgccgataatagccgatgccgataccagccgatagcgatagggtgtaagcaatcggctatatgtccaatgtagatgatgatataaaggcaatcggctgttgataataaaatataacaataatatagttcagtataaaccaatcggcagataatgatatgataaataagcatcgatccgaaggttaaagcacaaatcggctggaggtccgatgtcatgaaatttacaagattagattaaacaatgaaacctttgttgtcatcggctaaatccaacctatatgtatatgcaatccttatgagtcgatgcaacgtccagataactcaccggctgaaaccccgatgaaacccttattggcaatcaaaagcaggctagagattatggttctaagcacgacttagtagatcaaacttaactgatgcagcactaagtatgaaaagaaacataatatctagacaatcaagccattgattgtgttttcagggtggtagatgtctaagctaatctaatctagcaaagcgatttagccgataccggcagaaaccctaaaacgagaagcagccgatagtgctaaattgatatgctaagactagactaacagagacatatgataaataggtagacaaatatatcatccaaatcagagcaatccaagaggtcgaatgtattgatgcaacctttaacgacaccgatgtagatgagacaattgcctgggccggcagaacattggacttatcccttcgccagagatcgaagacgatgcagccccgcatcgggtgccaagttccgccggaacgtaaaaacaaaagtagaaaaggtaaaaggtggcgatgcgccgaattgtattgatcgtgaagatcgattacatagaccccgggtgtacatatttatacccatgggttgatacaagtccttgtcggacaagaaagaaactttcctaaagataaaaggaaaacataaagtccttatcggacactaaacacaaaggaagctaacaaactattcctaattaatagataaactaccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacactctcactcttctagtgggacccatatgcaagtgaccacgtcatcttcttttctctatgcccttttaactctctccctcctctcttctctcttccctacattagcgccgcagtagcaacaccgacctctagcaccgtcagcaactccatcctcaccactactgcataacaccttaaaggtgccagttgcaaaactggcatacatgtcggtttcacatccgacaccaatgacattagatcattggttaatgtcattggtgacggttatagaaccaacacctttgtgctctctccaaaaatttttttaaagaaagagaagccggctcgaagcattggctcattgagccggtgctttcgagcgtcctcctacaagcagcccctaatcccatacatcaatatcacatattaaccacaataatccctatcctcatccatcaaagaccacagatcaacaacagcaatcctcatccccaaccatcgcagatcacagattaacaacaataatcctcatccctatccatcacaggtcaacactagtaagatgaagaactacacaagatgaagaactacccaagcagtcgcggagccaaggcccggccagcacgggcaggtgcccgggctccgccgcatatgcatcaatgcattagaactaactatggtgcctagccattaacctagctgcgtacatgcaccattagattagcactaattatcatacttagtcattagctaataccccaattttacttctatccatgataaaatgctatatgtatttgtgtttacgtgttaatttgttttctatcgttaggtttgcctaggctaaaaaaaaatttctaaatctgacactgtacccaagcaatatgaacccactctctctggatcctataatagatgccgctattttaaagaactggcacctacaatatattataggtacgattttaatttataacaggcaccaatagtcgttcaaaggtgccgatttcatatttttctctctcatggaggtgggaaactgtcaataggtgcccgttttttaaaaactagaacctatgagcaggtacctatgagggttttttaagtagtgcaccactgttggcagtaacgaattaaaaagcagagctaggcggccgcaatgatgtacctggaccatgatgccaagtgtgcgtggccaacactggggaacatttgaccatatcaacgcctctcctctcccaagctcagtcagaaaaaagaacagatcgacgtcatcgttggagagaggttccaattctagctctatgacatccactacggcaggaagggagcaggagaggagggcagccacgaccgctcaggaagaggtggagtggagcttgataggggaagggggtgtggaagaaaacaccgagagggtggtgacctcgcaagatccactagtgcataaggcatcgtctactccgccccgtcgatcttcctcccatggtgagccggcatggagagttggaggtcgaggtttgtcaaggcgaggatgggtcctttcgacaacgacgcaaggagaaccaattggtgctaagctcgaccccaagcagccacagcgtggaagcaggacgcaactgtctagatggcaagtggaggcgagcctctatgccaggccttccacctcatcggcggacaatcattgattcctcccttggtcaacattgaagagatgaggacaaggaagctaaggtgttcatgacaagtcaacgaggttccctctaacttaagtcaaaaggacgtgtgttcgtgacgtgtggttccatgagggtgggtcccacttatcagggatccatgtccctcttatttaagttaacgtagttttaatttaaggtacctttgtctactactatcagtctagcaccttgacgttggtaaggtagaatgaaatttacagtaaaaaaagtaaattttgtaaagctacaaatattttaactacgtaaaataataagatttataaggtgttgaatcacaaaattacagatttgatactaaaattatcataaaactacaaatttaaaactaagtatcacataactacagatttagtaacaaaaatatcacaaaactataattttagtaacaaaattatcacaaactataagtttagcaccaaattaatcgtaaaactaaacatttatagctaacataatagtagtgctaggaatttaagctataaatagtagttttgtgataatttcaatattaaaactgtagtttttgtgatattcagctctaaattcatagttttgtaacaattttagtgtgaaatatgtagttttataacgattttttgtgcggaatatgtagttttgtaaagctataaaatagtagttttgtgataatttcaatgttaaaactgtagtttttgtgatactcagctttaaatccatagttttgtaacaattttagtgcggaatatgtagttttgtaatagttttataggttttgtaatagtttggttaaaatacctgtactttgtcaaaattactttaaaaatagatcatcaagcaagtgcttagtcatagtggaatgtgggaactaatctatactgcaatccttcagatccgctgtcgcgtgggacccacctgtcatccctaagaaagaaaccgcaccgcgtgcacccaaaaaaaaaaggaaatgctgcgaaaaacaaataacgcgcacgcccgccggacctaacccacgccgtgccggccgccagacgccactgctccgcccgcctgaattcaccgccgccgccctcccccacgccgccatctccacggccctcccacgccaccgaagccacgccgccgcgccgcccgcctcacctcaccgctgagccgcacttccccccgctgcctcctcaactcctcgccgccggccggtaccctactccgcttgcaaccgtcgccatcggagccgtggatccgtcgccgccctgaatttcacctgcatccgcccgcttgtgacgtgtttgattttttttttgtccccggtgattcgattcaaattcaatctgatcctttgttggttttgattttttttgtgttctatatgttgttccctgtggtcgtcctttcgccgtgttcggttgttgcaggagcggatttgattggaagttcccaagtcgaggtctcaaggaagaggtcagtttcccgtctacagtccggtcgtttgatttagtcacttgggtcggtgattgatttcagatttgagtggttgattacaaccttcaatcgatggatggatgatcatcggtttctatcagtccttacacgaggtgattcgataccctgggttgattgttatttgtaaccgctgatctggcttgtggtatgtgtttgtgctcctctagatgatgcaggaaggagagtgcctgttgagatgaaccgaattggtggaggtttgattattatggtccaggttcatggttgctttgattattagttagattcatgatgaataggggtggtggaggtttgcttgttatggttcatggttcttttgattagttcatgatggttttgaaattattctgacacgaaagtttgtggtgccgtgacaaccctcactggatttcctttggtcagatcctcaaaatgtgcagatttctaagtggtttcgagatagatgtacgagagattgtcagatggaatagcaatgctttgtttggattctgacccccccccccccgcgcgatttgatttatgcctgaaaagtctgatttgggccgttggttgttcttcagaattgttggagttgcatctcatggtgagtcctatttgctgcatgaattggaatcatacatacaggccgctggcagttctttttgtgtgatcaacaattccccttaatcaaattttccatgtttttcgtcagtaattcttagttcttgcagatagcacataacaaagatggaatttgcaacccaaacctgcctcggtctacgagctcaagacaggctttatccctatgcactcaatctttaattcatgttttctgtacttaggctactttcttccaaaataatattcttgctctctgtaggtctctgaataggagtaatttttttatggcccgtctcagtgaagcacaccaccattttctcttcaattcgtcattagaagttaaatacttacaaagttgaatttcttcccaaataaatgttctcttgcttattgcaggcctatctcataattttgcaagaccaaccttcaccgagtgaaatctttaaatcaccgccattctcttcaattcatcattagaagttaaatacctcacaaagatatatttaaatccaatctattactcactacaggtttctacataatttctatggccaatctgagtgaatcctttaaatcatctcccctttctcttcaatttatcatcagaagttaattgcttgcaaagttgaatttcttctcgaatatttgatgattctgaacaaaatctgctcgaaagttgccacaaatggtctgagagaatagtgaaataagaagaaagtaattggccgaaagaaagctctgcattcgatgtacacctcaaaataatttgagtttttgccgttccatatgaattcattgttagctgcaagtttctatactagatgaacaattcttacatgtgtgcggagtgcactaaatttcccctgaactcccctgattcacaagcatttttaatagataaataccagcacttttatgcatgtgctgcttccttcggtgttatgtatatattaaacttagaagaatttcttctacacaatacagttgaccttttattggttcatgtaaaatttaattgttctgtttgtttctttacagggaagctatgaaattatgagaagtagcatgcctaagttgactctcttctgcttgatatgatgtcctgaacatgcattgttcaggtgagcatagttatctatattgagatcccttccgcatcgtgatcgcgtccggcccacaccccggtcatggccattctgtcctctaaaccttccagataaacaatttaagtacgtctccactggtatattttggtattcatttttggatttttttttctcttgtcttttagaacttgccaattttgttgtttctcaggaaatagttaaatgagtattttggctttgctgtttatcactacctaggaagacatgtcatgatttcttttgcttatccaaagtgtcaaacattttattttattagatcctatgctaaactatgtaactgctgctgatatcattttgtaattaatactctgcattttgtctacatgattttgaatcgaggcagcaggagcaaaacagctttgttcgaaggactcaatgctaggaatagcatggggttaaggcattgaatattcctctcccatgctctggaccgtttttctgttggcggtctaagtcaggcattgctccagtattagcttttggatggctttaattttattttgtgaaatttgaatctgataaaagtacatgaataaaaacttatgttatttcttatttcatcattgtaaactatgagatcaatctagccccaggaggtgtttgacaatatttgaatgtttattgaatcaactacctcttggatatgggatcgtctgagaaaaatgtgtgttcaatgatctatatagattctctccacttctggggctacagtattgagcttgttatgaaaatcaaagcttgaatttccataaagaatcataaaaaaagccacttaaagcatgttgtataatatccaaggtactttagttattcactggaagggatcaaggtaatataaagccacggttttgtatactatacctggcacttctgatatagggaatagttttcacttttagggaactaccgataaatatgtttatttttccaaattatcacacctttttttcctggaccatttatctttcctatgctaatataattatttggaaagtctcgcaatcgtattatcttttctctgataatatttcttttatatatttcacaaggttgcatagctgaaaatttgcagcccaaacatttcttctttaaatggcatcccataattaaatgttaaactgtttcttgctaacttatgtatttttcgagcttgcatggtgaaccatcaattctgaattatttgtacttgtctgttttgtcaattgacattcaagcaaccaacaagcacctgaagctatcctgatatacaaaccctgtgtggtctatctataaatgccgatattctttttatttgtttgaatctttagatagataatacgcctaccacaacgttttcttgaatgtgtatacattgggaactagcatgtatacttaaaatcaacaacaagaatgtatgttaatccatacataaatatatctatctggattggatgtagccaatctgtacatgtactaaatttaaaatagcgacggataataatgattcttccataggagtgtccatgacattaaaaatgccattgaagaggcaaatgaacacacaaaatattaggcaaataaaaagggatttgcaacaccaattggcactcctaatgcttaacatgacttttgtgcacgatctacataacaaaaacttttatatatgtctatccgtgacgtgccttgcacgtgcacgctcactagtaataaaaatggaccagctgtggaggaaaactaaggtgaaattttttatctttttagatcaaagaacatggtatatgtggacaacataacactacctgatgtcaaagaaaaaacataaccctgtgtatgttaatctgtatagctgaggcatccaccagagcatgcatgtgcagtatattattggttgaatttggaaaactagaatacgcaccatataacatatatcggtcaacattatcataatccccaaataaaaaagataactttaacaacaaaaaagatgcatctggcatgcagctactaaatccaaatgaacaaaattcatatctcccaaacaattttggtcaaaatggattaaaaactcaagacgatgtcaagaaatgaaaaaaaaatcgacatgctgcatctgcctatttaaagctcaagaacattcagaagaatggcggcgaaaccaaacacaacaatcgcatgatcagctagagatcgaaacagagaaagaccgtgacccatggcgagcggcggcggcggcgtgaggctgaaggccgggacgcggccgccgtgggtggggctagcggcggcggtgtgggtgcagatggcggcggggaacgcgtacacgttcccgctctactcgccggcgatcaaggcggcgctggggtacacgcagcagcagctcgccgtgctgggcgtcgccaaggacgtcggcgagaacttcggcgtcgtcgccggcgtgctctgcaacagcttcccgccctgggtggtgctgctcgtcggcgcggccttctgcttcgtcggctacggcgcgctctggctcgccgtcagtggcgccgtcgtcgccatgccgtactgtttggtaagcactcatctgattccaaccagaattcaatctttggtattttcaaaacttgtattgggatgctgatatggcgatattttcaaaactttggtccaaaattttaaacaaaatttagtaacaaatattaccaaaattcatgaaaaattaaaaattttggccgaaataatatcatatcgaggatggtgatatgaccgaaatttcagaccctgattccaactccatcaggttaaactacatgaaatagtttctttaaatgatttttcgagaaatattaatcactcttattttctatagcaagtttataaaaataagactatataagtacaaacgaaactattttagcaaatctagccataccatttttaactattaaaaataattctccgttttatattataagatgttttatttttttaaaaaaaattatttgagtatgattaaatttataaagaaatgtaggaaacaaatatactatcaaactatagtcaatatattagatttaatgaaactaatttaatttaatgatataaagagtaaatcatcaatttttctatgatcaaatcttttaccttaacaaaatctcaattaagtgcaacaaaggttgtattaattccgatgctattgatgacatcacataacagctatggattgtgctagcaatggcaacaaacagcaacgcgtggttcctgacagccgtgctggtgaccaacatgcgcaacttcccgctccgccgcggcgtcgtcgccggcctcctcaagggctacatcggcgtcagcgccgccctcttcacccaggtcttctccggcgtgctccaccgctcgccgacgagccttctcctcctcctcgccaccggcctccccaccatatgcctcgccaccatgtacttcgtcaggccctgcacgccggcgacgctcgacgccgccacaaccgacgccgacaccgaggaagacggccatttcgccttcacccaagccgtgagcgtcgtcctcgccgtctacctcgtgacaaccaccgtcctcgcaacgccatcaaactctccgatgcaaccagctacacgcttttcatcgtcaccgtgcttctgcttcttgcgccgctcgcgatcccggtgaagatgacattgttcaggagttcgccgcggcggcggagtacagaaacaacggaggagccattgctgatcccgccacatgtggtcgtcgacagcggcggcgatggcgacgaggaggaatctgacaaggtggatttgctgctagcggaagggaagggggcggtggtgaggaggacgaagaggcggcggccgaggagaggggaggacttcgagttcagtgaggcgcttgtcaaggctgatttctggctgctgttcgttggatacttcattggagttggaacgggtgtcaccgtgctgaacaatctggcacagattggtgttgctgctggtattggtgacactacggttttgttgtccctgtttgcgcttggtaacttctttggccgccttggtggaggtgcaatttcagagaaatttgtcaggtatgtgtgttatatggaaaaaaatagctaatttttagaaaattttgttgaaaagagaccgaaatttttatagagttattggcctgtgcattgtaacggtttttttattcggtttagtaaaaaggatttggacagagtgggttgattggtcttctatactatggttgggtttttaagaaatcggttttataagatggaagtattttta

SEQ ID NO: 7842 - DNA, 1173 bp, Oryza sativa
  unsure (1)..(1173): unsure at all n locations
nnnnnnnnnnnnnnnnnnnnnnnnnnnnnnnnnnnnnnnnnnnnnnnnnnnnnnnnnaaatcggttttataagatggaagtatttttagaggatgaagtgcgggagaggaatggaaggtcttttttttttaagtagttgagaaaatcagaacagtccaaatatttattaccaattcttttttaaagaagtgttattctgttctgtggttaggtcgacattgttggttcctaggccaatatggatggcgttgacgcaaaccgtcctcgtcgtcgcttacctctgtttggcctatactctcggcccagccgtcgcctacgcttgcacggccaccgttggcctttgctacggcgtgcaattctcagtgatgattccaacgacctcagagctgttcgggctcaagaacttcggcctcttctacaacctcatgtccctggcgaacccgctcggcgcagcgctcttctccggtgagctcactggtcgactatacgacgaggaggccgcgaggcaacaacattctggtggtgtgtgccttggcccaggatgcttcagggccgcgttcgtggtgctcgccggtgcctgctcggtggggacggcggtgagcttggtattggcggcaaggatacagccggtttacatggctctctactctggcgggtcgttcaggttgcctaacgcgtcacagcaacattgagctttgcatttctttgaattgagttgttgttgcatgtcacgcgcgcgttacattaaattttggataattggattgctagcttggtttgtgaatattgatgacatgcatattattgaaaatggtttatgatatgtgaacaagggatttactagtttggtttttgggatcttttttttatgctggtgaagttttaagtttgtgagtattaccttatagataataagaagagtgttctatatgaaattacgaaattcgctagtatgtcacaaagtttagtggcgtactcacttttaccacaaagttgacgattattgcagattattcataaagttgagtgggaatgccatatcatcctttaagtactagaattactctcgtcttcttctccatcttctttctatctatcccctctcgttctcaactcttgcggaaaaaaaaccaccactactcccatatcatcctcaactcctacggcattgcc

SEQ ID NO: 7843 - DNA, 1166 bp, Oryza sativa
  unsure (1)..(1166): unsure at all n locations
nnnnnnnnnnnnnnnnnnnnnnnnnnnnnnnnnnnnnnnnnnnnnnnnnnnnnnnctcttttagaaactatggcaagtgttctcgtttgggaaaacgaaaactgaagtgaattttggcccagcccaaaccacaaacctaaatcgacaaaacaagtcttaatcaatcacaggccgatctgcgttaacagagaggaaacaaaatcatcccccaaccacaaaaccagatatccgatattccttaactaatcaaaaccggccacaacaggtccttaggtggttttgactccggttttggcctacgtagcggctgagtcagcatgggacccatgtggaccccgcatgtcatgatgccacgtcatctctctttcccctcttctctcccttcctcagatggggcccgcttgtcaagtgtctcttctacctccctccctgtgcgccaacacagagaggagaggaagagtagcgaaggacgacgtggctccagcggccggcggtagggaggtcatcggggcgaggagatccgacgaccggccggaccaggcctgcgcctcccgccgagcccgttcgggctgcccatcctgggccacctccacctgctcacgccgctgccgcaccaggcgctccaccgcctcgccgcgtgccacggcccgctcctttacctccgcctcggctccgtcccctgcgtcgccgcctgctcgccggttgtgatattctgtcatggtaattagcagtagatggacaggcatcagtgacactgccgagtatccataccggttgtgatatactccctccgtttcataacgtaagtcattctagcattttccacattcatattggtgttaatgaatctagacatatatatctatttagattcattaacattaatatgaatgtgagaaatgctataatgacttaaatcgtgaaacggaggaagtagaaatagaataggcggtgatactaatttcaggtaaaacgaaatgaaatcacagtacaattcgcatgacataataaatccattgttgttaattgacagcgctacgctacgcataccatttactctgagcaaatcatacaccaattgattctaacaagttactatactctactctgcaagcaactggttaggaaatgaaaaaaaaaaggaaaaaggaagcaaggatcgaatc

SEQ ID NO: 7844 - DNA, 420 bp, Oryza sativa
atttataccatggcactttaaagccagcatcactgacaatgagcggtgtggtgttactgggtagaatgctcgcaaggtcggctagaaattggtcatgagctttttttgaacattgctctgaaagcgggaacgctttctcataaagagtaacagaacgaccgtgtagtgcgactgaagctcgcaataccataagccgtttttgctcacggtatatcagaccagtcaacaagtacaatgggcatcgtactgcccgaacagataaagctagcatgccaacggtatacagcgagtcgctctttgtggaggtgacgattacctaacaatcggtcgattcgtttgatgttatgttttgttctcgctttggttggaaggtaacggccaagttcggtaagagtgagagttttacagtcaagtaaggcg

SEQ ID NO: 7845 - DNA, 817 bp, Oryza sativa
aggttagattcttggagcacttatcatatttatttgtcaacatgattgattgaaaattggaagacgtgggatgtcggtttccagggtgccaagggggtacagttagtctcgtctagatttcggagtacttgagcaaacatatctatatgaagctctagaatattatgtcgctagtcgttacattatataccaactgacctttacttgataatatacctttaacctttttgacttgtattgaacatgtcacaaaatatgactgtgaatcttccagattttaggaatgctgggtgctttgagaagttaaagttttttgagaaactatattttttatacagcaatgacctagctctggcgtagaggacaaatgcttaacatatcacaaatactctggaacttatttccacatgctaattggcaaagtaaatatgctgttgaagcacataaaataaaaatcaaccttttgttttacccaattaagtttgtgctgttaagttaactatggaaaaactctgttctgctttgcctggttgtactatactcctagtacttcatagtattttgtggttattagttacaaaatattccttaatttgattgaaaattcggaatgttctagtaccttcctggctggtttctttaatttgtttacttcttgctaggctattgggcaagttctttttcttcgtccttatgttaatgacttcagcacagaatgggtcctcacatctgtgacactactgacgcttggatcggtgtttacaactttcattggcgaaagaatatctgatttaaaactcggaaatggaacatctct

SEQ ID NO: 7846 - DNA, 1055 bp, Oryza sativa
  unsure (1)..(1055): unsure at all n locations
nnnnnnnnnnnnnnnnnnnnnnnnnnnnnnnnnnnnnnnnnnnnnnnnnnnnnnnnnnnnnntaattattctgttattttttagcaaatgaaataagatcaagcttctaatattttttttcttaacctctctccatcattgggagtcataattgttctaatttccattttatttgattttttatgtcctaccttacaaattaccaaaggaaatattgcttatgacttactatgctaccattatgagcaggtcaatagttctggtgtcatgcctataatattttctacatcttctttggctttgcctggtactttggcacgatttactggcttagagtttcttaaaaaggctgccatatccctaaatccaggaggtaaacaaggagtttctataattcttttgaaatttgttgtctttatatgggagatggcaatgcaatagacattttgtttgcatgtaaatcactttctgttaacttcatgctgcaggtgctttgtatattccaactaatgtactgcttatagcctttttcaattactattacaccttccttcaattggatcctgatgatcttagtgagcaattgaagcggcaaggtgcttcaataccgcttgtacggccagggaaaagtacagctgccttcataaaaacagtgagttattgttcttccattagaataaatattgttctttcaccgcatccgaatttttagtttatgtgcataatgtatatgttcctgctcatcagctcattcttgtccatctgcttggttaattcggtgcaatggttgtctgttacagaaattggcaatggtccttatctttgtgtagttatcaatggaaactgttttcgtagtgacatgatgtattaaagaactccaaaactcaggttgcaatcctctaaagaagtcagtaaccactaaacagtctgttgtctcctctgcagtgttagattcatgtgaggcacacctgttcatgaagatattctgtttnnnnnnnnnnnnnnnnnnnnnnnnnnnnnnnnnnnnnnnnnnnnnnnnnnnnnnnnnnnnnnnn

SEQ ID NO: 7847 - DNA, 14344 bp, Oryza sativa
  unsure (1)..(14344): unsure at all n locations
cagctcattcttgtccatctgcttggttaattcggtgcaatggttgtctgttacagaaattggcaatggtccttatctttgtgtagttatcaatggaaactgttttcgtagtgacatgatgtattaaagaactccaaaactcaggttgcaatcctctaaagaagtcagtaaccactaaacagtctgttgtctcctctgcagtgttagattcatgtgaggcacacctgttcatgaagatattctgttttctttatcataggaaatttggagttgtagtaattgcacaacttatgccaaccagactggttaaactcattcatggctcatatcatcagaaaatatcctagatcctatttataagtatcttgtggtatggccaaatgctagtctttggtggtggtaaggtcatttgctacattcagttggttcagaaccacatacaagagaatttaggatgcaatttatagtcaagactttcatccttctggatttatataaatcatagatattcctatgttggttatgtgattcataaactgtatgatgtaaatatgccatcccttggactggacaacatttccctctgttagcgggcatccttactacttctatctttttgaagatcacagtcagtaacttttttgccagaactgattgctgcgcaagacagtgggacatacagttacatttgatatgttatgcatgtgaggggcaccttttactttcttgctgcgtatcattttggagaaattgaacataaaaatctcaaattcaataagaaatccaatcacaactaaagtatatcaagtactgcaaaccattagcttctatattgtgcactgaaattaaattatctcattgcaggttcttagtaatatatctgtcctaggatctgccttccttgctgttttagctgctggaccatctgtggttgaacaaatcactcacttaacggcatttcggggatttgctggtacatcagtgcttatccttgttggatgtgcaacagacacagctcggaaagttcaggcagaaataatttcacagaaatataagaacattgagttctatgatgtcaaccgttttgaccaatgattaatgacactgatcattcttttcaacttgtaccaaatgttctgttgtattataattgggtcatgtggtagcatttaagactgttcaattttatgcccgttttccttctatcgtgcatatcacttgtatgtttacttgaggagcagaaaccatacatccttatgtacataaatatattagaattatttacctcagaatatgaactttctaccatattgctcagacctcatcagctatagtagaattggctgagtacttaatacatgttgagacgatgagaagcagttatttttgttttacatatgaggctattgcaaactctaatatagctggcatatgcttacttgtggacgtgaccctccccacatttggtagccttttctgcgatacagtatttaataatttaagtgagcactaagataactaagtgaacagttattggcgaatgagagtaaacatccaggaactataattatcatacagaaacgatcaccacttgtataattagtacgttactatttgcatcatttgattatattgaatgcagtttgtgttactctggatgatgatcttcagagaaatcaggttcttcaggtcgctccttctgtgcttttttgaatattgatgctatttttgagacagtaactgtttctctgtgtgatacagtgctagaagaaccattaatgtcctcacatctcgtgtcattgaagtcattgaccaatgagaagaatgacttccacctgttgcttagacctacttctgccattttttgtcgattctggcgccttcgccatgctgattggataaagcgagcggcccatgttctccactggtatgagtgtaacctgaatgtgtgctgcaggtgcttggaatgcatcatcctgaatgtgctggctacgcacttaatgtcatcggcttggagggagaatgcttccaattcggcaattgttttaacagttcttgttgatgatggatagctgtctctagagctgggaagcaatgcccatgtaagcaactcctcaccacaaaaatcacctggttttaggatgatggagttgaagaagccagttctgccaccatctgttgtggagctctctagcttgccacgaataatgaagagcatcaccttgacagggtctccctcacgggttatgtaggtgccttcagtgcgaaggaagtaggtcatgcgttcacagatggcatcgagtagttgatggtccattgcagaaaaaaatggcacctgaaattaaaattgaagggagcatactttagctgatcattattttaggatatatgtttactgtctatcattagtttttgttcatttttgtccttaaacatgaagagtaaggatgagtaaaggtgatgcttgtgattgcagaagatatttgcaggaacaggactcacgtacacgttcgacaagatcaaggcacaggtaccgttttatatctcgatgaagatctgctggtagttgtctcaagattgaatcctcttcaactccctgcgtagcaaaccacttgtatttgaagaattgacnnnnnnnnnnnnnnnnnnnnnnnggtatttgatgatctatcatccaatcttccatttctgtttgccacattctccaatcttcagtatttttagaaagagatctcatgtgtatctgtgaagcatttctttttcttattttgtgtactacataagtatataaagtgttactgaaagtgttttacaagataaattacctgcatgttgcctattagttgtgcaaacaaaccaatgctgagaagggttaaccctattgcaaataggttttcaccaatgaaggaactagtcaccaaaggattgccatacgtgctgtcaccaaaaatatatacaaaataacatttcagtaatctcaaaccatgataagtctgctacaaatattgcaagcagcatgaaagaatttgtaagaacaggtcattatgaggttgatgctagataataattgctttctgggtgtaatgcctttttggagcttgaaaaattgaaaatgcattcagtaagtatcgaaatacgaacgtcaactgttgaagtccccaccacagggagtagaaatatttctcagagaatgaagctgtggtcactccattttgtattgcttgaatgaatatgccatagttgatactgacactattgctgttggcgttacaatgtgtgaacacatttgtgctatttgcccaactttgactgttacttgatgtggcatatttgcagtcaaggaagtgtaaatcacacagtcctttgtgtgccattctgtcctcaatagagcactgtgtttcccagcatgtcttttgtcgatccactgcagttagatagaatattgctccaaccacctggtggaaacatggcacaagtaatggtttaatgagataagttgcaactttttttctataggatgatttatgtttggcatattttccaatcgtttatttgatgaagtgtcttgacttaaaaatgcctagtgaaatattgacgacattaattctagccaggttgtatggggctaaaatttatgttttgaaatgggccatgatcctaaccaaattgtcattttatctgtttgcagcaatatctgctgcaaatatgctcaacgttatttatgtacttataaaatcattatatgacagttgtttttgtaatccaggcgaaataactaacacttacgtgacttgccaccaaataaagaactagactgtagatagctccttcccacccattttttgcgatgaaacccaccatctccatgatactaaggctgagaagaattacgatgtataatctgatggcagattggaccaatattataagaaagaaaggggcattgatatgcttgaagctgatagatggcatggctatccaaacaagaacctgcacatagaaagaaataatttaccagcacaaaaaatatcacacctttttctgattactgctgtactatttccaactttcaaatgaaagagacatacttgtggaactggcaatgcagctactaggtcaatgaagaagtttgttctgatgtatctatttgcaatctttttaggatctgtgacaagctcacccctgccaagcactttggagcttggatcaacatgtgcagtggagaaacttatagcaatatgagctatgaagaatatgtcaagaaaagaccgtagacaagtgagtataatggcgagatgatggtccattgtcatacacaactggcggtctctgcgctcaacaattggcaggaagaagaagagaggatcaatgaagtgagaagcaacgcatgagacgaggaagacacggttccacatcagcacaacattgcctccagggtctagcatactctcttcgcggcttatccagattctggtaaaatcctttaacttgagcactatcttgctgctcattgttttaactgaacctgtggccaagttattctgtctgtgtcttgcttcgttctcaataagattaagcctgcagagtaaaaaaaatcaatgaaaaattatacgacctaagtacaaagaactttacttttttgtttcctggagatgtttatagttacagcaatgttggtcaacatatgattctgcaatcattgtacttaaagactggaggtagttgccagtgacttgacaattggcagtaaattaataatagtcattgagtaactcatgtgttgctacatttgtaatgacctaattgtttataatcaatcttgtcagtactaaaaggtgagtatcaacattttctagtaatccctgattaatgcatttttttttataattaaacggtctcgtgaaatgcattcattccaaacttgtatcagtatattgtcggtctgtggggttactgttttattttccccgctgtgaaaccttaactgtgattataccgtactaatgtactagcccaatgttgtttctctataattcaatgcaaaaacgattcctcataggtcaatctgtctcttttaggctcttctttcttacgctatatccaactgagtcccctcttaactcttgacagtactttgcctaatcttacacttttacaaatgacaagctcatcctagtctctttgctcttggaaattctttaaatgattatacatgagaccttgtatgtatatgatctgttcgataataacacagagattcctatattccttagaagcaccacgaggtgctgaatacgttagtctgtgtagaaaatatacctatccaacgctaagaagtgtagtaccacctcaaacattttttaagctctagtacgatgcagcaaatgaaggtgaactgcgttaaatatatgagatccctatttacacctaactgaagtatcagacagtgataaaattaatgatttaaaaagacaacaaaacctcattaaaattaatgttcaaggtgaagaaaacagaattatcggtaggaaaataacaacttaattaatgcttgtaaataacgagcaagttctcattctagcaaaaatatcaatttgaaaataagtcgctaagcgagcagctggtgcatgatttgacacttcaaaaactttacactcatttgcgtcaaggctcaacttattcggtttatatagaacatacaccatccatcccatagaaaaccaacctctggttaggtttaaattccaaaagttgtttttttaggatggaggaagtaaaatacaagtaagacaaaaaaaaaaagagaagatgaaacaaactagtacttgaggaattcttttggaaataaaaattgcactctgttgttgaaagattcaagctcaagagcaaactgaatttatcccccaaaacgtctcatgaaactcctgattcaatactacatcaaatttcagcgaaataactcgagatcatttgacacatcatcaaacaatatgttgaactcacctcatgttcttgtcaatcgatccttttctcaagagctaagcctcctcatccacagccaccaatctcgtctctttgccttttatcttgcacataaaaccgaatttcctagagaacacactcaagaaaaattcaatatatataaccatagaatcccacacatcatcactcactctctagcacgaacacaaaagagacacgggatcgactgccattatctagaagcttctagaacctctcctcttgggaaaacaatggagacaagctacctaggatgagaaagtaaaccactcgttgtagctaggaacactggagagagagagagagagagagagagagagcgagcgagctaggacttcctcaggtgactgcttataaatattctgggagtatgggacaggtgcacactattcaccattgcataaaagaaatgtgaagtccatatttctaaaatttatattagtattattaatctaagatcagatcagaggaacgggatagtgatgacttgatagaagaaagacttggaagaaggtaagcatatacaagtattttttgtttttttgtttttagagcttaggaagtgggtgagtcagagtgtcttgataagatggcacctactgattttctttcttgaataatataatgtaaaatttttgtagggtagatctcaagagggactaaggtagggcgtttgcattgaagcaaagactcattttggactagttttctagtattgtttgaagagcttgagcttcatgttaattgttaaagccaccaagatgtttagctcacataagcaagtgtggctgacatacaatttacttgtcctacttgcgacgtactacctctatcctataatatacgtactaacctaataccggatgagatgtattctagcactatatttggattcatagtcctaaaatttatctcatccggtactaaattgctatattatagatagagagagtcgcctttaaaatttcagcgtactactatacacataagtgtttgagattgtctaattagaacggaatcagtatatttgtcaacaaaattgcttccatataattatatacttgtaatatatacttttaacaaagcagaataaaaaaaaatccttcccccgacaacacatcacaatgcactattgcaacttgccctaccttaaattatcctatagagataactaggcatgcttagctcactcgcttcagcagtttgtctagctaagcttctcagcattgtaacaattgttttcccaagagcaaagataagagttggttacagataaaaaggtgaactacaaaactactccaacatgagctaatatataacacagcttgaacatttttaattacatgaaacacatgtatatatatgcacacgcgcgtatcactactatgcgtgcacatatatgagtaagtaggcatagacctatatgcctacttaatgttagctttaagatttttaccaaagttgctacaaataaaataatggatgacgctcaaaaggtaattagtcctactcaaacagcgttcattcctgggagaaatattagggaaggggtggttattttacatgaattacatcgcaaagataaaagtggtgtaatttttaagattgattttgagaaatcttatgataaagttaaatggccttttgtacaacaaactttgagaatgaaaggcttttctcctagatggtgtgagtggatagcttcttttgttcaaggtggtcatgttggtataaaagttaacgatcaaattggtaatggttttcaaacttacaaaggtcttaggcaaggggatcctttatctcctattctttttaatatagtagctgacatgcttactctattgattaagagggctaaagaggcgggactcttgagtggggttattcatcatcttgttgatgatagtttgtctatcttgcaatacgcagatgatactatcatctttttggagcatgacttgcaacaagcaaagaatttgaaactgattttatcggtatttgaaaagttatctggcctaaaaataaattttcacaagagtgaattattttgctttagtcaggcaaaggaatgttatgaacaatattctgatatttttgttgtaagttaggtacctttccttttaaataccttggaattccgatgcattttaggaagctttctaataaatattggaaacttatagaagagagaattaagaaaaagcttagtagttggaaagccaagcatttatctgttggtggtaggctggtgttgattaattctgttctttcaagtttagccatgtttatgatatctttttttaggtgccgaaaggggttcttcgtaaaattgattattatagatcgcggttttttttggcaaggggatgaccataagaaaaaatacaggctcactaggtggaatgttgtttgtcaacctaaggaccaagggggtcttgggattcataatttggagatacaaaataaatgtcttttaagtaaatgattgtttaagttaattaatgaggaaggggtttggcatgatttattgaagagaaaatatctttataataaatctataacccaagttgacaagaaacaagatgattcccatttttggtctagtgttatgaatgtcaaaagtactttcttaaatatgggttcttggattgtcaacaatggggaacaaattagattttggaaagatagatggattggtaacttggcttttaaggataaatatccatctttgtacgcaattgttcggaggaagacatcttctattgccactgttatgggatctgttccgcttaatgtttcttttaggagagctttagttggtcagaatcttgtttgttggcatgagttttgtgcctctatagtacatattcagttgaatgattcgtctgatagttttagatggaattttcatcagaatggcttgttctcggtgaggtctatgtacctagctttaattaataatggctatatcgagagaaacaagtgtatttggaagcttaagttgccacttaagattaaaatttttatgtggtacctgcttaaaggggttgtgttaactaaggataatttggcaaggcgtaactggaatggcagcttgagttgttctttttgtttgaagaatgagtctattcaacatctctttaatggattgtcattttgcgaagtttctatggagagctgttcagttctcttttggttttaatcttccagttagcatatctcatatttttaataggtggcttttgggagttgataagaaaatgagtaaactgatacttattggagcttctgccatttgttgggcaatatggctgagtaggaacgatatggtttttgacaaatcaccatcatttttctatatgcaggtcattttcagggcaactcattggctccggttttgggcacaactacaaaggtgtgatgaatatgaagagtttctgaaagttgcatgccgaaagttggagaccacggttatacaactttttaccaattatggttggagatttacaaatagacttcaataattgtgatctccttacgttaggctggtttctttgtttttctcttcggtgtgttctattcatttagatttacactatgttcatgaaaactactatgtaataattggctgtagcttttttgagtaaaggccgggatattatattccattatctaaaaataaattaaactgatgctttccagcctggacaatttattgtgtgaatatatactgcattgcatctcatatttacttgttttgggggtgggtcttctaaaccaaatgactttggtgagataagtcttgaaagtgagtttatcttatactacaccgagagggagttgtccgtccgatactgcatcatatacacaccgagatatcctcgaaaaaccagaaaaaaaacctaagtaaaaaaaatgttcaaagggcgtgaaggtagtgggtgctgttatatgttggatagctatgccacaattttcatccgtgtcttttttatagtacttctatttacatatatgaggtgcaacatgttggctccggtgttgggcacattgcaaagatgtgacgaagatgaagaggtcctaaaagttgcatgccacaagtttgagtcgacggcttatgcagctttttgccaattatgggtgaagattcataaatagacttcaataatgtattctctttatcttttattggttcgtttttatctttccgtgatgtttgctgtcttagttggactacactcgatgtggagtgctagattataataatgggttgtagctctcttgagtaaaggtcgggatgtttattccattatctaaaaaaaacatacatgaggtatatatatggtgctgtagacaggaggctccttattggagtagttcagggtaatttgatttttttaacttattactatttcttttcgaccgaaagcggtccatcaggctaccagcttcaccagcaagtttttaaaaaatagcatggaaaattagagttaaataagaaaaaatattcagtagggaaaatcatactccatatcaagtatgtcctattagagcaaatagaatttaggtgctcagcgtgtggtcataatgtcatattgtaatttagttctctttgaaatattttcaaatttgattgatattcctcaaaattggacttctctgctgacttttagatgggctgaaatttggcagattgacgggctagaatcacgcgcgcttatggactgaatttgatgagacaaatgggctgaaattccctacaactacgcagatcaacgggccggaatcccacgcaactgtaggccatatttactacattctgggcctttggtaggctcagttccattgcttttagagaaaattcgattcatggcacacaaaaagaaaaaccggaacaaaataatagcacaaaaattttccccttttagctcaaagcacatgcctctgattttccttcgatttgtagcactcccgtcaccttcttctattccatctttccccttctctttgtcccgtcgatctcgccaccacgtcggtggccagccatggtgtggcacggctgagcgcctctgacggggatggcggctgcgcgtggcgagttcgtggggatggcggttcggtggtggaacgtgaacccaggggcgacggtggtggcaacgaaacgcgagatcgggggtgaccatggtggcgcctggacacgaacccaggggcgacgatggcggcagaggaacacgagcttgaagacgactgcggcaacaataggacacgagcttgggcatggctgtttagtggtggaatgcgatggcggcggcaataggacgcgagcatggagacggcgccgaacgagctcggggtggggatggcaacggcagagcttggggatggtagtgacgacggcgccggacaagcttagggattgggactgtggtggcgggatgcgagggccatcgctatcaaccaccccaccgccgccaccaaggcctgcgcctcctccggccacctcatccacccatactttggttagaaaaaagggtaaattcgtcttttcacgctcctaatcatcgctaaccaatggacttggacgataaatgtgacagaagtgctataaatcgaagaaaaaatagtggcgtgtgcttatggttgaaagaggaattttttttgctattttttggtaccagttttttcatgtgctatggatcgaattttctcttgctttttaggcctgcaattggagaggaagagggggactggggtgaaaatggtgagggagcttcctaaccgtttccggtatcttttttattatagtcactagggttaggagaggtgattgtggtctctcttgtggcctgatcttctggtgaggggataactctcattttgattggctgtgatgtttgcgacgtggctaccaactagaacaagttcagaacgctgtgcaatcgcaacaccacaaacgatattgtaccaaccgtgatgtgcggttgatgttccctgcaatgtaaacgagagaacacttcaagaacaagataagatgcaatccaaatatttcgaataggtaattaagtataaaagaatagttgtgattgaaatggtagatctaatcgacctagcaaatcaatgcataaactattgggtgactctgaatctctatctctagatgccgactaatcgagcaaggattaaatattaggtgaatggcacttggtaaaattcaacaaaacaaaacccaattgttttttagggtgtacgaagctttttatagaggaaaataaagctagagataggtgttggttcgtagaggtggagagaggcacttccgagatggccctagtctattacaaagcacaagggctaagttcggtttcagcaacaacattgttgtgttttgacgattcccaatttcctattgactcgagatgaattttgatattagactggatacgtttgaaaggtgatgagataagatctccaacaaatccaacatcatccaaattagagttggcatgaagacgctagatccatttgaaatcaatgctactgacttgaacttagtcattggaacttgtgaagttacatgcggattcgatgaaggatgtcgtcatcatctcaattattttttgcatttgaataattcatcaatggtatggattatatctttctccataaaaccacaccatgcactccaatcatttataccatttacataattgatcaatgtataatatatagaaagcccataaaacaaaatcaacccatattacaagatacagaaaagcacgtgaaaaaaaatcgtacattaagcaagaaaaatttatttcctctgttcactcactatgaccacacgtattttaaaattcaactgaccaataaatattttattataaattaaattttatttcatgtaaaataatattattggattatcatttaaatttatttttatattattgtaattctattgctacataatgtagtatactagaaaacatgcccgtgcattataaagggtgaaggctattttagttgggttattgttagatttttttctaaaaaatatatatgaattttattttgagatattatttatatccaattcggatccctagttgggatgatggccataacctatatattgttttcttatagcttggtagaaattttaaagcaattaggagtctgactctcatcctaggtgagtatgtgagttttttttaaaatatttttttatataacttcttatgtattttcaaaagcgaacgaatttagaatccgactcaaatacggacgacataccaaaatatcaacggaaacatcctcaatttttataatagtagaaaagagattatataagaaatttaaagttaagaattagttttaaaagactatgcccatgtgaacgcacctagagaaaatattattctatcgtacaattatctcgcagctaatacatgagtacttatctactctctccgtcctataaaaaaataacttcttaggatgaatctggccaagcatttatctagattcaagttattatttttctagacgtaggttatagattttttaatagcatgaaccacttaaccataaatccgaatcatcaagaacacattttgactacgaatgccacacctatctctaggggtgaaagtggttcggataatttccgtccgtccggaccatttttcggattcggatagtttcggtcggaactatccagaaattctcggattcggaaacgaattcggattttttttctcggaaacgaaaacgaatacagtaagggtactatccgtcggaatcggaaaacggtcggaaactatccggattttttttcggatatccgcaaacattgagcaaagtttagaaaaaatatgtatatatacgtaactttttcatacggaatcagatggcgacaaactttatatcaacattgtagagctcgatgagatctacaactttcttattgactattttattatttgaggtcatttaaggagtctaaatattcattataatataccatattaatttttacaaaatcttagatctacaattcaaacgacatctgatggagaatcaaagttgtagagctcaacgagatctaacactttgtagtttataacatttgtatttgaaagcatttaaagtataaaacaaacattacaagtttcgaagatgtgaagtaaaataaataacatctctaatttatacaatagtaagtaagttatacatctagtaaaaaggtcgtgagaatagaaaatggtaatcatatttgcatatggatctctaagaggaatagccataaaaattgattttcaca

SEQ ID NO: 7848 - DNA, 3794 bp, Oryza sativa
ttgttttgcgtgagattaagacggaaattcgaggcgctgtaatgattttgtgcactgttcgtgtagaatttgagttagaaggccgctggactcttacatcacgcaggagaatttcattgctgaagctttgcattgtgcgttgcctttgcagttgtttagtttgtggtttgcattcttgtgtacttgtgttgtttggaaattggaaagttctagagtctagacatcttaagatgtcagatctctccactatgttaaatgcattttggttttgtggaagacaggtgcttgtaacaaaggtgaacactttaattacctagttgatgcgccgacactgtgaactctgtgtagaatcattgatgactaaattctaatgctgacaatgtgagcactagcacaactgttttgtatcttgtactcaccattctcgctaccttttgtggtgtagtttcgtcagagtggggccaggacacctcaatgtactttgcttggtgctttgactaaacctaacgatgaatatgaattaaaggtaaacttttttttatggtttttcattttgttcaaggcatatttgcattacacttgtgaattgtaagttgattacaatgggaaactatgtactgcagaagaatagcatgatatactaagtcggattactgattcgtaatgtgctaaattgaattatgcagaagctttctactaggtggcaaaagaaatttggcgaggagatagatcaagatcttttgtatttgatatcagtagacagaatcttgcacattgaagatttcaatgaggtaaaatacattattttcttctagttacttttggtttcttcatattctgcagtttgtcattttgggagttcttattctagtactgcagtgtttgttccgcattgattgcctcactttatctacttctatacaaacattccttactttatctaccgtattgggtgaaaaatgaacttattttgggacggaggaagtagaaggtgtctcattttcatgagaaaatgagatggaacttttagtgttcttcacacttcattctgttttgctaataataaggatataatagttaggtatgggttatttgtgcatgattttttgcatagtgtgagacagtaacaagatatgtagacaagagatgtgggttgaatttctttttactcgctgaagattgctgtgcagaacggtatcaaatagttatccatgacgctgaatggtgatcagtaaactagctgacgaaaatagcctcttaacgtgaaaatgtacattaaaagcatggagcaagataacttttacattctatcctaagaatattttcagttggaacatccatttcattaccttggctgtattggtctagttatcatttctgtgtttcaggtgtagtgcaccccttgaaagtgtctggccttctttttttgttataactggttttgccttctttcatattcggaagaagacctatttattgtttacattattcagattttgtttggctgacctgtattttacgaggataaatatatggagatcacttttagtagaatgtctttctcaatttcctttcatggatagcttcctgactttagaaaaaaaaacatcaagatattttagcacttaataaaatcatcaatttatcaattttcccccacacctatatttagtttattccccactcattgaatcacttccacacgaccaaattactacggaaatgaattgatataggttgctaattgaaccttgagcagctgctgaaatttgttcaaccaacatattaggtgctttaaatgttgtcaagtttcatctgttgcatttgatgtacttagttctatgtgagttgtgcagtttttattttctgatggatgtgtgctggtgagccaattacaccttagaactttgtagttcaaatgagactgatattcatgggatactttttctgttcaggatggcatgtgggtaattccatcagaatacagtgatgcagaacctgaccctcttcgaaattttgcggaaagcattgttgaggaaatgaacagcaaacatgctgaagatgtacataggatatacagtatttatgttgaatcagatttccaggtactgaagttattcctgtcattcctacaactttgcttcttacttcttgaaaggaaaaatagctaatgttaagataaagcacatgtttgtcttttcatagtttctttataatcacacagctgtagagattttttttttttgatgggaacatagctatagagaattaccaaaacagaaagatgtaatttactgatagtctgatagtggtatagtgattatgtgttatatatatgagttaggggcatatcaaactatgcatctttttattctttatttgaagaaaagtaattaaaaaattgttgatcttatcttttctaaaagatactccagctgattaatattttatgtgctatgtgataattcatagatagtgagatattatataccgcaccaagtgttgagttccgttatgtttactgaatgtgctaacagtgttcttttatggtgacaggcgacagaggtgaagatgatttgggtagacaggttgggttttgacttgcatgttcattccggggaaagtacctttgctgcccggatccctttcacgagagaggtctctgatgagaagggagtgaaatcatcattcaacatgatgtctcatcatgcgtgggaagtagagaagagttatgcggccccagagtttgagaaggtagagctcttgaagaaagtcagataggtactgtgatttctatggtgccgccttaccctgcatccgttgtcagtattttgtcattcatacgagtatagcgcaacttttgtcgcattaaatgtattgtgtgtacctccattttttgccatatgtgctataggttagtcgttcttttgtggagagctatgaatctagactgtaaggttggaactttagctgtggcttcttcatgagatgagattgagataattaaatcatgtttatacgatcttcagttgtaacatgcaacgttctacgtagtcagaattgcagtggagtactggctttatgccccaagtatagagcacttttgatgtaactaggaagatagcccgcgcacatgcgcgggcatcttatctgatgttgttttaaattgtgttaagaatgttttatgtgggtgacttttcttaaaattattctttgacactattgtaaacgtgttttttcactaatttgttttggattgctttgaattttggttatgattttcttatatttacccttggaagtttaaattctaaattaaaattaattggaactacgctgttttgaaactatgagaaaatatgttgtcataataatggagtttgttcttataaaactatcgtttgtactatgtgtatttactttttaatatttagcatatcttatctttttttagagttttttttatgtttctatgctttaagtaacaaaattgcttttataccatatatatttatgaatgttaggatatattaagtgaatatattttctattaaacaatatggctaataggaatgtttcatctaattaaaaaaacttctattaatttacttctactctcttctctttttttttcatatgttttcttattttctttgaaaaataaaattgatttgaaagaatagcacaatcatataaatttaattagtatgtgtaaagcgtttataaaggtttaagtgccatgggctaaattgcagttttgttcgatcaattctttttatcaagtatgttttact

SEQ ID NO: 7849 - DNA, 5625 bp, Oryza sativa
  unsure (1)..(5625): unsure at all n locations
nnnnnnnnnnnnnnnnnnnnnnnnnnnnnnnnnnnnnnnnnnnnnnnnnnnnnntaaatatgattgatacattataggttatcccggtatatatggatcaatagtatggaccctatatataagcatacttatacgatgatataatctacatccattattttttttcatgatttgtcaaatctccaatgccatgcaaagtaccaagatttgtgaactgataaccgatatatagtgatataatttatattgtcatattttccataattttcatatccgtttgcattggattacatgaaaggaataaaaatgctatctaaaatataatttccctttacaagttgaaatatagtaaatatacataataaattattaatttaatggtaaataatataattatgtaaactttgttttaaaatgcggtaaagctaattgagttatgcttgtttgtaaagtgatttaaacaatttgctatatctgatagatgtttgtgttttttagactttctaggattttccctaatttattagagcatagttcatagaagtttaatagacttttattatataattgaggctctttgatggtacacaaaagcaaagtataggtccgcatgtctttttttcaaaatatacatggtttttcattgttgttattttggctatgcatatttatgaagttctatacttaataatctacacggtaaattttgttttgtatacttttatgagtaattggatggtgtaaaaaagagcaataatctaagttaacatgttagtctttttcacaacatatgcgggtattaaaattgttggtttaattgccaggaatacaacttttgaattagcctttttaatataataatccaatgagagaatttgtcggccgaacgtattaatcttttttgacacacaacacgtacatacgaactactccctccgttttaaaatgtttgacatcgttaactttttagtacgtgtttgaccattcgtcttattcaaaaaatttatgtaattatttgttcttttcatatcatttgattcattgttaaatatactttaatatacacatatagttttacatattttacaaatttatttaataagatgaacggtcaaacatgtgctaaaaagtcaacggtatgaaacattttgaaacggagggagtatgtatttacgtattagagatcggatgagtgatttgccggattgatcaggaggagtgattattagcaggatgttattttttttctcaaacttttaggattggaggctttgtttttctaacaaaagatagattttatggtctaaataatatgtctaccaatttaagtgaaaattgatggaaaaatacttttattaataaatgtagtctaaaataatgggcacataatataatataatgggtctaaactttattttcaagtattatagagctaatttatctatatatgtttgtgaagagttctatgctgatatattgaatgctcgtaaggtaactattatttaaaatttattatcactgataataattattattggctcatatacatacatggaaaaagaaaaaaaagaaggtcaaatacgtacgtacgttcatactgaacggaaggaaggaatagtgagatatgtaagggaggaggaggttggtgggtcatctgtttgttttaagagatctaatctaacggtttataatattggacccaccgatttaagtgaaaatcgatggatagatgttttattttttttctcagtttttttatgattttctctaatttattagagcgccaagtggcggcttgagagcgtttcgagaaagtttaatggacttttagtatataatagataatagatagatagaagatagatagatagatagatagataatagattttcagctacaagttgttactaccaagtggcatttttctaaagaaaatcccttgagtattttggtttctcattaccggtgaaagctagctagagcccagcaccaccagtttatcgaatatacgcagtgtatttgtgtttgaacatgctattaatttctttgttaattgtattgatcgtgatcaggggtaccgtaagggttaccggcagtagggtttgataaattatacccaaattcaaaattccgaaaaaaattatggatatagttcttgatttgtagtggtagatggtgaagaaatgttttgaaaaggagtaagataagttcaaatttgagagcgaaaccgaaagtacattagattgttgttgaattgcttcgaaatccataatatagaaaatgttatgctgaatttttgtattttacacctaaaagttaggtttacaaatatcctatatattcttttatttatacccaatttctagacacatttaagtgatttttcaattttttgctagacacttgacgataactgcgcaaatattgcggttaccgcgagaaaccacgctgaaaccgttgatttttgaattcaaatatttgaagacggattttacacggttttatacggttaccatggtaactccctttaatatcaaattctttgagatactgttcataataagcttctagtatttcaattacagaacggaggtattataattctgacacgttcgtatggcgcactacggacaaaaattcattgccatgaattaaaataacaaaaataataattttattatcatctctcgctctttcatctctatcaaggcatgtttagtattccggtgaacaatcctggtggtgaaaccactttttagtcgtagtattttaccgtttgactatctgacttgatgtttgtaaagatcggtaaaattcacatttaaaatcactttggtcaacaggctttgcatgcatgcagatgtagttgttcttaaccttcctcgccttaccttgttagattttaatgtgatctgccagacagagttactgattaagttccacaactacttcttccgtggcagatgaaaaaaataatcacaggatagcacaacaatcgcaatctggcccttgcattgttatactttttatttcgaataactaattaaattatcgtgctttaccaccaagagaaaaagcaatcactcaccacaggtttgagagtataagcgcagtccattgagattctttttctcagtgaaatttcatacaaatgtagccatttcgttaaaaccgtaattttgttacaactttagcctatcatgttgcaaatttcgatcagtagcgagcaattttatcactacactgcaaatctgcacactgtttgtgtggctacgaggcatgatcaatgagatcaacaaaattagtgttatgtcaaatgtaaggtacaatttacaggattacatttcacaaacttttaatgatcgtgataaaggccgatgttaatattgtaatactgtgaaatagaggtatgtcaaacgtaagggaagaagaataattgtaattcagtttacttgtgttgacaaacgctatatatgctacatttgttaagaggcatatatatgtctcacaaaattacatttcatagaatgttagggtgccatcgtttggtatattggtggaataagccaaatggcatatttgcaaacgaaaagtaatttgtgaataaaacttttatattgtgttcttagtgatctaaaagcaaaggctgaaaaataaactttgatgaaaaaaccccaaaatcagctccaaatttaacgttgaaaattcaaattttggctgataagcatatgaatatgccaaacgatgaggatatcttagttaattaaaattataatgcaattatcacttatactttattttaaaaaaaatcttgaatgagagtacagtgataactgatacattggaggaagaaattaaataatcacatatcctatatccaaacaaaagcaactcccaaaactaatcaattattaaaagaaactagctagcaaacaacgtactagattattacacgagactaaatcaactaaagacttttacaaattgtcgatcgattccctcaaaatgtaacacagatttcgcagtaacatttggcaaatatgccatgtttcatgcacttgtgacgcttgactctgcctttattgtatttcgcctcaagccaacagtccaacttgcacgtaggacccacgcagacgatcagcttgccaatggctttgtagcaataatctacaaagagaaagaactcattagatgctagcttataaaataatctagcttatcatttattaaatcacatgaaacattaattgtaaactgtcccctataatctcatcactgacagatatctatagagaaccgctcaagaaaacaaataaaattcagagcatatagaacgcatgcagtttcttcgaaagatgaaatcaaatgggttgagggagaattaagatgaacctgtggcagaagcaggacctccaagtgctaacacaagcagtaagatgcagcaaacaacactggcttttctcgcttccatagctgatttaccgatcgatggagacttaattggcaagggagaaatgattagatcgatataaccctaaatgcactctagctaggaatgaaatctagctactttgtgatgctaatgagtgtggatgtacctatatttatagggaggatcggctatctaatgagaatgcaggagcggcccttttcagcagccgggataatcgactggatcgatctggtcaatccatctatccctataacgtaggcgcattcgcatgttaatttctactgccgcgagtacactttcagcctgcacgccgataattatattttgatgtttaattaccacggctattgaccagttaatccaggaaaaaacaaattaatgcgcatgcatatgcgcctaaatagtttgaggaccaaaagaacttctgcatacatgcaaattaaagcgtgcgatcagtttgagggtttcgcgtgattacagttaggctgctttactaaatattaagaaaatacattcattctattatactgaaaaaattccaaagataaagtgaaattttctagtatttgatatgggtgcggcttccctgtcccgatacgcttgttcctggcgacgtgtcatcttctcattcgccgagttttttctggtaggccagtacgcatgcgcttctctttcacttaaacggcgtcaacgtctccgttcttttttcccacaacggcgtaacatatcccttccctcccccaacagaaggtatcatatacattattaattcctctctctccatgccgctgatctactattactacaacaaaataaaaattccccaccttgacctagatgaactccgccagattccgccgctttacgggtgagctcgagcaccgcttgcccgagcagtcgattgtctcgagctcgccaccactgatcaagcgccttgccgctgagttggagctgatgcatggttcagctcgtgcaaattaatcaatgtccagctgcatcaaagtgcatgagcttggatctagaaggtccatgatgtgatcgatgctaacatcgtccaaatctagatcacttctgattctcaagaacttctctatatcttctgccaatttttcaacacaattagtagacatggagtatgtttcttcagattttgcagctgtagaagctattcg

SEQ ID NO: 7850 - DNA, 1082 bp, Oryza sativa
  unsure (1)..(1082): unsure at all n locations
tttgatgttgttgacgtcaagtatcttcagtgcatgagagcacaagatgccagcaaattcaaacttcttgcaactgcatttaacattggattccaacggagagtatctaacaacatgttcaagatgaacatgttcaagatgcatttaccgttggcctttattttgtacaccttttctgcatcaacctcaccacagtagaatatgtcacaattcaaagtctgcattacctcttcctcaaatatcttataaactgctggagtataaacttctgctacatctctcaaaattctcaactctgcctttagcttcggtgtactttgtgttgctctaaagtcacactttacctcttcatatcttttatctcccaccaatctgtcaaagtgctcaagaaaagaaagcatgccatacttcacactaatataaccctttaattcattattcgggctttcatttctttgggtggtactcatatccgcagaaaacatgttctggccatatattaatgcccattgctcccttttcttaaaaatccgttacaaccatgtattttgctggtgctcatatttttcaagcaattggccccatgcacgtaaaaattcttcttcctcttcctgatcatatatgcagttctgaaagtcagcattaaatttcttatagtccttaacacacccagcaaggtgcttgcaggcattctgattcatgtgccatacacatatccgatgatgagtttctggaagaactattttaattgctttagccatagctccatcttcatctgtcaaaattgtttttggcttctttcctgacataatatttagaaaagttttaaataaccaaacaaaactattagcggtctcatcatatagaagagcagcaccaaaaacagtagtcttcttatgattattcactcctacaagcaaaccaaaaggtcgtccgtcatccaactttctatatgttgtgtcaaagcatacaacatcaccagaattttcatagtcggcaaccattttagagtcagcacagaaaatgtttgtaattnnnnnnnnnnnnnnnnnnnnnnnnnnnnnnnnnnnnnnnnnnnnnnn

SEQ ID NO: 7851 - DNA, 4105 bp, Oryza sativa
aacactcctccagtatcaccttgtttggtttgtagggacctcttggagtataatttattcttcatgtcaacacgagtaaacccgagattctcaaatccacaagcttgttttgccatcaaatcaatagctgctttagtagaaatccctacggattttgcgacttcaacgcttgcaacttgagcttcattaatcttcctttgtgatcgtaactgatgagcctgacttctagtggcaagattatggttatgttcaggcacaaagtgatagatagaatagaatccatctatgagacttatcttcatacatgcttgacacttgcatcgagtttctggcctactataactatcgccatagcctgaagcttctgctcttttgtcagtacctctacttcctgttaatacagtgcactaattgaaacaaaatgtctctaattgaaagttaatgtaactataaaaagaaacaaagaatttaccttgacgagaacaacaaaatgtcatgttttttataattttagtatttcccatgtaatgatagctgcttcttctaatgctgaaacctttcttaagataatcattgtagaagtcgataagctttttgttcagagctaaatttcatgccaatctttggcaccaagtcttccagatattttattgtatgagaagcttcatttgttccttcatcctagttttatctgtggtaatagtttccatcaaaaaattgcaaaaaaaaaaaaaggaacgatgaatatagttgttcatatgcacgtgcacatgtccggatcttacagtttagatgcaactaatttaacaaaatgtaaaggagaatatatagggatcttacagcttctaattgatttcttcccaggccatcagagggatatgtggactcagcaggatttgatgatgatgatgatggggcagaagtatcatccaagaatgcgaacgtaccgcatgttactgtattctgcaattgtgatggcattggtctaggaatcgggagttcatctagcatggtgccaagatttgggagagttcttgttagtgtggagacgcaatctgtgtagatgaaaataaaataactgtgtatttgtacttatgtaccgctctaatcctttttcccgccactaattttatttgcttggcgccatatttttgttagcgcttaaattgcgttgtttccaaattaattgtgatagtataacacgggacgttgacgccgtttaagtgaaagaggagcgcatgcgtactggcccaccagaaaagacccagcgaataagaagatgacacgtcgccaggaacagggtatcgggacagggaagacgcatcctgatacgaaaaccttcttatcaacatttttgatatgttagattccgaaacttctattttcaaatagaaataagcttaaattgtaaactccatctacttgaaattatatatgaatcatcataaactttgcatgtaaataaaaatttatattcataaaatttctacatatataaaatattttcattaataaactttatacataaaagaaaacatttatgttgatatactttataaataaacaaaaaaaatagattcataaattttctatgtagataaaatattttcatttataaactttatatgtaaaaaaatgattgataaactttatacataaataaaaaattatattgagaaacttttacaataatagtaaaaaaattactatccaactttttactagaatgaaaaaagtatacctaaaataataagtggcatattttggcaacgtatttaggtgacaaaattttaggattaaaatttccgatttttttaagataaaagaattataacgaatcgccctatatatttgggattaaaatcaaaagtttaattaattagatagttggatgttttctaaatacattgcctaattaatcctggacgctaccgctaattacgtttgcacgcgtgaggatcgcagatgcacggtcgaatggaccttaggagcaagtttaatagtatagccatctgctgccttcaaatcatccgtagttaacttaatgaccaattcatacaatagttacatataaacatatactacataattaatatctggtcccacctgttatacacacatgtaccttagagtccgtgctgcagctggctacaaatatgtagcccactgcccttctctcttctcttttatctcttcgaaatgtgtttatagctggtttatagcctgctattattgtacatgctctaatctgaaatagagggagtatgtatcgacgggatcaatcctataagagtaggtacaatagctaaggctataagccaactataaccacatatcaagaagaaaaaagaagagagagaaagcggattacagatttgtcgccagttgtaacatgaactccaagatattatatgtgtatgagaggtgggactgagtattaatgggtagtatatttttatagtcaactattgtatgaatggactattagattagctataaatattttggagctagtagttggctataccattaaacttgctctaatgtaggaatttctttcgtcgtcatcattatcgaaatccaactgcccaacacacttagtaaggactaaggaggcgatcccccgattccgcttcggcaattccttcggcggtgtggaggcggcccccgacaaggtaattagtatagatacttagctaatactccctccatctactttttaatagtcatatttctaaatttgaaaattttatttttgataggcatatttcaatccaacaacttataatcttaatggctttcttggatttaatgcgtgactctccattcttacacacaagattggctacatgggcatcgggaaatgtaaatattaatgaatcgcttgtttacgaggaatgactagtagcatgtttaaatggatgacaagtacaatcacttatcattggtctgtgtgccaagatgaaatattactatcaaaagtagatggagggagtatcgttttccgatttgtagtatttactctattttgtattataagtcatttgattttttttcatagttaaagtttgttatatctgatcaagtttataaaaaaattagcaatatccataacacaaaattaatttccatacattttacattaaatatattttgataatatgtttgttttgtatggaaaatattttatatttttttataatgttgattaaatttaaagatatttaacttaaaaaaagtcaaacgacttataatatgaaatgaaaagagggagtatcattgtctcaactggatgaatcctataagagcaggtataatagcaggctataagccagctgcaaccataatttaagaagaggaaaaagtacgttttaccccctgaactatcgcggtcgaccgaattacacccttaaactcaaaaaccagacattctataccctcaactattgaaaccggacaaataaggccccttaacactgttttgagtggttttgacttaaccttgcacacgtggcgccaacgtggcaatctaaccagcaaaaaaaataaaaaaaaacatggcccacctgtcatacctatcctcaaaccaatctggcaatctctcaaccattccatctctctcacgcacgcgctcgggcaaggcagcgggtgaccggcggcggagatggagctcctcgggcggccgggtgtctgaggcagagcgggcgaccggcgacggagacggagctccccgagcagcgggcggcggaggcggagctccctgggcggtgggcggtgggcagctgaggtggaagcagagcgggcggtcgacggtggaggcggaggtccctgtgcggcgggcgtcgtgccactgaggctgaggcggaggcggagcgggcggctggcagcggaagcggagcttcccgggctgcgctgctgcgggtggcgagcggctgaagcggaggcggagtgggcgaccgacgacgccgtggtgaagggcggcggcggcggcggcgatgcgggagcaggtgtgtgtggcgtgcgggggatgacggcgcgcggggccgggcggttggcggcggcagagggggagctggagccgacgacggctcggcgggcagcgggc

SEQ ID NO: 7852 - DNA, 3185 bp, Oryza sativa
aaattttggggtgtaaaataactggttttagagtctaagagggtaattcgaacgacccaaatagttcaggggggtaaaacgtacttttccttaaggaagataaataagtagagagaaggacagtgggctatagatttatagccagctgtagcacggactccaagacgcagtgtgtgtatgataggtgggaccaggtattaatagtgtagtatataactattgtataaatgagctattaaattggctatagataaattggagctagcgattggctatactattaaacttgctctaacgtaggagtttctttcgccatcatcgttatcgaaatccaactgcccaacacacatcgcgaggaggcgatcccacgattcctttggcggcatgaggcagcccctgaccaaggtaattattatactccctccgtactcgaattagatgacatttcggacaggattatactccctccgtttcgaaatgtttgacgccgttgacttttttaaatatgtttgaccgttcgtcttattcaaaaaatttaagtaattattaattttttcccatcatttgattcattgttaaatatatttttatgtaggcatataattttacatattttacaaaagtttttgaataagacgaacggtcaaacatgtgctaaaaagtcaacggtgtcgaacatttcgaaacggagggagtaattactaaggagtcattaattaaggggtaatcttccgtgtaagagcaaggtcaatagagagcccactgccatctccaattttctgtccaactcaggaagagctagcttatagcttaccaagtacaatagattagctgtaaaatgtcagagattaatacattgaactatttaatgcatgcatgccaatagcagttgttgggatcagtcctgacatccatatttgtggccattttgttgcaccacatatacacaatcacatcagagctagttaaatagaggattaataatccaaacagtgaaacagatacgatgattcacaaatctcctggcaacatgccatcaaacaaaaggaccacaaaaactagacaataataagctacacaaggcaactttttagggataacaaaataacagttaacgaaaacatagatataaactgagatagttcttgatctccatatggaccatcatcagccatcttgatttgttgcagaatataaattatgttatcagcagaacaatcacagtacaaatgcaatattaatcccagaaatctaactacttagtgatggtcaaatttctgccaattacagtaaacttttcctaaaactataaaattaggtgtgtctcattccaataaattttcttgaaaggatgtcacagtccctacactatagttacatggattcatgaatcatatttttgaactgagatgtaaaaaagatcaatgatgaagctagcagttcatgtatacaacatatatagcatatggaggaacaaaatcggttcatgtacacaaaaatttcgatgttcattacagctgaaagtactcacacgataaatataccatatgatggaaatatacctgtaagaggtgtgttgcagaggtgcaacacagtagacatcaaagcttaattgttcctgaaataaaacatatagaagggtaaattaaaaggctctatatatgacaaaaaagggggaaattatatgctaattaccctaccatggttatgtacgctgcgtattcctgaaccggttccaaatgtgctaaattaaatcagttttaagctgggtatgcattgaacgagcacaaatagtagctttcctacttagcacatcacgaaaacattggttaccaccactggttacttctggaggcagtactattgatgtcctaggaattctattgaggtctaggtcacatattgcatcctcgccctcgtcttcaacaatcatattgtggagaatcacgcaagttagcatgatatttccaacactctttctcttccatttctttgccggacgacgtacgatgttgaaacgagcttacaataccccgaaagcccgctccacatctttccttgccccctcttgatgtgtagcatataacttatgcttctcagtttgtggaagtggtatagtcttctggaatacagcccattctggatatataccatcagctaggtaatacccatggttgtactcttccccgttgacataataatggacccgagaagcctcacctctcactgtgtcaaggaaaagaggggactgattcagcacgttgatgtcgttgttagaaccagcgacaccaaagaaggcatgccaaatccataggtcgtgtgaagcaactgcttcaaggataattgttgggactttgtaatcaccacgggtgaattgacccttccaagccctcagacaactttcccacctccagtgcatacaatcaatactacctagcatacccggaaacccacgagactcgttaacatgtaatatatgctctacatcctcccttgtggggcgtctcaagtacgtcccaccaaatacctcaatcaccccttgtgaaaacatttctaagcattctaaggctgtgctcttgccaatttttaaatattcatctagtgcatcagcaggtgtgccatatgctaacatacgaagtgctgctgtgcacttttgaggtggagagagacttgtgcggctagagcaatcttccctttgagtaaagtatggtgaccactgacctaaggcttcaacaatacgtagaaagagtggcttgtgcatgcggaaccttgtgcgaaacatccactctgggtacaatggatgctctgcaaaataatcagccaccaaacggctgtgggcatctacatgatccctatgaattgtcttccttgttccaccttggcgcttcgaacgcccagctcctaacctacccttcatcttctctatgattcgagaagcaaatgagtctagtacattctgctcagaaatgtacttgtctagaactttagatgggtctaggtcatctgagttagaggatgaataggaggatgagtccgacatggttggaggaggaggaggaggatagattgggttggcagtttcaagttatgagaggtaatatatagatgctgcaaaggactagctgtaataaccatacaaattttaatatggctggactatgactgcattttaattaggaccagct

SEQ ID NO: 7853 - DNA, 12828 bp, Oryza sativa
  unsure (1)..(12828): unsure at all n locations
nnnnnnnnnnnnnnnnnnnnnnnnnnnnnnnnnnnnnnnnnnnnnnnnnnnnnnnnnnnnnntttagatgggtctaggtcatctgagttagaggatgaataggaggatgagtccgacatggttggaggaggaggaggaggatagattgggttggcagtttcaagttatgagaggtaatatatagatgctgcaaaggactagctgtaataaccatacaaattttaatatggctggactatgactgcattttaattaggaccagctgcaataaccatgaaaaatttaatatgtctggactatgactgcattttaattaggaccagctgcaacaaccatggaaatttaatatgggttggcaattgactgcaatttaatttagaccagctacaataatcatgaaaatttgggttgactgcatggttatttagactaatggcagttaatcagcacaaaatatgagactatatgcatgattatttggactgaatgctattaattatcacaaaacagggactggttgcatggttgtttggaactagagctatgaatacagtacaatagtttgactactgctcaaaatcaacgtagatatatgcatgttttactactgcaaagaacttcatgacacatacctcactggttttttgtaaatatatcttctctcatgcatttcaacattgcaacaagctcagacctcacatcatcaggcatatctcttgtgtctttgttcagtaactctctatatgctgcaatcatagcggtctggcgacccaccttcttcgcttcaagattatcactagcaacacgtcgctgggtctccaacaattcactttactgctccttggctgcttcatgtgcttccataaacttgtgggtgtcatcttctagctcagcagtacaatcttgaaccttgccttttcctttgcctatacgcttcgccttagctgccttgactcccattggacgtgggatctcctcgtcatcaaggggggtagcatcagcataatctcgcttccttttattcgacttgtcaagctgatccaaatatgcatgccatttaggttgggtttttagttcattccaacactcaataaacaagaatcgcccatccttgaagtcattctcatacattttcagcgccttgtccatgagatcaacattacactccccactagcatataatgaattagcctccttccaagggcaacaaaaattcctaacttttttcttgatcttactaaaccggcttgacggagtagtgctattgtaagcagcagcaacatcagccaatatttatcattctttttgaaattcgattctattggatcatttgagttgtttaaccaagcctgacctacaatttccaaatatttcactattgttaaattgcatgtattatgaatgccactaccaaataaataactcgcgtaggacacttaccagcctcaagtcttcttcagttgaccagcctaggcgcttctcggtcctagtggcatttccattgttgccattctcaacattaattggctgcaactgacacccttcagtcacatggtgcataaggttcgtggtgtttttgataaaatcaacaaaaccaccgagcgggcgagattctagtcccctatataaaaatcatgaacatgaaaatcttgatcagttatgtcccatatataaaaaggaatgaacaagccaatcttgatcaatgcaaggcctaacccaatattaccccagtataaatggtatattgatatgtgcagtcaaaattattttatttcagttcatagtggtaaatgagtgctcgaatctaaaacaaattagtaatagatgtaacattggactcttgtttttactttgccaaattactgcataaatacatggttaccaccactgctaattaccctaccatggttaccctacatgtaacattggactcttgtttttacttagccaaattgctgcataaatacatggtacaaatcattgcagaccaaattacatgggccaagttactacggtaacctgattatcagaccaaaatcacctcttttttcctaaacaattcattgcactagtgctgttatggatcaaaacaataacgaccatgaaactctcaatattagacagggaaacagaagcatgtcaaaatcagaactgataaagccaaataataaatgtaccattgttccaaatcaacttggacgtccgtcttggcatcagtaggaggacgatatgcagatgagcccgccatggcttgtgacggtggaaaaggaaaccatgatggcagtggggtggggaacaaaggacctccatatggatacggtgttgccggcgggatatgaacaccgggaggaccagacgagcttgcaaatgagtttgcggtggtgcaacctctctcttcgtccgacgagacatggtgaaaaggaactagggttttggtgcggtagaactatggaagaggacggggggcagtggccctccctgaaattcaccggggggatggatttcaggggcgattttggggctttggcatcgttctacctgccagcaaaatgaatttcgcgcgcgcgggagaagttataggaccgggagagaagaaaaaggagtgagtgagagggaatactgcgcgggaaggagatcgatcgatgcggtgggtgggagatctgtccatcgatttggcgggaggggatcgatgcgccaggaaggagagatcgatgcgccagcctcctttctcgcgctcgcgccaagagggagagggggatcgatctcatggcaaagagaaaggggaaaggggatcggatcagtggatcggcggcctaggagcggtgcgcgcacatgatcagtttttccgttcgtgggccccacaacccgcgttttctagcgcctgcctcggctgcaagcggattcagattgggtgagataggatagacatgtcataaggtgacatagcgtagatctcagctctccaaaataaatccaacggctgagattcgttcacatcatcatgagttaaaatttaactcgtatgagtaaaaattttactggtagttaaaatttcaggagttaaaattttattggagttaaattttaacttgtaatgacgtggacgaatctcagccgctggatttatttcgaaggactgagatctacactatgtcaccttgtgacatacctaccccatgtcatccaatctaaatgcgctgcaagcgggcgctatgcccccaaaaaatgcgttatagcttggcgacaatttagtcgccagctcttctctttcccctcaatcattacccttccacgtagaaataatgtgacgtggcaattattggagctgatgggtcagccctattgtacctgctctaaatgatcaggtgggtttccttgtgcaagaattgttcgtagctagattggttaggcagccgcgccttaaggcctgtgggcatatggttcaaatcccttcgctagcgggcgagtttggctcatttgcatggcattcggttttggcgcgttgctgctcgtttttttttttgccttggttttcactggcgcgctcacggcacgctgtctggaccgacgcttgggtctcccatctcctgcttgatctatttaagacacgccacttcttaacgccacctcttcctcacttgttcatgtactgagccatccgcacatggccgatttatttcctgggttcgatctcaacgaacctgcggcagagcacggcaacggtaatgcatcatttcattgtttcattgtttccgttggagtatgaggaaattagttttgttttttgatattcacagcagtctcatgcaaattagtttccattatcagtgtgttctttcattttcgacaggatttgatttgaacttaccactaagatgaatatggtgcatttgattttgatttcgtacaaaacatcgctggtaagccgtggttattatttcctttctcagtttgtactttccatgtatgattgttttttaggtaagccgtggatattattttgaatgtgcttgttttttttcctcttactagaaccaaaccatcgaaagaaagaaatgacagaagaagtcagaaaacaagtgtatcaagtattgctggctaaaagcaagaatgggacactaggcaatacagatacaagaattgttgctaatcaatttggattgcacattcggtcagtccaattgtggttgcaagtagaaagaagggtagatgtggccataaggcaatccctcttgatttgaaacaattgcgcaacattcctctcaagtaaagaatgaccatagaagatgtgtctagtaaacttggtataaacaaagctaggatacaaaggtatttgaaaaaaggtttgcttaggcgtcactctagtccagtgcgacctcgactgagtccagatccaccttgacggagtccagcgccatctcgactgagtcccacagcgtcatctctgagtcgagtgcgacctctgagtccagcgtctcctccatgtctagagcgagcttcatggcgccgagctccatggcgagcgtgctgcgggagaggaacgcgagcgcgaggaaggaaggaggacgtgcggcgagcggcgagctgtgaggcgaggcgaggcgaggaggacctgcgacgaggaaggaagccgcgcagcgaataatttcttcgagcatgcgcctacgaagaaattaactcaagcgtgcgcagcgaggcgatgcgagcgctgattcgctgaacagagtccgagcagcgagcttaacgaacaggcacgattaatgcgcgtgattactgcggacgacgagcacgcatgcgcaggggcaaacacgtccacctcctttcctccgagcgtacagcgacatcctttgcgaaaacgcgagcgatgccaaaacgacatctaattcgagtacggagggagtagatacttagctaatgccgttttctgatttgtagtattcactctgtttcaaattataagttatttgactttttttttcatagttaaagttttttattttgaccaagtttatgaaaaaagttagcaacatctataacataaaattagtttcattacattttacattgaatatatttttataatatgtttgttttgtattgacaatatttatatattttttataaatttgattaagcttaacaaaatctgactaataaaaagtcaaatgacttatagtaaatagtgggagtaccatagtatcgatcggatcgatcctataacgtccgaatatctttcgtcatcatcattatcgaaatccaactgccctacacacattgcaaggaggcaatcccccgtttctgctgccacgattcctttggcggcgtggaggcaccccttcaccaaggtaatcagtatagatactagctataggatagatctgcagtatcatggtatcataggatcataatacatttttaaattatatattttatacaaatatccagaaaaaagaggcgaaaaaaaaccaaaattgtccaatctaaaaaaacaggcgaaagaaaaacgtaaattatctaataaaaaaaccgggtgaaagaaaatgtgcggaaaaaagaaaagaaaaaacaaatctgcaaatctgtccgaaccagaaaaaagggcgaaaaaagaccgggcgaaaaaaaaaaaccaaaattgtccgataaaaaaaccgggggtaagaaaacgtgcgaaaaaaaaacaaatctgacgtggtaaaataaaaaccgggggaaaaaagaatttgtctgattccccaaaaataattgtccgataaaaaaaacggggcgaaagaaaaaaaagcgaaaaaaaatagtccgactcctatccgattcctctcataaacgacaaaaaggtccgactatagatccgattcccccttaaaaacgaaaaataaaaggagccactccttctgagtccgagatattagccaccactcctttcagttttaatctataccgtgatatctcacacatcttggtgaaacaaaatgatgtgccggattaaagatctgtataaaagacggaacctataggtcgagagcattccatttttatatgattttattttttaggtttgtacttttacatttgagtccctgtaatttttatatttatatttgagtccctataatcttgcaataaggtacttgaggttgtttttttaaaaaataataataaaagagagagaacaaaagctgaaaggtgcgtaaaaagaaaatataaacgattcaaaatgcacgagaaaataaaaacgatttaaaaagagaaaatgcacgagaaaataacaatgattcaaaaaaacgcgtgagaaaaaagtcaggaaaaagcgcaaaaaatgctaaaaaaggctttccatcttccataaaaaaataaaaaacacgtgagaaaaattatttccaacgtcggtaatttttttaaaaaaaacatgggaggaaaaaactataagaaaaaacgcgccattttaaaaaacggtgctaaaaaaataccgtctattaaaaaatcgctctgagtcggataggatccatcgattttttgccaccactgtacacggcttttatttcgtcaatactaatatgttgtgtagaaaccatgtctcatgtaagacctggtttccttctctttactcgtttattcacttgccacattattttttcatcttagattgcagcttatttaatgctatggatatcataccagtcaatggattgggaatggccttataatttgggatggaggggtaccaaacaaattaatgaacacttgaaaacacaactccaaagagttactagtgagatcccctgcacgtggctgcagaacttgtgtatgatgaattgctacaaaatggtgggtgcaagctagattatttggttaggataaaagggtatttttctagtgaaatttgtacattgcgatgatcatccaatggcagcttaaaattaaaaaattaaaataaatggttgcttcggatatgagaattttattgttattttgtaaagttattaacatttccataattgtgaagatatgatgatcttttctatttattttgatgtagccagtcatgtactcaaataataagattgttcccatggccatagcatttgagcattttttttatctccaattaagtatagaataatccaatatgaaaatttaagatctgatgaaataaattcaagatcaataaactgcttggaaaactggccaacaagttcaaaaataaaatcaatgttttggcaagatttgtctaaatttcactagttttttgtcatttattgagctcaacctgtgataagtgatgaaaccactcccaagcggcaatgggtcaccaaatatttttttaaccctgcctatcactcaccatatgtaagttgctccttctcaaaatcaccaagactattccagtatcacaacactttatagagagttcccatagcaagataatatattattatttgaaattgaaataatcaatcaccctattaccaaaaaaattagcacaaatcaattattcgaccagactagctaataacctaactaaagactctagcaaatcattgaccccggcaacatctcatcttcagtgctactatttcctgcaaatcaagcagtaacattttgtcttgtaaccttttcccaagcacttgtgatcaatggctttgcctttggtgaatttcgagaaaacccaacagtggtacttgcatgtgaaacccacgcagatcggcaatatggaaacagattgcgtacaagtatctgccataaattaatttaacccatcagtaacttataccattaataatctcatttcatttgccataattaatcacaagaaacatttaaaaatcaagttttcggtttaaaaatcgagaaacatttaaaagtactgaaaaatgaattggttcttatcgacaaattaaatatgtatatccttcaacacaatgagaatatacatgagattctttgataaaaaaatgagtataacagtgtgtgtgagagagaataacctataggtgttggtatagaattcccaagtgataacagaagcatcaagacgaaacaaatggcagcttttctcccaaccatggctgattagctctgatcgggcttaattattacccgagacttgtagctagcttcagaatcgataactaattcctatgatatgggaatcaaactgttctatcatgaagagatatgatgataagatgtctatttatagagaggagaaatcaaaggcgctcgattgatgggggacgtgaaatgtgggtggataacggcagtgactgagttagttgaatattcatgcatatgcatatggacctgttcagccggaaaacttcaccaatataatgtacgcatgcaccacatcatgaccaacttatgatatgagtgtgattaattaacggctaccgcctaatcaaatgtttcagttgaccgttgatgcaacattaagttatacacgatgaaacagaaaaatcagcctatgaaacatatagaaattttgtgaaacaaaatgagaacacgtggtgaaacatattgctattacgtatgaaacaataagtttttattgtttgaaacatatgtttttcttttatcagaatataatcatgggatatctttaaagatttaattatgacgaattcaacggtgtgatcgaatcgttcatcagataaatagtttagaagaaaaaaatatttttaagatcactaatacatgtatgcatgcatgcatggtgagggagtcaatagaatgacaggagagagagtaggagcctgaccatcctgtacttcttcggtcattggtgaaacattaagttatacatgctgaaacaccagttagtgaaacatttaaattattttatgaaacataataaaaacacatgtttgaaatatatttctatatatcacgtctgaaacatttaatttaaaggattgaaacatatcttttctttcatcagaatgtaagaatatgagatttaattataacaaatataatggtgtgattatatcatagattggataagtagttcaaaagaaaaaaatattttgaaaatcattacagcatgtatggatgtgtggagtggacaagatttagtaattttctcgtcccatttttcttgttgcgtcagatgtctggtactaataatttctatcatctatatatatatatagtcgtttccgtttggtaaactatatttttttcttgtttggtaaactgcttttcacttgctatatctgttttttccgtcccaaaataacttaaactctaaatttgatttatgtccttttatctatcctcacttggcaaattaaataatctgacatgcagtacaaacgtcgactctcatacacacgcacaaacacatactcttataaacacacactcacacacacacaaattctaaatgtatgagcacctcttaagactggattagaatatcatagaataaacaaagtcatcacaaatatctcgatattgatggatatatcgtcacctactacatattgaaagaataattagtcataaatacgagcattcgtgtaaaggcttgaacttaaaccgggcatggacaaggaagaaagcttagcttacctcgcaaacttagaaatcttatctcttcaatgtacattctttgtctacccatgtgtactacttttctattaatgaggtgtgctttgacatttttctttaccactaaattttctctggatatgagggttccaatagtaagctgcaaataataatattattgtagtataaaaacatgaattaattggaagagattaatgaaggttggatagcatatttcatgattgtaatttcatcagtaaaacaaaatacaatctatttgcacttatgctaattaaaactttctatgaactctcacattagctagaaattgatttgatgcatcggattattgtgaatgtagttcatgctgagagtcatgttaaataaacaaatgacacaaatgaaaatagcacagactctaatttagtaataaaattcataattaaaaatatcatatcgtatccatcttatactctgaatttagtatttattaattaaaatctagaattcaaaattcataagtagtaacttgtaactaacgtggaccctaattttagtatgagcagatcaatatcaactcacaaccaacacatgcaatgtaataatataattttaatattaaagagtagcctatgtaatgcatgggttagcgactagtggttataatttctaatttccgtagaaacttttatgagattgtatgtgtacttttcatgacatatgtacaacacaccatatgttttcaaactaagtattcattactttttttataagccaattttgaaaaaaaaaatgacacatggccatgtatttttgagcagagggaacatgttatgaaacacaaatcttgaaactgagtcacattccttaatttgagagttaaggcatgttggatatattttccttaatttacatttttctaataattcatgattgttcattccgacatttcctatatattctcaactaatcaatctgcattggatcgatacgatgaaagagatcatcaactcaaattctgatggcatcacctggacagaggttgcatatcatgatactgaaatgacagaaataattacaaattaaatagatcgatttgtaatgcgtctttgaaacttttggatcttagaaactttgaaacgtctctttaatatccccaatgataacaagccatgcgttgcgcgacttttgattccatataagaactatttgttgtataggatctattagtttatagaagattttagatgagttattttatttacaaagtatctattggtctagctaactatagatttagctaagtcgtgctatatgagaaatcactagaagcttcttggttttttttttcttcattatctttgcccccgctctctttgtaccatgtgtctataagaggaggcactagaaacctctataaattcccatatgtttatgctattgttatttttttaatgcatatgtaaccttttgatccaatggccattatttatctaaattctttattcaacggttgatatgtttttgatgatgtggcgtgttctcgtgtaagaaagcttgttgctttcactatataagataagataataagatatgatgatagccaccggccggaatacacaggagactaacagtgctctgattttcttttctctcgggctgaaacgccctcgccgagaaatatcattatatatgtatcgaaattatataataatttgataagatgcacattgtgacagtacaccattggaggtagaagtcaaattaatcataatgccaaacaaattaacaacgacggtgtacttcaaagagataaatttagggatctagctagcttacgaacatatgactagcacaaattattcaatgacactactagctaacgatcgacaactgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaatttacggtctagcgatggcttcagctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattgttaccagttataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacggtaaatgtctcacaatagtagctcgcgaaccggtccttaattgccatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtatgctaatgtttctaagcatggctaagcaatcataactaatatctagctgaaccaatatataaagcccaactagtcaagttataataacccaaggtatcaaggaatagggtaatcaatgcaaactggccataacaaaggaataggttcacaccacccggtgacattcgaaaataaatgcacagttgaaataaatagagaatttaaatataggatcaacatgctcaaaggattgtgtttaggatctgtgtgacttgcctt

SEQ ID NO: 7854 - DNA, 12045 bp, Oryza sativa
  unsure (1)..(12045): unsure at all n locations
cgacgaggctacggagcacgagagatcacgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggagtatttcccctcaactaattttggaaatacacgagataaaaggccggatttggaggggaaaaccgcggctatacaggtactgtgcggctggctcgggctctgtctccagccggctggagattgaagatgacactgtagcagggaggcaaactagactttttgctgggcttctacttcttggcccgattgaaaaagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttcctatgctcaaataattccaagaaaaatcttgaaaatacttggacacgcaaagtacttaacaaaattataattagaccatttaatgattaatttaatatgtgggtaattactgaaatgctctttgtaagattaaaaattaggaattgagctccgaaaaatccgagaatattccagagagtataattaaccatggagaatttaataaaaattaaatccatccatgctttaaatttaggaaattttattttccacatttaacttcacttgtaaattaatgaacatttaatataaattctattattaatttattaaataatttataaatcctgaaacgaaaatcaggatgtgacaacaaccaactaaaagatcacttctgcaaattattaataaaactcctacaattacaatagaacataacataatatcttgtcttcagtggtactaaacattcttacaaagttggcacaaacatttgatcttgtaaccttttcccaagcacttgtgagactggactttggctttgttgactttggcgaaaaaccagcagtcgaacttgcaagtgaaaccggcacagatcggcgacacggaaacttcataccagcaccattgttctacaaaattaatttagccagtgaacttacaataatctcacttggttgatgatcttaatcacacaaaacattggaaaatagaacctataataatctcttttatccttacttatagtggtgaatccttactcatagtggtgaatccataacagttttacagctagcataggcataacatagttaattataccatagctagtatattctataaaacttctatcttcgggccttccaattatatagaattttaatgtaccaactaccgatgacatcaggcggccgccccgggccggggtctcggggcattagatttgccgttgcttagtcatcacataagaaataaaaattaaattaagatttcagtttctacatacaattgaataatagataatacatatgaaatgatactcgaacacaatacattggagagggatagagaagggaggtcaaggagcatgaagaactaaccagcataagcatgttgcgcaagtgttgacagaagaagtaccaaaaccaagcaaattccagcttttctctcacccatggctcgttaattggctgtgagagagctaacggctaatactaagacctcggctttaaagtttcaagctcctctgtcacacaagagagtgatgaggtttaactgtatgatgatgtgtatttatagggagaataatccaactgaagaagatgtaggttgtaatgcaacgtaaatcatgcgaggataagtaacagcatttgactgactgagtgtgagaggaagttaattagataggagaatccatgcaggcatgcttggccctgttcagctggaagaaagaactacattgcatgcaagattacgtctatgtatagatcgagagaataataaaactgaagatgctgaaatgcaacgtgaatctttgaagaactacattgcatgcaagattacgtctatgtatagatcgagagaataataaaactgaagatgctgaaatgcaacgtgaatctttgaagaaatgcaacgtgaatctttgaagggttaagtagcaacatctacaaagactgagtgatcctttttcttttttgggaggggttgttattcctcataagtaaattaattatattattattaatctttgggttagtataaaaattaatgagaaaattaaatatgttttattaaataaatgaccttgccgcacatccatatataagggtgctcccaatacctgctcaaagagacataaactagcggtttcaatattttgtactgccactttgcaggcaaccacgcaaaataaagttcaccgtatttcagcaaaggtaatcatgaatcgaatagcgcatgcaaaagttgagtgtccttccacaaaatttaccctatatatgctagttaaatcccagagatttttcttcctactagcagctagcaaaattatccattcattgacacgcaaaattaaacaaagagatcgtcgtcttatactagctagcatgtacatgtctagatctaattctgttatcgaaagaatttatgatcagcttagtcttcggctccgcctcctccaagctcagtcaagctctgaccaaaggtgaggccataattaaactcctccggcatgcttgtcctatttcattaatactttttttttgaacgaatgtattgcataaatactcacgatgcaaattatttatggaaattaatttattggtttggatttgtattttgtttttgttgttctgggagggtgtgtgagctcggtagtgtttggttgttgtgagattatttcgttattaaattctacagggaaagatgttttgtgttccttaatttgaagttccagtaccctgtaccgttgtcattcttgactaatcactcatgtgcatatatattgtgaaaacatgtctaggaattaaatcgcattcctttctgaaacaagaaactgaaaacagggaaaagtagttcaagccagacgtacttgttggatacattttctgaacattatgttgtctcgcactgttttatcttcttgacagagaactataccagattgatccatctatgatgacctatcagtaacgggccaaagtgtctcatcacaggtgaacgcatttgtgatgggttcaattggagcccattctagatgtggcccatcacacataaggggccagttgtggcaggccagtatgtgcacccgacacatagcacgtttgacatgctcacctatagacccatcatagatgacccttttacctgtgaaggtacaaaaaaatataaaccgtcacaagtgaggacactcctcgtatatgggtatattcttttacccatcatagctctttctctctctcccatcgaaagaaatcgaagacaccactaagtccttatccacacatctctctcccttctttttatctcagcaaccaatcaaccatagctctccctccccagctgagcaccccctgagtggcccccatgtcctctcgggccccgagcgccagaggccgcttcctccacccaagcgacgaccgtcgccgtcgccgtcgtcacatcgacctcgagtgtcagcgagctcgcttctccgcatttgagctccatccgtcaccgccataacgtcctcatcacgtcgacccccaagcaccggcaagcttgcctatctgccctgagctttggctggtactgtcgtcatctcctcatatcgtccattcccaagcttcggctgttgcctcctctacccttcgccctaaggttgtcagcggccgcctctccgctgccaacaaacaatgggacgccagatctggtatccaacaagttggagaccaccggatctaaattccctagagcttcggccgccacctcctccaccctctcctgcatggtagccattgtctgcctcttcaccgcctccgagctacgagacaccagatttggtctccaggaggttggggaccactggatctgaacgcccctaagctctagccgcctcctcctccatcctccgctccaagatcatcggtggccacctgatgaaggcatcactcctttggatacacatgctactcctcatgttgttttgtaaggtccaatcactagagctcgtgcccgacaattaaatttacaagtgagctcgttcctaagtacttctttatgtgctcttgaggatagattgctacctaatgatttaattatgattaggaactatagagacaaccatggagcacttggagagaggttaggagatggacaagatcatcatggacgttcaagacaagatgaaggtccacttcgggctccaggagcagtccacactaaattcatcatccaggttgtatttggactccgatttcgacgttctacatatgtatggaaagctaacgagaccacctttccaatggatctgatcccacgtcaaaattccttccgaatcaatgggaatcttcaaaacaaaaaggcattcagaatctatcaggtgctatgtccccgtctttgggcccattgggccgtgtgtcgtctcggagtctaatagggaggcgtacaggggtctaaggtcgaccctagaacctatatattcagtagttatcattgagttagggttgtgttttgcttagattatttctgccttcgcagtttcgctgctagattggtttgtgaaaccccaacgtcgagttcttaaataatcattcatttgcaattaagttgttgtttttcttgttcttacttgtgttctttgattcacacgcagggattagccttctcggcaaggtcaatcggttttagcatggctgataatcagagaagacgtgctactacgattgtagggtttggatcatgttgatcggaagttggatcgtgtgtgtcaagtttccaccaaatcgatagttatcttcacctgaaggaagatcgggaatcccataatcccgttgccatcaccgcctctctgcctttaccccaaggtccatcctagagtgtgcaccaccgcggcctctgcctcttctccggtctcctcaggattgtcatgtcgttcttcggagtctcaagtcatcgaggcaacaaggattttgcaagtattttttttgtgtttgtgtcatgttttggatcttgcaagttttgatgccaattttctgattgagttgtgttctttttgaagcccactgatttgtgctgctggggtttggagaggcagatggctgattatagaagaagagtcgggtcatttgtttcttgtagaaagagttagtctgaagtaaaatgttttgggttaataaccatagatatattactgttaatacacattttgcttcctgttgcaaccgagcatcattttagtttttatttttttaactgggtttttcacacctgtaattgtgatgggtcacaagttattcttcactcttattcttttatctttttgttgggttacactcatcactgatgggccacaacttatgagacgatcgagattgagtcatctgtgacaagttctatacagtcaccatcgacgggccttcacccgtcagagatgagatcagtcatcactgacccctaatttctacgagagctaaactcgtaagaggtgatggtatgggtgcatcggtgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctgtatcttcatattccgttaggaatatagattatcttttgtaatccggactccttcccatatataaggggggtccgggcgcctctaggggcagatgttgatttttcccaaatcatacaatcaataatacactcggggattcatccccggacaggagtagggtattacttctttataagaaggcctgaacctgtataaatcctttgtctccaaacccatacacttttccagcttgatagccacccccttttattattgccgaaatccagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcagaccagtcgggagagaaccggctttcggtcccgtttggattcccgaacgcggctgaaagctacttcaagaccatctcaaccgagtcggcttcaaaccactcggccgagatcgcatcttctccgacgacaccagatcaagatgatgggacttacccaccagtcctgatgaagctccccgacgatttagcggccgtcttcaccacgacagcgtcttcatcccgtaggcctaggcagaagtcggcttcaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagctctcgctacaacgacttcgacgactacgacgacttcgacggaagcctagatgacaactacacccctctctactttggcgttttcatggccaataatgagacggaggagcaacgccaagtccgggagaccgaagaacgtcgccgactggaagaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagacgtcgaagggacaccggttttccgcacccctcaacagaatgcggttgccgcgatcactcttctcgacaccctcctcaaccaaaacgagctcaatcgatccgaccacgtcgtcaacatcttgaaccagacaaagaccatgattgcggcctcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcaccggaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccggtggctttagcagattccgcccgatcttggctccatggattgccccgtggtacgatcggatcttgggctgaattacgcgaccacttcatcgccaacttccaaggcaccttcgagcgtcctggcacacaatatgatctttacaacgttatccagaaatccggagaatcccttcgagaatatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtataccaagcctgctcggaagaactccgacgaggaacaaagcacgtcaaggaagaaggacgacggcgacaccccggctggatttcaagaccaccgcaaggagctcaaccatatcttcggcggccccttggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcgggtaccccctggtactagacccagtggtcngtaatgtcaagcttcgcagaaccctcattgatggtggcagtgcactcaatatcctcttcgccaagactttggatgatatgcagatccctcgctccgagttaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggagaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttttggactgctactcggggtatcatcagatccgactgaaggaatccgactgcttgaagacttcattcatcacgccttttggtgcatactgctacgtcaccatgccgtttggattaaaaaatgcaggagcaacttatcaacgtatgattcagagatgcttctcaacacaaattggccgcaacgttgaagcctatgtggatgatgtagtcgtcaagaccaaacaaaaggatgatttgatctcggatctagaagaaacctttgcgagcatccgtgctttcaggatgaaattgaaccctgaaaagtgcaccttcggagtaccgtcagggaagctgcttggttttatggtgtctcataggggcatccaagccaacccggagaaagttactgctatcctcaacatgaaaccgccaagcacccagaaggatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggtcatgtccagaaagttcagcgaccaatctacttcgtcagcgaggtcctggccgactccaaaacgaggtaccctcaggttcagaagctgttatatggtattttaattactaccaggaagctgtctcattactttcaaggtcacccggtaacggtggtcacatcgtttccactcggcgatgtactgcacaaccgcgaagcaaatgggcggattgctaagtgggctttggagttgatgtctttggacatatcattcaagcctcgcacttcaatcaagtctcaagcgttagctgattttgtcgccgagtggaccgagtgccaagaggatacccccgtggagaaaatagagcactggaccatgcattttgacgggtcaaaaagactttcgggcactggagctggggtggttttaatttccccgactggagaaagactaagttatgtgctttggatacatttttcggcgtctcacaacgtcgccgagtatgaggcgctccttcatgggctacggattgcaatttccctagggataaagcgtctaattgttcgaggtgattcacagctggttgtcaaccaagttatgaaagagtggtcctgcattgacgacaacatgatggcatatcgacaagaggtacgcaaactggaggataagttcgatggactcgagcttagccatgttcttcgacacaacaatgaagctgccgatagacttgcgaactttggatccaagcgcgaggcagcgccatctgatgttttcgtcgagcacctttattcgccgacagtacctcacaaagatgctactcaagctgcggacactcatgacatagctatggttgaagccgactggcgagagcccctcatacgatttttgacttctcaagaactccctcaagacaaagatgaggccgagcggatttcaaggcggagcaaactttatgttatgcatgaagccgagttatacaagaaaagcccttcaggaattctgcaacgctgcgtatctttagaggaagggagacaattgctgaaggacatacattctgggatatgcggaaaccatgctgcagcgcgcactattgttggcaaagcttaccggcagggttttttctggcctactgcagtgtccgacgccgacaaaattgtgcgcacatgtgaaggttgccaattttttgcccgacaaattcatctaccagctcaagagttgcagactatcccgctgtcttggccgtttgcggtttgggggctcgacatggttggcccgtttaaaaaggcagtcggcggttacacgcacctcttcgtggccatcgacaaattttccaagtggatcgaagctaagcctgttgtcacgattacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgag

SEQ ID NO: 7855 - DNA, 836 bp, Oryza sativa
  unsure (1)..(836): unsure at all n locations
nnnnnnnnnnnnnnnnnnnnnnnnnnnnnnnnnnnnnnatgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttccttgggttttaggctcaaca

SEQ ID NO: 7856 - DNA, 1233 bp, Oryza sativa
  unsure (1)..(1233): unsure at all n locations
cacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatacagttatgccagtttaaaccgatgaaacggatctagggattaccttttgatgaaccactcagctcatagtttgaatcctggagctgagcgattcggtcccttaattccttctccgtcttcttggcgtgctccttggcctcatgtagctggtccctaaccgcttcaagagttcccaaatgaggaaccagcctttctaaagttgcggttttggcctcattgcgaagatggattctctgcatagtggttcacggttaggttctgctaaaaagaaaacaaagttaccgaaggccgtcacccggaggacttacatttacaatacgagtggcttctccgagcgctttcttcagctggcacacttcttcatcttctttttgacggtttatgactataccgccggcttgtgagttctcgtcccaccatttgatcaagataggaggacgagagtcgtcggttgcctttatgcgagggatttcctctccgtcatcacctgatggtcctgatgtgtttccaagacgttagacggataaactgaggttatttaaatcgccattgtttgagaagacaactaacctgaagatgtacctagctgagcgtgaggtgatctttgttctttatttggagacccgattatcgagtcgttaccagcctctggtccttgcgaagtcgtcgtctgcgcttctacttcggggatctcttgatcaggacctgcatccgactgatttccagtcgggggctcttgagttgttgccgtttcagttgttgccgactggtttccagtcggcggcaggtcactcggattggtcctatcgcccgaagtatgggcgccagtcggctggctttcagcagtcggtggttttcagcagtcggctcggggtccttggatatattttgctctgtcatggcaggatcgcggtctttcccagatggatctatatcagatggtttcctgcagagtgttctttcaatattcagcatnnnnnnnnnnnnnnnnnnnnnnnnnnnnnnnnnnnnnnnnnnnnnnnnnnnnnnnnnnnnn

SEQ ID NO: 7857 - DNA, 1122 bp, Oryza sativa
  unsure (1)..(1122): unsure at all n locations
nnnnnnnnnnnnnnnnnnnnnnnnnnnnnnnnnnnnnnnnnnnnnnnnnnnnnnnaggagcacgcccagaagacggttaaggtattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccgccaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaataatccaagccatgttcctcaataatggtggtccgagtgcactcgacgcaaccgaaatatttgacaagctgagtgttgctccgaaagtatatttcaagaatatcaagaaagctgaaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttacccaaaattttcaaaccggccaaattacccccctaagtcaatccggggtggttttggtttgacgtggcgcacacgtggcactagtttgattgatgtggcagtccaacatggaaataacaataataaaaatggtgggccctaccagtcaggcacctattctgattatacgagagagtgagagagggcagaaggggtgtgggcggcggagctcaaggctagagggtaccgag

SEQ ID NO: 7858 - DNA, 1114 bp, Oryza sativa
ctgagcttttgatgcttgtcaacctgcctcaatgccattgtctaccctctccgagctctccgtagccgctactagagctcgcttgctctcgtgcttgcttgcctatcggtgaatctactgtgcgtgtatgctcggccgctggctttgccgtcagtcgttcgctgcgccgattgctcacgcgtgctcgccaatgttcagtccgttgccgctcgtccttgcggcaggcgcttgctagtgctctacgtcaacagcttgtcgatactcagccaccatctctcgccagtgctctactcacggatgcatgtcgtcgtttcgtcgagaatccaagaagagatgggaaatgaaagaagattagggtagaaaaagaaggtggggggcaaacgagggtattctgctgaactttgtagcaaatctgtaatgccacttaactttgtggtagatgttgagtatgctctccaactttgtggcgtatcagaatttttcatgaaatttgtttatttgtgttgttcttttcttatgaaaatgacatttattcagaaattcatgccaaataatttggatgatgcagaccgtatgttttataaaggagctacgaattgaaaaaaaaatacatctcatattcacatacccattgatcaatttaatttatgtgttgtttttgtcccatgttagacttcttcgtcttacattaggatatctcaatttctatctggagatggctaaatgatttctgacatcaaattaacaaaagatcgtagatgagatcgatctcttgtcaacatcggggctgttcaaattaatgcaattttcaaccatactattttttaagtaaagttgtcaaaaaaaaatatagtttgttaccaaatttaataaatacagaagaaatccttccaaaatttggtaaggtttatttttggttataatttaaacaggcccatcgacatggcaaatgttctctctctcttttagaaactatggcaagtgttctcgttggggaaaacgaaaactgaagtgaattttggcccagcccaaaccacaaacctaaatcgacaaaacaagtcttaatcaatcacaggccgatctgcgttaacagagaggaaacaaaatcatcccc

SEQ ID NO: 7859 - DNA, 2818 bp, Oryza sativa
  unsure (1)..(2818): unsure at all n locations
nnnnnnnnnnnnnnnnnnnnnnnnnnnnnnnnnnnnnnnnnnnnnnnnnnnnnnnnnatccattgttgttaatggacagcgctacgctacgcataccatttactctgagcaaatcatacaccaattgattctaacaagttactatactctactctgcaagcaactggttaggaaatgaaaaaaaaaggaaaaagaaagcaaggatcgaatctaagcagctgattccaacgagcaacaaggaaaatgggggtagaagtagaagcggggcggtgagaccagaggatggaggcgcaaatcggtgagctcggaggcgacgccacccgccacctctacctcgatgcggccccgaatccacctgctccgggcgcgtgggtctcttggtggccgggaaggagaggcacgggatcgacgatctggtggcggtggcggcggtggcccgacgaggaggaagaggcgacacggggcggggagaggagcagcccgctgtgcctctgcggctccgcttgatctccggcgaagctcctctaccgccgccggcggctggtggagaaaggtggacctcctcgccccgacgacctcctccccattgccggccggccgctgctgccgagccgctggagcctcgccgtccttctgaggaagagacacctctcttctctgtgttggcgcagggaaggaggtagaagagacacctgacaagcgggtcccatctgaggaaggatgagaagaggggaaaaagagttgacgtggcatactgacacgtgggccccatgtgggttccacgctgactcaactgccacgtaggttaaaaccggagtcaaaaccattaaagaacctattgtgaccggttttgattagttaagggacgccgggtatctggttttgtagtttagggacgattttgtaactcgaggacaagttgagggaccttcgatgtactttttcctaacagagatgtgctttagcggctaagcctaagctaattacggcccacgaccacgagcccggctgaggcccagggcccagagcccagggcccatcctctgcgccgctgccacctcctcatttcacctcgcttatcgcctcccaaatccactcgtccgtctccctccacccatggcggccatggccaccccgcagcaatgctggctccccacccgcgcgcgcgctccccctcctcctcctccacgcgcaccctcctccgcgtcccccgtctccggagctcccgcctccctccgcttccgtgggcgccgcgccgcgtcggcgtcggcgtctgcggcgaggaggaggaggggagcctccctgccctgctcccccaggtagcataccagcatcacttctcgagagtaaaattgcgccgtacgcgcttcatcccgcattggcggaggagctccgcttcatttcgatcttttttttgcttatccgcttcgcaggtgcgcgttggagacggctggccctggctttgatcccctagggctgtacaacgatgggccttcgaggaatgacacgcagtccccgctgtcgaacttcttcggagtactgtcgccggtgttcgggagctcgagcggcggcaggaaggagaagtcctatggacgaggagcagcaggttgccaagttaaccccttcctattttttgtgcgtgtaactttgagaatttgttgttaaatgcttttggaatatctgtactaatttacctatgcagtaccattctacatcattgtaggagcgtgttattacttattaggataaatgcgtagtttgagctgaagacgatgttatgttagtaaattgttagtgaagaaattattgaaaattttccatctaagtaatatgatgaagttctgagagagctaccatgtaatttacgtagtacttagattttttttaacacagatgtaatctggtaatggtaaatcctagagacttcagtatgcgtgaaaggaaacctcttgattacacatggttttgacataatgttatcagcaggatcttgcttgttataaatatgtggaactactactctaacttttcatgttgtttgtaaaattaactcaagttatgttcatatttttctatcagtgcaaaaacttattttacccatgcatgcctcataggctgttactgttcaattacttacgagcattgacctatgttgttcatgtatctgcagcttgaatccactttaaggctcagttcgttccctccctttcccaacctcccttcctcgttttccgcgcgcacgcttttcaaactattaaacggtgtgttttttgcaaaaaaattctatacaaaagttgcttaaaaaaattatattaatccatttttgaaaatttttttagcaaatacttaattaatcatccgttaatcgctgctccgttttccgtgcgtgggagtgaggttcccaaccctcactcctgaacgcagcctaataagtttaaccaactagaattcctatttaaaatgtgtcttaacccaagtagttcccttttgagcagctgcaattgaagatagttccattgacattggtgacttcttcaagggtcctctacctgggaagttcttgaagctccttggttatttggccttgtctcgacttggtatttatatacctctgggtggagtgaaccgggatgctttcgctggtaatcttgaccagaacagtctactaggcactttggattctttttctggtgaaggtattggccgacttggaatatgctcccttggcattgttccatttatcaatgcacagattgtgtttcagcttcttgcacaactttatcccaaattgcaagatcttcagaaaaaagaaggagag

SEQ ID NO: 7860 - DNA, 1277 bp, Oryza sativa
tatttgagatcacttgggtggtttcaggaagccgagaggaaaattccgctaaattatgcttctcgatacagtagtcggagtggagggctccaacgatctgcatatctaccatttaaggtttgctgtgcttccatttaattctatttaatgtctatatttccatatattttgtgcaagggttgagtttgagcttcagcttttagttgatactctggatgcttctcatttgaatacttacaattcagaactttctccaaatttattgatagtattacatttgcattgtgacttaccacatgttggaagaatgacctatcttcatttgatagttgtggtttcgtgcaaaataagggataattctgaaagttggtatgcagactcctagttgttattcttgattatatgttgtctgtactcttctaaccgttcatttgaatgacactcaattcacctttttggttcactttctatttttctttgtttattactttaaaccgttccattggcacttttgggtgtctgacttaacaatctaagggcatgtttgggggagcttctagctgttgcagcttctcctagaatcagacgctcccccaaacagtccagcttttggtctagattctgagaagctgtagttgtagaatctagaaaatgaactagaagctagaagctgggaaactcagcttttccagattctcagaagctgcctaccagccagttgcttctcagaattttaagctctccaaacaggccctaaataactttgtagagggtgtatggacgaattaaagccagaggatatcacccatatgttctgacttaacaatctaaataactttgatctaacaagagttggagcctgtaggaccaagcacacaattattctgttattttttagcaaatgaaataagatcaagcttctaatattttttttcttaacctctctccatcattgggagtcataattgttctaatttccattttatttgattttttatgtcctaccttacaaattaccaaaggaaatattgcttatgacttactatgctaccattatgagcaggtcaatagttctggtgtcatgcctataatattttctacatcttctttggctttgcctggtactttggcacgatttactggcttagagtttcttaaaaaggctgccatatccctaaatccagaaggtaaacaaggagtttctataattcttttgaaatttgttgtctttatatgggagatggcaatgcgggtaccgagctcgaattcgccctata

SEQ ID NO: 7861 - DNA, 714 bp, Oryza sativa
  unsure (1)..(714): unsure at all n locations
nnnnnnnnnnnnnnnnnnnnnnnnnnnnnnnnnnnnnnnnnnnnnnnnnnnnnnnnnnactcacgtcctactggcatcgtggagtacgacgaatttagctctcgctacaacgacttcgacgactacgacgacttcgacggaagcctagatgacaactacacccctctctactttggcgttttcatggccaataatgagacggaggagcaacgccaagtccgggagaccgaagaacgtcgccgactggaagaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagacgtcgaagggacaccggttttccgcacccctcaacagaatgcggttgccgcgatcactcttctcgacaccctcctcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcatgactaccgtcatccaagcctcagcatcaccggcgcaggatccaaccgcaggagcaggggtcacgacgagcgggctggtcactcacctcccgaccttcatagggagcgc

SEQ ID NO: 7862 - DNA, 715 bp, Oryza sativa
  unsure (1)..(715): unsure at all n locations
tttttttcggagaaaagatattccaatggcaaaactttccaaataattatattaccataggaaagataaatggtccaggaaaaaaagggttgtgataatttggaaaaataaacatatttatcggtagttccctaaaagtgaaaactattccctatatcagaagtgccaggtatagtatacaaaaccgtggctttatattaccttgatcccttccagtgaataactaaagtaccttggatattatacaacatgctttaagtggctttttttatgattctttatggaaattcaagctttgattttcataacaagctcaatactgtagccccagaagtggagagaatctatatagatcattgaacacacatttttctcagacgatcccatatccaagaggtagttgattcaataaacattcaaatattgtcaaacacctcctgnggctagattgatctcatagtttacaatgatgaaataagaaataacataagtttttattcatgtacttttatcagattcaaatttcacaaaataaaattaaagccatccaaaagctaatactggagcaatgcctgacttagaccgccaacagaaaaacggtccagagcatgggagaggaatattcaatgccttaaccccatgctattcctagcattgagtccttcgaacaaagctgttttgctcctgctgcctcgattcaaaatcatgtagacaa

SEQ ID NO: 7863 - DNA, 743 bp, Oryza sativa
ctataggcgaattcgagctcggtaccctgctgttcagcccgacacgccccaatatcttccatgggcaaaaaatgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggagaaaccgaagccgagactaaaaagattcccttagatccttctgatcctaccaaaactgctgtaataggcgccgagttagatt

SEQ ID NO: 7864 - DNA, 546 bp, Oryza sativa
  unsure (1)..(546): unsure at all n locations
nnnnnnnnnnnnnnnnnnnnnnnnnnnnnnnnnnnnnnnnnnnnnnnnnnnnnnnnnnaaagcccgaataatgaattaaagggttatattagtgtgaagtatggcatgctttcttttcttgagcactttgacagattggtgggagataaaagatatgaagaggtaaagtgtgactttagagcaacacaaagtacaccgaagctaaaggcagagttgagaattttgagagatgtagcagaagtttatactccagcagtttataagatatttgaggaagaggtaatgcagactttgaattgtgacatattctactgtggtgaggttgatgcagaaaaggtgtacaaaataaaggccaacggtaaatgcatcttgaacatgttcatcttgaacatgttgttagatactctccgttggaatccaatgttaaatgcagttgcaagaagtttgaatttgctggcatcttgtgctctcatgcactgaagatacttgacgtcaacaacatcaaatcagttcctcaacaatactacctccgttttttaatagatg

SEQ ID NO: 7865 - DNA, 619 bp, Oryza sativa
ctagaggatcccccgcgacatctatggctatcaatataagaccccttagggaggggaagacaagcccatacaaatcaacaagctcagtcagaatagataccaatacaggccaccagacatcaacatcaaagatcagcctagacagacccaatctggtgccatcagaggacgacaagagggatctagcatcataggacgacaagagggatctagcactatccctgatcttgccgagtatgtattcaaggaggaagactaccccgtcgtcgactacttgttggagctccatgccaccaagccaacgatgactagatagggcatcccaaatattatacttggggaattcaaatgaataacagcaacaccggcttagggcaacaagagtcgggttataaccttccggggaaggggcccaaacctgtaaataaaatccttggcctctgctgttttacctcaacctcgcatatattctgataccaacaatgcccataccatgcaaataccgttaaacgtgatctcaaacatctacagcggcataccagataggcccattggttcttcaaggtttcgaccacatggggccaagaaatggaacctgcgacaacacactacttgatga

SEQ ID NO: 7866 - DNA, 9545 bp, Oryza sativa
  unsure (1)..(9545): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccattttttccaattccctcagccaccttcaattatccaatcaaaatctcgttctctcctcccactgatcaaatatcttcctctcccatgaatcaaacttttcccctccctaatcaatttctttctttaacaccaaaaattaaatcgccattatgagctgaattcattttttttccaaacacccaatgacttgtcatctcctagctactcaccttcctcctccctcaaacggccacgttcctgctcaaccttgaagcagtgccatctcttccaattcctccctcccattaatcaattcctatacttaatgccaaaaactgaatctctatgataatttggatccgtttttctaattaccttgggctctccatctcccgatcatcatctacccttcttcttcctctggccagcagcaggccaaaagcccccctgtccctcatattcccgcctgcagcgccgccagaacagaagtgcattctccatgaaggctatgccgcctcctccaactcccttcactgatcctttcctctccttcatcaattttcgtcaccaacactaaaaattgaatcaacttgttgatctaaatccgtttttgcaattcccggtgacttctcatctccaggacactataacctttccccgccatctctctccatcttcctccaccggggcatcgtcaactacgtcgtcttgctgctgccgctgctcaccacagtgtggtctccagagatcacaaactgctgcaggggaaccaaaatcgtcttcatcatcgtctcgttcttgctcgccacccaagcgtgccaccgtcgtggttggtaagcacatccctattcatagcctgatgcctctctttttcccctgatgctgtcaaacatcgagtggttgcgcgactcgtcgccatcctaacgtcccatttgcagtgccgccactgtcgccgggagttctaactgatgtgccatcttctccgtgcgtctcgttgccaagacatcgctgcgaccacatctccattatcgaggttggtaagcgcctgcaccacatccactccattagtagttttatccttcccgttcatcgcctagtgtcatgcgtggatcattgtggatccattattgagatcaccacgcaccatgtgcaaatgccgttgcagaggaacataagagctccaccttgttctccctgtcctatttttgagactatcgtggctgtccggaagatgagacttggcatgtcctcatctctggcaccatcttctgtcaaactacagtcgtacctcggtgcctccatccctcatgcccagcgtctccacttctaactccttagacagtctcgccatcgaccagccgccaaggtgctgttgcctctgctccatgcaagcatgacgccatcaccagcccaaaccgcacatgctttttctatcgccaaaccaagtcttagcctcattgtttcggtttctccacggaagcaacaccagctcatccaatcccctctcttccttcaaaatttctccatcaacactaaaaattaaatcctttccaatggttggagttgttgtcccaatttctgcagtcacctctccatctcttagctgttcatctctcatctgctcccctacaaatagcagccttgtgttcttcgaacagacaccaagatgccgctgcattagagctctaccacttagcctacttatgtcgctcataggaagctcaagcagcactgctacaatcatcgacttgatcacaagctgctgcccttggagatcgagctggcatcatcgttgtctcgttgtgagcggtgctaccgctgttgggagctcaagccgatgtagttgtctcctctgtgctcattgtcggaacaaatcttctcccggcatttcctttgttctttttttttcatacaccactgctgtccttggtgagtctcggtgccacatcctcttccttcccctatgtcaactagcaccattgctctctttctcgagcccgatgtttctcttcttccaggtgccatcgaattactagtgaccatgtcgtcgtcatcatatcgtccactccggagggccaacgcagctgttgtcctctcgctgccttaggttggcaaccacgtcacaccgtcacttctgtcattgtctaagagtctggcatggcatgttcgttgtctcacacccatcgatcagtagactcaatccttcggccataaaatttattccaataaaattcaaaaatgccggagaatatttcttattcttttcctttgaattttcttccaatttaatattttgtcagtcatatctcggtcctcgacaagcatcaccgctccatttcacgatcatggcatcgtcctcttacccactatgcccttgcttctctcctttttcgatccggtgtttctcctatgatatccatgttgtgtggcactatgtcgcacaagtcctggacaagccggtcccctaaaacccaaaaccaatccaagtcatcgattttcacaaataaatctcagcctccatataatcagtccacaactctcatccttgtaaccaattaactgttgatcatcccaatgacaggtggaccaccccgtcagtccaccaaaaataattcctttgtttccttaacttcagagaatattttataaatatttctctttctttattcacggtttccgaataattcaatcttccgaaggtcacatctcttccatccaaactccgattcggcccattctttttcctaaattcttctaaaattgagctctacctcctgatttaattggttatttcatttgttgttattttgctgccttttcttttttttatttgttttctcctttttgcaatcgtgtagacgccgttgccgaggaggttgctgttgcaggtgaaggttcagtctgaagatcccgtgggtaaaggcaagtgtacccttgaacatgttgatcctaacttgcaaaattatcttgttttaaattatatgcatgatttgtttcacaaattatcgtgtgggtagttatgacctacttgttaattattccatgccttgaattattgttgattatccttaattatttgtcacctagactgtatgagagtcaaacatggggtattggctcagggcagtagatttgcttaccctgctcacacttatacaaattaaaatataatattgactaatgatctacttatcactgttttttttatataaactgtgtggttgtgtgctatcttcttggtggcatgtgttgcaccgtgtagtaatgatctggtggaaaatgttttagaccggggcgatggtggatctgtgtgaacctaggaggtaagccatctgtgtgcgtgcttaccgttgacctgtgtggtcgattgagctgtgtgctcctaagctgtgtgctccatttttgctgtgtgcttgaggtacttagtttaggcaagtcgccctggtcagttaaggacttcacttcgtgcgccatctgagccttaccgtgcaaccacatgtccttatgggaaggacctagcttagtacactacttagctctggcactggcggcccaggtggctagatgataggtttttggattgtaccataggacctttcacttgtgtggtgaaaggaggaccacccaagggggaagccggtgttagggcgaggtagaggaaacgctttgttactctttggtgtttagcggcactgaactgtatcttgtgggtaaagttgtacaacctttgcagagtgtcaatccattcgaatagccacatcctcggttatggatatgctcggtgatttcacatgaggggtagatttgtgaaagttttacttttgggaaagagctatgtgcaggataaattaatgaatatagctgtgtggtcctgtgtgcagtatcctttttgaattggttggttggttaaaaatatcgtaattgcaaatgttgtttaaattaaatttacatctatttattgtatttaaattcgcaaatgcctttatacaaatgaaccataaccttgctttgaagccttgtatcatatattgcatattcccgtacacttgtgagtactttatgtactcacccttgttgtctcacaaaatttcagagaaggccagttgtttccagaagttctgttgctgaggatgtcgaataggttgcgtgccccagtcgattgcctgtggtgtgtcattggtgcctctcgcttctttttccgctgcttatctttgtttggccctgtgtggcaaagaaattgtaaaatatggtcataagaccaatgtaaaaattatatttgtttcctatttattaatgtaatcgtgatgtggttgtgatattatcttttgttactgtgtgtgcaagcgttgatttgggactagcacattatacatagagggatcctagttggggtcccgacaaggtgccaaattcaaattggcttcaagatattaattttatcgaatgggcatctcaaaaataaaaaaatgacaagaaaggtaactcgatgatccatatcttgttatttaaattggtatgatttggaacacttgccttgtctgtgcatctaggccaagtttcattccttgctaattagcctaatttgcaaaatgttgtgacgacatgcttgttttgtcaataagagagtattagtcacaaagttgttctaagtgaatcaatgtgcttggagacctcgttctatgtgaatttttggtcttagcacaaactatgagattcatacatgcgaaactcatttgtgaaatgttttgtgaaaatcttgggtaagattttttttaaaaaaaaactcttgaatctcactcgaatttgtgacaaagtggtttggcaagttcaaatctcgatgatcctcttcattgtatatcatgtcctctccttaccatgcttaagtgccaaagtaggagagaatgactaaaggggagacttcttctatgctttaaacccttggcatgtgagctttctatgcgcaaaatttgtatcaatgcttattgatttacttgtgatctttatgtaaaattgatcttcatttcctaaccacaagtgatgaaatataaaattgaaaggtaagaactcgatgatccctcatcaagaatccctttgcttttctttccctacttatgccctttttggtgttagatgtcaaagggggagaagtatactaaaggggttaaagaaaagattaatcaaagggtgagatatttgtgagaacttatcaaaatgcatgctttaaagatgccaaagagtaaatgagaaagggggagagaatattttttttgaaagaaccacggtaggggaagcccccaccgttaagattttatattaataaaggagaaaaaattacaacaaatttaaccactgtaacaatgtatatctctcagaatttttgactctatgaactaaaagggagagatcattcctaaagagaactctccaagagggaacagaggaaacaatgttttcaaaaattaaactattcctctgcttccaaatggtccaagcagcataaagcaccttctcaacaaaatgggtagagttatatgaatttctggccatgaccaacatttcaccaaagcttaaagaaagattccaaaccacaccaaattgcgcccaacattgagtgctaaaaggacactggaaaaataagtggagagttgtttcccttgatcctgttgaacaaagtacacagagcaaggaagcattttgaggggagcaatgccttctgtctaacatgtcataagtatttaaccgattaatcaagagtagccaaccaaacaccttgactttcatagtacaactgctcttccaaatccatttaatataaacaggcacatggacatgagaaaaattcatggcataaattttctgtgaggaaaagataccgttgccccaaacatatgtccaacgatcactctcatcattaagatgctccaaggtatctgcagctgacattgccaaatattcctgaaaagcttgctctgatagtggcaaggcaaagagctgaggtagatcagaagtaaagaacatcagaactaagagatttgaattcctggcaaaagaatatattctgagataaaccaaggccctgactttattgttccacaaatcttcccaaaacaaacaagattttccatcttgcacagtacaggccgagatgcctctaaaaatatccacaaattgcaaaatatccctccaccaaaaagatcctttaggagtaacaacatgaggaggttctgcagtgtagtaagtattccaaatcaaactgacccagggaacaggatatctattatagaacttatgcagattcttcaagagaagggcattaggggtgtgaatgtttgaaagtgtttatcaatgggtgtgaatgtttattatttgatcaccatgcctcatgcaattgagattatcttttgttacttgaaattgtttacaaacttgattactcatgctttctcaatcggtaccggaatcaattgcatagaataaagtttttgcaattggcatcgagaatttcatttgatacattttgaatcggtgccaagatttgagttgtgtgtgttgttataattttggtatctccttcacacacaatacaccccatggatgcaaagagttagggggagctctcacattttcaaaaatatgtgcctatgtgttcactttataaacttgtatgcaccgatttaggggagctcaaactaacctttggattcaaaatcatttattatcaatcttctgtaagctttaaacgtgttgtcataaatcaccaaaagggggagattgaaagaacatttatgcccctagtgggttttggtttattgatgacaaacgattaaaggactaatgcacttgaagatgaagaagctaggaaaatggacttatagatggatgagaattaaagagaagatattgaagatgcggtatgaagtgactacctatgtcaagatggtgaagcgcaagcgacactcaactgcgatggaccatgcggtggtgaagggcaagtgaggggcttggcgccgacgaaccgaaaccggtggtgaagggcgagtgaggattgtgtcgtgatgaaccgtgcgaggccatttgaagccatggattatccgcatcaatcatttgagaaaaagaagataaaatgtcaaagatcaagaagatgagatcttcccgatgatcaaatgaccttgacgttggtaaccctccaagtgaagaaacaatatggtgtgaaggtactcctattggtataactttgccttttaaatttgagtttaggatgccgtactattaagagggataccacatgcatataattggttgaatactagtgctcaaaatgcttcatttttatgtgagttgaaaaacctaagccaaaatttcaatcccgagttgtttcacttgtcacaacacttacactgggtttctttgcaagtttttcaacatctcttgaaggttttggaccatgttttatgttgggtttgatagcccatgaaactagctttccatagagtacaagatcttcgaaatcggagttcggagtaaaaagttattgcatttttacttgagcaacatcacactatccgatttgaaatcagactatccgatgtatcggactatccgatttttaacacaacttcactctctgtctttgtttgaaaaatcctttcgagtgagtttttctaagtgtcggagtattcgatgttggatcagatagttcgatgatacagagactccgaaaattcatgaaacatcagtctctgtttgacgacgaagtttttgcttctaaaatatcggatactccgatttaacatcagatagtccgatgtctcggaaagtccgaaatttcatggaacttcgttctctgtttctcgttgccttggaggtttaaaatatcgaactatctgatcttgtatcatttgagaaagattcccctccaacggtcacattttgggggatctatataaacccccaccaacccttttctagggttgcccaaactgatttcattccaatcttgctttgggttgagctttgtgctaagtgctttggatttttgagctctctccctccctatctcaaatcccccttgttctttgtgacttgggtctttgtgtgtggatttggagtttgggagcctagtgtgtgtttctcttaatcttgagcactaggatttgtccaagagttgtgcggtgtttattactcttggaggttgaggactcctaagcggctaagtgtcgttcttgggccaccgatctacgtgtggttgtccaagagaagtttgagaaggctggatctcgcctccgcaaggaagttgatacccttagtggaaggaggagtgtatttgtgcaacctcacgaggatagggttgaaaaagacccagctttttgcgagcccttcaacggagactagaattccctcaagtatttgaactccgggaaatacatcagcacataaacctcggtgatatcctcactctccttaccttcttgttccattgctttgtactacgctaatattgttgttggtcgagctcacctctttgcttgtggattgaatctaaagctcttaggttgttctcttgtttgtattgttgttgtgcaggtcagatagtctgatctcagttcagactatccgatcacttaggactatccgacctaatatcagacaatccaaccctgttttgttttagctttcgcatttatttttaaaaaccgcctattcatcccccccctctaggcaacatcaaggtcctttcatacccttcaaacaagaagatgcacatcgtgagggatggaaagcaccgaattgtaggagttgacaacgtcgtcgatgaagaagaatacaaccagaatcttcatgtaagaccttacattgaccttgacgatgatccccaagagcctgtgtcatatgctcgttcagatcatacggaaggcataaccttgtgatcgatatgatgcatttgtacttatctattgtaatgaatgaagtatgttgttttattacaatgacttgatatgtgtagtcatttatatgtctaattttgttttattacaaatgttgtttaaatatgtcatacattcaaattggaaatgttgtgtagtcatttaaatatgttgtgtagtcatttatatggctaatttaaatgttgtttacattattgtacagcagctatgtattttgcattcacaaatataaagacttgatgggaaaaatggaaaaatagtcatcggtgacaggccttagtttaaggccgatagagattaatctatctcaatcgggcattgtcgtagggcccgtcacagatgagtcatc

SEQ ID NO: 7867 - DNA, 8677 bp, Oryza sativa
ccaaaataaaagttgtagatcttgatgagaggatcaactttgttgttgttgactttttcatttgaaatcatttactatttacaaatgctgtttaaatttgtcatattgtcaaaattaatttcaagctgttgggaacaaagttatatagacaaaagaccaaaataaaagttgtagatcttgataacctttacaattttgttgttgcccatatttcgatttgaaatcatttactatccgaaaatgtattatgactaataaaatgaattattatatagcagctatatattttgcactcacaaatataaagacttgattggaaaaatggaaaaatagtcatcggtgacggaccttagtttaagcccgataagattaagctatctgtaccgggcattatcttagggcccgtcacacatcagtcatccgtgacaggcgtaaatgtcatctcaatcgggcattagtatggagcccgtcacccatgagtcatctgtgacgggccctacgacaatgcccgattgagatgactcatcactctactataactagggtttcatagatcggatcgaaaatttttctaagtcccgcacagttttccgcctccttagaaccctagcgccgccgccaactcctcctttgccgccgtcgtccttcctcgcagccacagccaccgagcccgccaccgcaccaccgagcctaccgtcgccgccaccgagcccgccgctttcaccgagcccgccgccgccgccaccgagcctctacactgaccggcgtcggccttcctcctcgtcgccgcctgcctcctcaccgacgcaaatagctgacccccatcgagcccggcgacgtccttcctcatcgtcgttgcctactcctcaccgacgcccgacgccgacctcccgaccagcgtctacaccgaccgctgctgcccttcaccgagcccggcgccgccgccgcgaactcctcctttgacgagcccgcgcgccgccgccgccaccgagctcgccgcctccaccgaccggcgacgccctccagcgagcccgccgcctccaccaccgagcccccccccctccccccggccgtcctcaggtgagtcctccatcacggcgccctctactacctgtggtgaatgatgaaatgtggatgttaggatgatgaaatgtggatgttgggatgaatttagagatagatgatttttttgattgatgacatgttgatgaatagatggaatgtggtgcattaatgaatttagtgacagatgcatgatatgtggatgaatagatgatatatgaggtgaatttatgattttcggatttgatgatatgtttcatttatttataagtgacattcaattcattgtaattgattttagcactgaattgtgtattttcattattttgaaaaaaagtagacgatgtctcagcaaggcgaaccaatgtcaacgacagctagtgggtcctcaagggcacgtactactaggacagggaacaaaatccctaaggaacggttccgcataacagtggtgaaccaagtagggttgccgacaggtccaaggaaaatattgagccgatttaggtctatctgcggtgtcataggggggcagaaattcagtattctgcaggatgacatcaagcaagtgccggccgcagagaaggacagtgcttggctagcgttcaagaagagcttcaattatcctgcagagcacaagtaccttattaggcaggctgcttttaaggtcaggggcaattcttgtaagaacttcaagagtaagctagtcggcgagttcgtcttcaacccggcgaatcccgatccaacagagaaatttccttggatcatggaacaggtctgggaggaattacacgcgaagaagtcgacccccgattccagagctagaagcgaggcatatcgcttgctccagaccaagaactagcattcgcaccggcttggcaccaccggatatgccggtaaggaagaggaatggttgcaggaggatgaagaagcggaggaatcgaacacaccgcgggtgtttggcgatatcccacatcctcgggctaggaactgggccagggccaggtaccagaacaatgctgatggtacattcttcatgccaaatccagaagatcaacgaatgtacgaagctatagtaagtgtctagtcaaaatagatgttcgcattgtttcccatcatgcagtttatttaaccccactaaattgtaatgcagaaggagttggttgccgagcaacaaacctcgcaagattcctgctctcaaagacgcgaggacgacctcctcacaaaagcgttgggcaacaaggaacaccgtggacagacacggggtgttgggtcttctgttccctagaagtatggatttccagactacgcgtggcagtacaagaagcggacttccaacaaggcggacaaagatgcacgccttgaagccaagatccgggcgtcgataagtgcggagctgacatctgaatttgacgaaaagctcgagtcgatgagggccaagatcaggcaagagcaacagaaccccaggccgccactgctgctacgcatgaagagttaggaagtcccacccaaaaacgcagcagttgcgcatcaactgagttggcggaaaatccaacatcggtcgacagcgccgtcgaccacataacggtaaaagtttcgtccacaatgcatgaaagacttaacgaatccatatgatatataatattctaaaaaaatgatgaatctatcgcaggaaccaacgagctgcaccctcacagttagggtgatgccgaccttcacggttccagcagccgagggacttgcgtacaagccgaccccagagactagagtgcatggagcacaacttaggggcgactgtgcaaaagttcaagtcgactcggtgaagcccaaatacgagctgttcccactgaagtatccaccaaacgacgaggtcctctcactaggaaatgcttgtggtaccttcatccaatggcccaaggacctcattgagataagggttatagcgaggccaaccactacaccaggcggtcgtccgccaaagagacccgcctctgctccttcagcccgtcctactcaagatcgtcatgcacaatcttacaatgtgcagttgcagtacgacatggattttggggaggaccgaatggaggccaacagcaaggcgattcatgaacccacaccgatgaagaagagcaagaaggcacactcttcccctcagataattactctcgataaacccgaagcaaaggggagagaaaggggaggaaaggtgcaggcctcgcttctagctccaaggaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacgtatactacatggagaaatctaacgccaggaggccgaataaagctaccgatatccttggagagcacgatggaaagccattccttggtccaacaaattatatcgtggtcgacttcaaggatctattcgacctctacaggctccgcgcagtagacacaagcctccttaagtactactccttgtaagtattgtcgcccaactcaatctggtaataacaatcggtttaactcgcttacaagatcgtttatcttgtgtgtaggttaagttggcaatggtgtcagaagaatgcaccggaagttgccttccttgatctacaagtggtcactgtcacaaatctctagaatgaccgtcaaggaatggtcaactacatctacgacaccttgtggtcccgccaagacaaggagaatattatgtgtgcctataatcaatagtaagtgtgttatctaaatatacacaatagcatgacacattccttcagtacttaattaactttcactatattaatgccgcagtccccattggatccttctggtcataacacctaagtggagtacatgtcactacctgaactccataattgataagaacgcatatgattggaccccaattcaactagcgatagatgaagcgtgggcccaatacgtgcaaagacgaggcctcaggaagacaggatatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctaaatggtgatagactaactacattttagtactttttgcaggtgaaatatgataaatatttgaatggatgtgaaatatgtgaatagatgtgaaatatgagatggctgtgaatgtgtggttgtgtgaaatatattgatgtctatgtatgtgaatgcatatgtatgaatgggtgatgctggggggctggagatattggatatctgtatttgtttctatcatttttgcagcgggcatggctagcaaaggcctgaggctagccaaaaaacaagatttttttttttgtggattatagttatctgtgacgagccataactaaatgcccgattgagatgatggttatctgtaacgggcgtacttaatgcccgattgagatgactgtcatctgcgacgggctctagtttagacccgattgaggtcagtagtcatctgtgacggtcatctgtgacgggcgctagttgtggcccgattgagataggtcatctgtgacgggctatagtttgattggtcgtctgggtcaaagctatcggtgatgggctttacttagggcccgattgagatagattcatccgtgacggctgtttgcccgattgagataactcttcacatcagtgacttctagcctgtgacggatgctgtgcctgattgagatgagggtatccgttatagtgtatactacatatatggttaaaattgctttataactgaaatagtaaggaggatatatatgcgtgaaaatataggttctgtgcatccaaatatccaatacacagcaaacacatgtctcatgcgaaaaatctcctcacgtgtgacttttgccacgcgtgattattgattattgcagatttgggaaaccagcaaagatatgagctggcattaagccatttctgtgagagtgaaggtttgacaacgagatatattattggatcaaaccaatacaacccatacacaggactgtgcatagttgattgcatacatagtgacgttctttaaaaactatatacttctatgtggcatgcaacgacgggctgacggggacatataaaaggaaatgaagtggtcatcataagaatatcgatgcaaacttgttgcgaatgtggaggataaataaggagatgaaacactaccctaaaaacacaatcgatcattcactactatacagaagattcactttggtgcgcttgttgagaatcgatgtttggtaccagattcataactggcacccgtcaggtggcattgatgagatgccttataggagttggatatataaccaggacctataacttcataaaggtgccacttatgatcaataactggcacctatatgatgatgttataggtaccaaattttcagccacgtggctacatcaaaggtgcccatttattattaacatttggtacctaaaactttgtacacactagaaagttatagaaattcaatattcacaaccacatacattcacagccacatccacatccatatcttcatatacaatacattctccatcagcatatacctcccaaattcccaagtccaaagttcaacgtacaaatatatatctaaaaagggcttaatttcttcaacatatatatctctcctaaattcccatgtactaaaatttaacatacacatatatatctccacaaatacgacaaatgtgattgcgcttagggaagatacctagtcagagttggatttccaaattacgatccgctttcatgtcctgcagttatcatgcctgcaatagaaaacatataggagaatacttcctctgtttcacaatgtaagactttctagcattgcccacattcatatatatgttaatgaatctaggcatatatatgtgtctagattcattaacatatatatgaatgtgtgcaatgctagaaagtcttacattatgaaacggagggagtatgtaattatataaactattcaaacacattaaaatgtaaccttacataattctcggacagaagaccttggaataatagatgtcgtactcgcttgactgttctcggacaaccgagaaggtgtggagtatgcgactaaattctcgcttgaagtcaagaaatttcgtttcggcgggtacactgtcattttattccaccttgtcgaattccaccaactgatcttgggtaatcgagtagttgtagagtctatggcaaaaccctgaaatctgacatgattatgttgatatttcactttcctgaaatcaatactcagaacaaattgtttagatagaaatagcccccgagggaatgctcaagggtaacacaatataatatgaatttgaaaattgaaaataaaattaatctgcatgtgacaatctgccattagcaatcggagtatggtatcccttactagccccaagctgtctttatggaaaaatcgtttttccacaaaggcaactgaaaacttataacaaaccaagctgaagctgacaaaatcctagcccctagccatgaagttgggaaaatcaattcctgattacacggcttacttaatacgttgccatggagcgacatgaccaaatatgacatggttgtttggctttgcagtatctgatatggccttactagctctgggcatccccagccaaaatccccttaggtttctcggaggctttgtgagaatagcataaaggaacgatagaaacaacttcaagacagggagatataagaaaaagggatcaacggacaaatattgcacatataacacttacagaagttgatgcacatggggtgatgagttgactaccacacaaggtgaagaccgagtgtgtagttgtactcaacaaatcgcagaggtagtgggagaatcgctacgccgctggttgaagaccaattgtagccatacctcgaccactagaagttgaggcatgaggaccacgacaccgctgctcgaagaccagttgtagttttcacctcgaccattagaagttgaggtatgaggaccgctacgccgctggtcgaagaccagttgtagtcgtcacctcgaccattagaatttgactgataggtagcgagagatcactacaaccgactagtcgacaaccaggagtagacatatttcaatcacctgaaggcaactgataggtggcgagagatcgctacaatagactgttggataaccagtagtaggcatctcttgatctcctgaaggcaattcggagagatatatggatgacgtactcatgacctgcgaggaccgccacctgacgacaatgaagacgatgagggattatcttagttgggagcacgactcctggatctacggcctcatcctcagtccctattgaagtctgggaatctcaagtttcgtcgtcaccgggtgttgttgtgatgtcgttaacctcgtccgttgtcaccctgatctcgtcagtcctagacattgtcgtcctggtgactacggtgatcctatcggtctcggttgtcattatcatgaccacatcggttgttgtgttaggtggcaagagattactacaacagactagtcgagaaccaggagtaggtatctcttgatcacctgaaggcaactgataggtaacgagagatcgcaaaaattgactggttcgacaacaaggagtaggcatctcttgatcacctgatggcaactgataggtggtgagagatcgctacaatcgactggtcgagaaccaagagtaggcatatctcgatcacctggagaggcgctagagttggttattacatgtgcatctcatgtggccagcatgactcacatacccaacctatagcatatccggaggtccgttcgtaatcatgccgggtgatcaagctgatgacgttcgtgaggaattatccattaacaacctattctctttgttgtggccggctctatacgtgagataactagtcgtcgttctttgttggtaggtttcgtccgacaactcggcctttgtcgagaacattctcaataatggggtgtacttgaccacaacctactcgagtactcaattgttcctgaaaaatattttctagaagaaagacatatagcagagaatatcgagtatgtactaaaaaactacaagaatcttctagtattatcaggatatcatgagtagattaaatatcgtgtattacataaatcataaacaagcatgatttatataacgaaacagagcgagcctctagtattagaccgtagtcggcctaatatagaaaacactcacacaacagatatcgtataaaaagcatgctctaggtaaacataataaattacagatatgataatatcatatagatctgaaaaataggtatgttaaattacatataaaatattgcatacctttgtagatacatgccggatgtatctatgaaattagtagattaatttaaaaaaccaatctaccaattaccataacgcgtactcgttcgatatcatatatatatatgtatatatatatatata

SEQ ID NO: 7868 - DNA, 13176 bp, Oryza sativa
catgatttatataacgaaacagagcgagcctctagtattagaccgtagtcggcctaatatagaaaacactcacacaacagatatcgtataaaaagcatgctctaggtaaacataataaattacagatatgataatatcatatagatctgaaaaataggtatgttaaattacatataaaatattgcatacctttgtagatacatgccggatgtatctacaaaggtatgcaatattttatatgtatatatatatatatatatatatatatgaaatcttctggtacgccacatgtcttgaagtttggatgatcttgatagatcaaattgttgacgatgatgattcccgatctcgtcgggggacgtaccctggtcgggtcaaatctcctagggccaaattagttgaagtatactgtaataccccatatattaaaagattcttaggttttttagtttgggttgacttgtttaaaataaagatgttaacagaaataaataaaagaaaatatctttagatgtgggccaacatgagaaggcccataaacccagcccattagttcttccctaaaacctagagagaggggaaccgaatcccaccttccctcatagtgcggccacccatctccctggccggcgcctcctacctcccctcctcctgtgttcgcatctctcccatctacagcaaattgctctccctagatctccaccttcatagcttggatcaagaagcgaagtagaaaaacggaacgaggaggaggagaggagtaaaaggaggggttagatcggagtctcccctattgtctcctcacaagtcctctaacgaaaccctaggtgaggcttatcccctttttgtattagttgttgtagcatggctttagtgctttaattcgtggttagagaaggctagagaaggagtttgggtagttgcggtttggtttgttgcagttctgcatgtgggcagatttgcagtgcttcagtgtttcgatgtttcggggctctaaatgttattttctatgaaagtatataactaagaagttgtagataatgtttatatgtatcttctgaacaaagggcgtgattttatctcaagtggtttaggagatataatttttttagtacgattgttgtttttgtgtcataatctggatagtagtagattgaactgtttttggacaggttaaacagtggaatcagctaggccgcctatagacaaagttgtagaggtttttcttagctttccatattggtaaagtacaccctgaatcggtgagtggaactctagttatggttgttttagtgtggacagtctgaaattctggacagattctgaagcctgctttcaagcgcaagttagaccatctaaatggcagaataaaaatatgatttccacaaaagagttgtaggccttgttctgtagatttcgaaaatgtatttatttgttgtcatagccttttcatatttcaagatataaaggtttgaagcagcagtcttgtttatagtccaagcggtgttccttattattgcgttgtgatgggatggggaagtaggttcacctttttcattgttttatatgcatgtttgaatgtgtttgctgaggttttgtttgtgattaggtggtggtccttcagatcgtgaatgataccaacccttcattggaagcaagtgcatgacgaactaattgtatgattcatggattgtttgctctatctatttatttccgatatatttctatgtgacatgtgaccgcttatattcatattgttgttcgcgccatttaggttttcatgtctatcctatgtttacgacgttattcttgtttcaatattccggattctggttctgcttaaataattcaaattccctgcttgccatggatgtgcaatatggtttcaatttggttctttgattccggtttcaattattcaagtaccatgcgtagtcatgggagtgcaatttggttctttattcaagttcctatgggtaagtgctgatcacgcttactcggctttgccggcaaatgctaggatgtattcactattgtccgggatggaaactactatttcaattcatgcctgcccgggatgggaaatactatcttctttgacttggtgtttgaaaatgtgtttcctatcaacgaaagaaaggcttctgttcatgctttattgccaatgttgtgtatatgtgttttctagttccatattgtacttgctgagtatttttatactcactcttgtgtttcatttggttttaggtacatactgagaccgacatgcatggacgggaagtagcacccttatatacacatctacttgcacactattaaactatattgcttaggtccataatgacacttaaattatatcatggtttggtcttgtaataatcttttagatttctaatagtttcttccccatggattataaggatggatcgtattttgggaatgatattgttattagtttaacttacaattgcctatcgtggatctccgtattaacaggggagactgccgaaatttctaataattttggaagttagtggtttgagtgttttttttagtgtggcactccaagtacgtggctacctagggcattacatataccttgtcacaaaatccacagcgatgatgacttgacgaagcttgaggtgatgcggggcccaatccatcagataacgcacttcattcgggtcgtatccccctacagccgaagtcatcaagtagtgtgttgtcggagaatccatttcttgaacccatctcgtcgaaaccttgaagaaccaaaacccctatctggcatgccactgtcgatgttttagatcacgactacggtatttgcatggtatggggattgttggtatcaggatatatgcgagattgaggtagaagagacagagacaaggattttatttacaggtttgggccccttcaccggaaggtaataaccctactcttgttggccgaagccggtgttgctcttattcatttgaattccacaagtataatatttgggataacctatctagtcatcgtcgacttggtggcatggaacaccaacaagtagtcgacgacggggtagtcttcctccttgaatacatactcggcaagatcagggatagtgctagatccctcttgtcgtcctctgatgctagatccctcttgtcgtcctctgatggcaccagattgggtctgtctaggctgatctttgatgttgatgtctggtggcctgtattggtatctattctgactgagcttgttgatttgtttgggcttgtcttcccctccctaaggggtcttatattgataaccatagatgtctccttgtctaagtagaactagggagataagtatggatacaatccaagtagtgcttatagtttccatgtagaactatgcttgttcttccttatccagaactccttctatataagaggtatgattccgtataagacttggtatatggtgggctccaccgagcttaatcgactactattgggtatgtattatccctaaccctgacaataccatctacgttgagtgcaaaccttacatcatatgaaaaatactttatgtacttgtcgtctacctttctccattgagatccatcatatgagtgctattccatctctcttacgctcatcgtggtgctaatgcatcaactgagcatggttcttgtttgcgcacatatgtttcaaacgagggaagataggaaaataccacaacaacttctaaggtactcttttcttcttcattgtaccattatttccaccatcaccatctccacaattatattgagattccttgcacacgggacaatcatccaaatcagcatactcaccctggtacaatatgcaatgatttcaacaagcgtgaatttttcgtgtttcaaagccaaggggacagataatcttcttcgcttggtacgctgttttcagcattacattacccgctgaaagaatgtctgccaagagctgtaacaactcactgaagctcttatccgaccatccattggttgccttcaattgaattagagataggaccacaggcaacttgttgtgctccaccttagaaccattgtaaactatagttttgagttcaccatggtattgaacttggaatagtccctattatcagtgtaagccctctccccgtcgtgcaatatctggtttagatcagcttcaccgtgatcaattcatgtttggtcatcatgctcatagcccacatcctcattcggaacgtcggtcttgcctgcacttccctcgttcatcatgattgtaaggacatctgaagtttgtcataagagcccttgtaagtagatgtgcatggactagttgtgctagaaattgtcagtctttcttgcaattaatgcatagacactacaggcaataatccggaccattcacttattttgtgctcgtcacctcggcaacaagagatgttactccccttatatactccatagagtagtgcgtcgcatcaaacacccatcgttgatccattaaaaccgatgagtacctatggaatgatttaatttacgtacgtgtcataatctgaataatatggcaagaagagttcaacaataatatatttttaacctagttcatgaatcatttatcgtttattaaaagcagtgtagaataaatacaataaggattttataggcaaattggaataacaagatcttcagtaatgtattataacattgtgatttactgaaacaagggtacgattgtcattcacaaattacaatatcattttcttcaattccttcgtttaattcgaaatttccgggcccacctaactaccgtcaaaaccaaggacagacggttgcttcatttcaaaaaagtaggggcaaaatcacaaaacctaaaaaacaaacaggggtaaaatcataattaaactggaaagcaaggaaaataacacaatttccccatgaaaaacatacataaaagaaacgacacaatatagcaaacaattgatttccataaacaagagagaaatgaagtgagaaattatataaactaaccttctagaaatcaaaattaaatatctccaagaaaaccaaaagaaaattaagcaaaaccatttccctctaaagcaactggttgaggaagaacaaaaggcaccgatgtattctatacccgatcagctcaagaaggatggaaagagcttatatatatatggtggatcaaaggtgccagttctgaaccctaaccgacatctttatgtgggccccaccatcggtcacgactaagtaactattggcgaggctcacataatgatgccggttgtctccttcggcgccccgcaggcacgcacttgagtgggaaaatcactatactgtcagttctaatatttttggcatctatagagccatcccctatttactgttctgtattagtgattgctggtaaataagtggcatcagtgatggctttgaataggcaatgacaaagtggaagcaataatcagttaaccagcagaaacaatagcgtcactgtcggtttgtttgtagtggggttcttgattcaaattttgtggcgcagataaccgagaagcgaagctagaaattaaaccccacaaaattatttttttatatcaatggacatgctactagaatcgatgtatcacaagtcatgcaatatgctggatttgagctcagcagaaccgtaattaccattcatgtgaaacctccttaattaccgtctccttatgatgtcatgttaggaagtagctatacgacattgatagttttttagtaggaaatgtagagtctcatcggtggcacatatgcatcgataaaattaatttaaagacccgaaacgtcttattagaaaataaaaataatttatagataaaacttttatgtatctgttcatagcgacttaaaatctagcgttaaaaaaattacgttgaaaatatcataaaatcaacatcaaaatcaagtttgaaaaattatatttggcttttgctttggcttattaggccaaccgataaggctcttaaactaccaataagttgggtactactttttcagatgttcttagtttagtgtagctttatggtatggttttttctgtgtattgtttaacctattttttctcgggtgttcctttttgtcctagaattactatacaattgtcaacaatttttctccaaaaagccttcactttttggacccttagatcatccttgagattcatgtaaaacctaggatgaaagtttcgacaccacacgcttgaggcagggatcgaccccctgtcacctcacaacgcacataaatatgcacagctaaccaactggcccttcagggtagttattatacaacagttacacataagttacaatacaattgtacagttataagttataatacagttacaatgtaactataccacaattatagtacagttatattgtatttgaaagttttccatcaaacacggtcaaaattcagaggcggagccagggcccggcaaccctggcagctgcccaggctccgccggcttcatgcaatcatgccccattgtattaaacctaattaccttgctaatcatctttcttaatcaccgtatgaattgaagcagcagtagtatacatgtatatatacttaagtaacggcttaacgtagaatagcaaagcaaatgctcactctaaaatgatactccctccttccctaaatgtttgacgccgttaacttttttaaatatgtttgaccgttcgtcttatttaaaaacttttgtaaaatgtgtaaaactatatgtatacataaaagtatatttaacaataaatcaaatgataggaaaagaattaataattacttaattttttttaaataagacgtacggtcaaacatgtttaaaaaagtcaacgacgtcaaatattttaggatggagggagtatatggatttgtctactatgtatttgttgttaaaacttgtccagactcacaaaaatttctggatccgcgtcactgtgtcaaatgttatatagccactgttccccttttgtttgtatgccacgttgcgttacgtgagctagccaagctagctcttgctcttccctataaattaagccatgcaaacccccatgaccacatcagccaacgcaaggtggtagcgcgcacacactatacaaaaacacatccaatatattgtcattagaagtgaccttaatttcatggcagaactactgatcatctcctcgctgatgatgctgcttgctcttgtcttgtacttgtgcataggctggccaattctcagcaccctcgagctcccgtccatcgccgccaacctacacaacctccacgaccacctcgccggcgtcctcgccgcgtcgggacacaccgtcatggcgcgcggcacggcggcgaccagcagcatccggttcttcatcacatgtgaccctgaaaatgtccggcacatcttcacctccaaccatggcaactaccccaagggccacgagttcgccgagatcttcgacatcatggccggcgtctccttcaccctcgacggcgagccctacctccggctgcgtgccaagatgctgagcatcctcggcgacccacggttggttgcctccatggccgcctcctgcctcgacaaggtgcgggatggtgttctccccttcttggcccgcgtggcgaccgccggggcgccgttcgatatgcaggatcttaccgggaggctcatgttcgacgtgacgtccatggcggtgttcggcgtccaccctggctacctgtcccctggccctgacatgccgcccgcgcacgccgccgccgccatggacaccgtcatggaggtgggcttgatccggcacgccgtgccggcgtcctggtggaagtcgatgagaaggctcaacatcggcccggagaggaggctcgccgcggcgcacagggtgctccatggcttcgtcggtgagatgatgggggcgaggacgaaggcaacgcagtcgccgcaccgcgacgccgacgccgacgcctgctgcaaacgacggccatcgcctacatggtcgccgggcgtgacaccatcggcacgaccttgccgtggttcttctacaacctcgccgtgaacccgcgcgtcgtgtccggcatccgcgaagagctgaagcccatcgccgcgtcgcgcagagctgcttctcccagtcccagtcccagcaatggcgatcgcacgacgacggtgatgttctcgccggaggacaccaagccgctcgtctacctgcaggccgcgctgttcgagaccctgaggctgtacccgccggggcatatggagcggaagacggcggtcgccgacgacgtgatgccgagcggccacgaggtgcgcgccggcgacgcggcgacgccgtgctcatctcgctctactccatgggcaggatggagagcctatgggggaaggattgccgggagtacaggccggagaggtggctcaccggtggcgacggcggcggcagcggtggcgcccagctgcggcacgtgccgtcgcacaagttcctggcgttcaactccggggcgaggatgtgccccggcaagagcatcgccgtgatgctgatgaagaccatcgccgccgcggtggtgtggaacttcgacgtggagatggtggaagggcaggccgtggagccgaagatgtcgtgtcttttccagatgaagaatgggctcatgctcaaggtgaagaagcggcaaatctgaagaaaagctcttgcatgcacgtatacgcatcttgtctcaatcgtcagatttgtgcaagtcatctacataacatacaaggaataataatatccttaaataataatatcccactagctacttgaataaagaataaagtgtgtttttaataatttgcaattcctgcaatcatctcacacccggaaataataacatctattgagataaatcttttaaaatgttaatttgttactgtagaatgcatgtaatgaaagtggtaatgtggtatagtacgtacttattatacaaaggcagtttaggtttcacaaacagaaaatgcagtacgtcgcgaagaacttgttcgatgtattagtttgctttatattaatgtattgctactagttttgttgtttgtacttactttacacgtacttagctaaacaaaatgaaatatatgacttttggagtaaactaggactgacaaagtcagctggccaagccaacacaaacggccagttgaccccatcttctaaagggataggcggcatggaggccaagccaggccattcgaccatttttgtcagggtagccagagtgccagacacgaagatatttggaaatatactttatatttaacgtttttgcaagggtgaatagctaaagtggtcctccaagtttcatgcaaggatcagtttagtccttagtccttaatgtttcaatgtgtccatattagtccttcaagtttttattttaattcaaacttatctttcaacccacataaccaacaactctcttgataaatgacacttataccccctcattcacatatataaaagaaaaaattgcatgcaatgaattctttttatagataaaacaaaaataaattatgtacttacaagtgtatacgatagccattaggctcaattttcatgtgcacatattaaaataatgagaagtacatatccaatgttgtttattcattttggttttcttttttctagtgtatagttatatacaaattaagggcaaaagggacattttctaacataattgtggactaaaaatagtcatatggcatattaagtaggtccaaggatgattttagaccaaaataaatacttaaaggacctatgtgaacaaaataaaacctgaaggaccaaattgagccttcggtaaaacttgaaagactaaattagctattcaccctttttgcaattacatacatatttttcaaaaaattataaaaatatatgtgtgccgcgggcaccgatagtatagtttagcgtggcacgaagatgcaggaccagacaatcccacaccgctaacacgtggtaccgcacgtccgctgcacaggattctccggcccgatagtctcgcatcttcacattgcactaaacaattggtcccgcgtttttatccgatggtacatgtatatttttattttatatttcaaaaatatgtatataacagcaaaacctctaaaaataaagtatattttcaaaaataaaaggctagacaactactcacctggccttctcctcctcactactacaaaaaccgtttttgcaaacgggcggtttacattttcgcatgtggttggctggaccgcatgagcgagaaggtctgcaaagatcatgatcttcgcatgcggccggcgcaaccgcatgtgaaaagccggccgcatgcgaaaatgaaaaatcgtgaaaaaaataaaaatccccaaaaaaaaccctagccccaggcgcccgagctcgctgccgccgctcacccccacgccggatctgccgcgcccgagctcaccgcccgccgccgtcgtcgtcaccgaggtcgtcgtcgccgcacccgagctcgccgccgccacccgtcgcctttgtcgttgccgaggtcgtcgtcgccgcggggaggtcatcgtcgctgcacccgagccggatccgccgcgcccgagctcgccgccgccacccgccgccatcgtcgtcgccgcggggaggtcatcgtcgccgcacccgagccggatccgccgcccccgagctcgtcgtcgccgcgggggagggcgccggcgccggatccgcgtgggaggagggcagccgaccccggatccgctcgggggagggccgccgtccccagatccgctttggccgccgccgccgccgccccccgtgtgccgcctctcgagctcaccaccgccgcctctcgagcccgccgtagctgcctctcgagccccgggccgccggcctccgtgcgtgtgagaagaggatttgagagagagagggctgagaggagaggatttgtgagagaggagatgaggagatgactgagagagagagaagaagaagaagtagataaggccgccggctagtgtgagttgaagaggaaaataggaggcccgcatgtaaaaatggagcacttatttttacatgcggaccacttaagcgtctgcattcaaaaatcgtgtgttttttcaacttcaaattgatttttatgacattaaattaactcatgtcaaaaggttgtaaaaaacaaacttgtagaattcattgagatctaccaattttattttggtcatttctccatccgagtttgattggactatacaaaatttgaattttaaaatataagaaattcaaataatttttcgggtagtaaatgatttcaaatggaaaagtcattaataacaaagttgtataactcatcaagatctacaacttttgtttttgttatttttatatttgactttgtttgaatagtttgaatttgaatttcaaaatatgacagcttcaaacaacattttcaaatactaaatgatttcaactgaaaaagtcatcaataacaaagttgtataaatcatcaagatctataacttttattttggtcatttcttcatccgataaagtgatttgtaaaattgttcagaaaatgtacatatctcttatatagtttataaaactataagagagatgtacattttgtaaacaatcttataaataacttcgtcggatgaagaaatgactaaaatagaagttatatatattgatgagttatacaactttgttgttgatgactttttcagctaaaatcaattactgcttcaaaatattatttgaagttttgaaattcaaaattttaattgataaaactaagtcacaagaaaaaaaatggccaaataataatagtaagaatacaataacatgatagagcatgattttagaaacatttagaaaaaagaatcatctaatttggagttcatatgagtgggatacactagtttcaaatttttcaaatttttcaaattttatttttacatacgcctccttaagtggtccgtatggaaaattcgatttttccatgcaggcgcttaagtgagccgcatgcaccctcttaagaggccggtatgggaaaatcgatttttccatatgggccacttaaggggccgcatgtaaaaatgaccctcgatttttgcagacaccactagttatggtccgtttgcaaaaatcaaggtgtctcgtacagtaaaatcgcttttgtagtagtgcctatttcggtccaagagcctaaaatgactttgtaagggggtcgaccgacctatgactaggctagccggcccaatccactccgctccaaccaacttcaaagctgcagcaaacttcaaagccgcaacatccaatgctcgcaaccgcaattagaaagtgataaggactaaactagaaaaagcattttctctgacgtgagggttttattttcgcaggcggacatgaccatcggagccaaatgaccgcctataaaaatataaactagggtgaagctcgctgtctgcctgcgaaaatttattttcgcaggcggaccacttaagcggttcgcctgcaaatatacctggtccgcctgtcaaaataggtgtgtaatataaatagacgtggcatctcttagattttttttctaggtcctcacctctcctctcctctccttctgccggccctcacctctcctctccctcagcaatgggtgttcggcagcgggggcggcaggaaccggcgacggtgacgcacgcgtgggcggcgggatctcgatggcgaggcgcggggtcggtggcggcaacggctaggcgaggcgcggggatgacgacactatggagcggcgcacccctagcgcggctcgcctcccctccctcccaggtccagacgaaggggggagggaggaggccggtagccggtggcgtgggacggacggcagcggggcgcagctgtgcggcagcaacggccgcatgcagcggcggaggagggaggtcagcggcagcgttcccacctcccagatccagctggcggcccacccatccaggatccggaagcgttgtgggggagggtggcgatagcggctgcatgcagcggcggaggccggaggtcgtcggcggcactcccctcccctcatggatctggctgcatcatggggagggcaacggctgaggtgacgcggaggcgcgaggtcatcggtggcggcggcggcactcccactcctagatccggacctcccctccc

SEQ ID NO: 7869 - DNA, 31170 bp, Oryza sativa
ccctcccctccccttccctcccctcccctcccctcggcggcagcggcgggctggcacggtgacctcgtggcttcgcagctcctcctcccctccctctgcctcccaaaaccctcgtggtggcacagctcgtggtagggcggcggtggccaaatttttttttacgctgaaaatattttcgcaggcgggtggatttggccgcctgcagcgttttgttgcagacgttatggacacctaaaaaataagttttggccgcctgtaaaaatgtttttttctagtgggtggaaatcaatcgacctaaaggaggctcgtccgaccactcacatggctggcttatcctgctggccatttgaagatgggagcacctcaagcttgttaatttaagtaaatattgctatcgttttagggttttattaatggttagccatttttgttaatttgtactacctcagtttcaggttataagactttctattattgcccacattcatatagatgttaatgaatatatatatatatatatatatatatatatatatatgtgtgtgtgtgtgtgtgtctatatccattaacatttatataaatgtgtgtggcaatgctagaaagtcttatattctgaaatggagaaagtccaagtttgtttattgatggttagcttaatagtaatgttaatttttgttttgttttttgttaatttgtaaactcacatgactttttctatcgttttagggttttattaatcccacacatattgctacgtttactgcgtttagccgaatgttgtccaaaataacaaacgatcgaaataatcgtaatatgcactgctaaaaaattattcttgctagctgctgaaatcgatcagtctttgcgcaaccaaaggtcagagatggcaatttccacaggtgtggcttctattcgcgtgcgaaaattgattttttttaagcgacatctgaatagcactaagtacgaaaatttatttttgcaggtgacacaagtcatctgcttgaaaaaggttttaacgaaaaaaaaaggaaaataaatccgattttcacagcaggttcagattcaaatgcacatcaaacccaagcctgttcagattcaaattggcatcaaatccaagcatgttcaaattcaaatccaccacagcgacccaaaatcaacagacaattcaatatcaacaaacaataacttcatctaatggttgttgtcgctatcgcagtcaccatctcatcgagttccatcggtggaggtgcggcgcagatccggccttcccactagcggatctaggccatgacgtcaagccgtagccctcctctttgccctctttgctgagtcatccaccgcggaggcctccggcgctagatcaagcggccccaaggtcagccgccgcccactctagcggtaccgtggccggcctcctgctgttgtcgccatcccgtggcccgcgtgcagctgccatctccaacccatagccagcttgtcactgatgttgtattcccgccgctgccgtcgctagcccaccgctgccatcgctgtctggtggcccacgtgccgctgccatagccgacctgtggccgagccaccactgccatcacattcccgcctctggtccatcactgctgtcacagtccagtcgctagcccaccctcgcagtctttgtcgtcggtcgcttccaccactttgggctcccccatcctctgtcgccaccgccgctgctaagaatgaaggggttggggatgagaacgagtgtgggggtggggtaggagatctcatggacaataacttgctgagaatgagtggagaagagagcttctcgaccagttccaccgatattttataaacctttcattttttttcgccggcggtgcaataagtgtcctacatgcaaaagtaaactttattttcacatgcagaccatttaaagtaacggtcagagagaattgatttttgctagcggtttttattggaatcacttatgtatatttctacaagcatgtgtttttaaatccgctaataaaaataaaaggatggtatcagcaaaaaaaaaaatattttcgtagtagtgatatgccttgtaaaaagataatagtaatctataaatcaattatataatttttaaaacgaaataagtatgtgtccaacttgacataagccacaatattagtgttctctataagctgcactaccaaaccaacaacagtcttctgaaattctgttttacaagctttacacggtacaagttcattttaaagaactatttagttgactagttgcaaattttaattattctaacaaaattgttgaaatgaaattaaaacaatcaatggataatgtggccttaaagcgacttcagtaacagtgccaaataaagcgatcgaccaattgccaataatattaagcaattcaatacagttagctgaaagtcgtacatccttgtgcatcatttcccatacttgctgtagagatgttagggtattcccaacccaatgactaaaatggtatccatagtattaaataagttgccacctaggatgaaaaatgatgtggcaagtgaataaatgaggaaagagaatgaaaccatgtcttgcatgagacatagtttctacacaacatccaagacatcatgtaacataagtagcattaaatttaagtatggaatagtagtgtttgcattgtaagagtagtgtctagtactagtttcttgatgatgtggagtttatggaaaccatatctagtgttttgggttggaaatagccttatggcccaattagtgaactgattttttttctaaaataatagaagtattatgtctatcgtctgcacgcatccttaattatatttattggcgtacacgaacaaaatggcaatcaacactatgcaggcaaaataaaaaaaaatggtgatagctacttaactagtcgccaaccagtacactgcatgatatcgttattgatatttaaaatattaaaagatatttttattcaataataattattaaaattcctaattagttgagatgtactcggttttaggtctttgcatgattgagttctaaacagccattcgaatcggctacttcctcatttcctgtgagcatgctcttcttcaacggctaaacactactggagaaaccatcttaatctacaatagtcctgattcaactaaaaactgggactaaaaaccattttagaactcccctgggccagggccgccgggctggggagacgatgggagaagcggtggcggcagcggcccccggcatgcggcggacggcggccggcgatgccctcccatctaccagaggtgaggtgggaggcggcagcggtggcaccggatttcttttttttttaagaatttgtaattcattggatctgtgtgatgtgatatgtgatatatatgtgatctgtgatataatttttttagaatttgtgatgtatttttttgacaatttgttatgtgaatcttatgatttgtgatgttgttactttgatttggggatgtacggagcaactcgatttggaatttgtgatgattttgtgattttggtgagtttggcgtgaaatcaatatgcaaagaagaatgaaaataaaagagaagaacaaagactagaccctctttaatccctgttggtaacaccagctgagaataaagatgaatctttagtcccggttattttaaccgggcatctttagttttggattcatagtcccgattgtataaccgagactaaagggggttacgaaccgtgggtaaaaaccctttctccagcagtgaaaatttggctaaaagttgaaaacaatggtatcatcccacaacatgcagaatatagatgtgctttaacttttaacatgacacacaatgttaaatgtagagctacggttatccatcaaatcgatggccagatattttttttagcgtgtgagcatctgcgaaatgatcattaattttatgttaacgtgtgagcttcttgaaaatgttcaattagtattactgtaggtgtagatagaaagatatatatcaaacattagtgcagataaaagtgtaacaaaatttgccatacaacactgaaacaacatggaatttgcaaatacaccgcaaaactgatactttgttcttggacactccaattttgtgtggatatttgctaatggctatagaggggataatataatggcaaattgctgtaggatattacaactctgtggttttagctcatgcagctaaagtcgatctttgagagaagacattctcaaatatggatatgtctattaaaaatattcatatttaaataggagagaaaaataatttgaaatgccagaaatgcctatagcccacttgtattcttcctccacctcccttctctcatgtaccctatagttaacaagttgtttcactcatcacttatcactcgttatttcattcatcactcaacgatccacagcgatccagattatctcaccgagttctaacgctcacacgatcatctccacctcccacatccgtataggccgcttttcctccctgcgcgttctccgttcccccgtcagcgccgccatcgctctccctcctgactcccacccgtcgcccttctttccccaacctcatcgccaaacctaacctcccctctctccccgccgcacgccgtcgacccccgctgcgcatatccccatcgcacagcgccgccgctcgggcgccgcactttctcaatcggaggacagcacgatgaggaaggttgcgggagaggcgccgtcaggcgccgctgatctggtccctcgcaaccagatcaccgtcgcataccctagagtcgacgtcgccggtgcatagccccgtcgatcccgctttcccagttcgctgtcatcgcctccgatcccgcgggttgcgcctctatcccctggtacagcagcgtcgccaccgccgacgggagcagcatgtcagtccgcaactctgcattatcagcgcacaaccagtttattggattggagatgttatttgctttgggtaatttgtttttttgcctagccacaagaaagaatgctcatgtgccatagaggaacagcaagctaacacaccttcttgagattctttaggcaatcaattatttacttgttggtaaattatgcatgtagggttagatttgtggttttcgtaattacattacatcacccgaattaatcaaaagatttgagcattttgtgcgtatgcaagtagttgaagaatttcaccaacgaagatcccgagccctttcagccagtacagcagcaccgccaccgccgacgagaacgggcgtcctgtctggatcgtcagaaggtggccaggtcattggattggttttcattttttctttttggattggattctgaaattggaacaaaagcagtagcattctccattctttgatttggttgttttcacaaatgagaaatgggcagtacatcataaatctgagtactttgatctatataagtcgatttttattgctccgtacacaacacagttcacctcctgagtcatgaaatgcaactatagaagaactgaacttggttcaaatttaggggatatatgctaataaaattacaagggaatggtgtgcattcagtttgatatagttcatatgaatgtcactttcttgaaaatattgacgtttggtattagttgtaaaaccttcatcaaaatgcagaaaacacgggatcaaactaatctaaattcaacatctctccttcaagttttctgaagtcaggtaatagctgacttgagttaatttattaattggtggattactcatgcaacacctgccagtttattgaaaaaaaaaaggaattttcttacttctgtcaataaatataatactatggacaagcacttttgtttgattgtattaaaagaaatactaaaaaatgttaatgagatataaacggaccgatgatgttaatgaaatacttttgtttggtgctatttgattgtgacttaaacggaccgatgatgtaaattcattttttatacacttactctactctgcacgataggtctctgtttaaatgccgctgagggagggtttgttctggttgatgaattttcaagcaaatctgttcatgatctttacaaggtttctatgtgttttctgtgagatctttacaaggttttggtttgggggtacaaattcacattcaatctgaatttcgttttggttttcaagtgaagcaaacaagccaacatagggccctgccaggtatgagtttgctgctccgactgtatgtgcatgtagcagagggcaataatgaagacagaaaaaagtagagcaagaaaatatttaacattgaaattgggaggtgttagtatggaattgtgatcaaccttaatgttgtgcactgctttagctgaaaccatctgagtgacaggagaggaactggaagtcgtgcattgatacaaacgatatttttgtgatttgtagcctgagatcaaataaatttagcaactcagccatatttcagagcctgcttcacttaggcaatgtaaaattataaaggccttcacctagccaatactatttattttttttattctcacaatagaaatgatattgttttcatgctcctaggcggctcacaccagtctctgccattgccagttcgggtgcctaatgaggccggtgcccttgaatgacagccatatttccaaggtgagtattggaaaccttctctcagaaattaattgtctgagtttcctaccaacaaattgatttgttcacagatttaggtggtcacgggccataataaatcattgagaataggtcatataacattcagttatgtcatcacaaacaatctgattttgacaaaattaggcaacacagaatttaatgtatgcaagcatccagatacctaacacggctaacactattgactgctttttgtttcgagggggctcactgcttatattttattgagcttagctatattgtatttctctaaactgcataaccatctcactgcatagcccatatctttatagcattgtgacaataacagctacatctctacaatattactaccggtaagaaatgaaggattagcggtacataaagtgcctcaagttgattggaacaagcaaccatttgtataacatatatatctttcagactcaaggtggagtttgatctctacgtaaaaaaaaagcaatcggtgttttctgtactcgaatatgtaaataagctgtagtgtgtcagatattataatggtgttctttatagagcacacgtgccgacaacattttgcagtgggcttatctatgaatatttttttttattcatctgttgcatggttgccagtgtgctgtatgtttcattcaatttgatttagatttgtaggcacgtctaaatggtgcatgtgcacgtattgtaaatataagttcgattactaatcctaaatcttgtcgatcaggtatgtattgatcgagaattgcatttggagatataatcgataaccaaacaagtgtagtgaaatgggaagttcattatatatatacacacacacactattgattccttagaaaaataagatcatataaaaaaacatgaaacattaaatactccatccgttttataatgtaagactttctagcattgtccacatacatataaatgctaatgaatctaaatacatatatctagattcattagcaactaaataaatgtgaataatgctagaaagtcttacattgtaaaacagaggaagtattaaaagttattaaacacaaatagaattgcaccgtagcgtttagcacgggtatattactagttatctttaaaaaaaaaacttccttctcacatcccctttataatcccttgcatggtacgttcctggcgccgtggcgaggatgatgagaagcaatgcagcgaggctagcagtcacgtgcccctcaatatcgtctttgacatgtttggagtagcgtttttccacagtagtttttgctttcccttttaattgtagcttttgtttgtttctttctcccttcccccagcataggtctgtctggctaattgcgttgtgtaaaaagaaaaattatctttccttctaatatattatattgatgtacaatctttttacgtgttttcgaaaaaaaaatatcattgatgtgtgcaccctaggactccaccatgtccagggacaactatagtagttcgagcagcccgacctccaccttctctgcctcatgaagaatacatcatggccgcccacaccataacctcatcaccggccaacccactgttgcagtccctccaacatgatgcccttccctgggcgatggagcagatcagcaactacctcaccgggaggccccttgctggcgcatggatctggcaaccagagagagagagggggtggtattaggaagcaatggtacgtcgggcttgtttggtttgaatctaatttttgccctaccaaaatcttggtagtgtcaaaatcttgacaaattttggcactaccaaattggacagtattgaatttgaactattgtgacaaaaaattggtagcaaaccaaacatgtatttgcttctattgaaatactccctccgttttgaaatgtttgatgccgttgactttttagcacatgtttgaccgttcgtcttattcaaaaaatttaagtaattattaattctttttctatcatttgatttattgttaaatatatttttatgtaggcatataattttacatatttcacaaaagtttttgaataagacgaacggtcaaatatgtgctaaaaagtcaacggtgtcaaatatttcgaaacggagggagtacccaagaaattagtagggcaagttgatagcaacccaaacatgcccgtcatcttcccaccaaccgagatttggaggtcaccagccccgtgcctctgtgctatcggcctagtagcctcaagcctctctgcacggtgccatttctccgccaaccgaccacatcaatggctgcttcttgcttcttgtagtcctagccatggcgggctagaagtcatctcgctcgaccacgtgtgtaagtcagaaacctgaaatgaaatcctaaaacaaaaggttaattatagtgtgatccaccttctattaccaaagttttactttaagtcatcatttaactaatatttttactttaaactaggtgagattattttttgttacactttagaccattccaagtcacttttgtagtacctcccataccagacataatattttataggtgttagatttgatatttatgtaccatactaaaattatcctggcgctagaaatttccatagaacgatatatcattgtgtagtacttcttctgtttcataatataagtcattctaatattttttatatttatattgatattaatgaatctattaataaaaatataggaaatgctagactgacttatattgtgaaacggagggagtagtatagtatttctagacgtaagagatttcgttgcatcgatattactgttccgtagtatttctaaaaaagaagaggatgagttttgaaacgaaatcccagtggatctcggcccagccaaacgcggcccaaggtagtcagcccagatggcccggcccatctggcaacttgatctaagtaacccccaagcaggaatttttttcgtttttacatttttttttaatatttacagaaataatctatcgaccaaaaaaattgcaaaaatagggggggcggcaagctgacgtggcagacggtgggtcgaccgcgccgtctgccgccgtcggccaaaattgcgattaggcccttgccgcccatacagagggcggcaaggggctaattgcaattttggccgcccataaagagcttgcggccgtactttttgcatctgggtcccttgccgccctaatatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaatcaaggagaattatgtaacatgaagaaatagtagtacaatttgaacatgatacaactatttgcattgcggttacatagatgatattagattcgaactaggagggaggtagtgcaatagttgaacacaacgacgatgttggcatagtatctcaaacctgtgctgttgggtaccttgcactagagctcgatgtttcatggcctttttacgcaactcctctagctttttctgcatgaaagttccaaacaaaatgctattgttcggcatagaggtaagaactgcctggaaccgatccctaaaatacatgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaatttttttctcctggttctgattgcacagcctcttgaacatgttcatgagctccttgttcttgaattgcttgaagaaattagctcccatatgacgcatgcaccacctactctgtacatcttcccaaacaccagggtatcctcgttccatactcccaaactgcaactcttctatcgctcgtagaatgccaacgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttccttgataacaccaagcaggcgtggcaaattgtcatacgaggcttcgtaagttccaaatctcatctctattattttctgtttggccctccaggccttggcatagctaatagtatacttgtatgtctctttgatgtgtcggattattgaccttggttcatatgtgagattatcgatgacatgtgcatacatctcagatgcaacaaatgcacatgtaatattcctgtggtatttctgaacaccaggtagaaaacatgtatgcttggtaacgactgacactgtccaataatccttctatttccccttatacgcgtgcactctccagggacaaccatctttttccttaacacaccgaacttcatattgcgaccggttcgacttggcaacccaaaactctctataaagtgacattgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatttgacgaatcaccttcctctacacgctcgttgtcagaatcctccctctccatttcatccacaatggcaccgacagtctccccctcatcggccactccacttggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccacgttgcaatgtattttccaaataccatctcacacactcgagagttttgaactggcattagttcccaataaaaaccctcagttgtccgacttactataacattgattgttatgtcacttgtctgtggatcaactctcaagcccctcattaaccatccttttataaaaggtatactcctctcagccggtctatcaattcccctttctgatacaataaaatctgacagatctaccccagttggcccgtaacggacgtttcctggtccatggtaaacttggaatatttgtttgttcgacatatttgtcaacgaaataactagatcatattactctttcatgcaataaacatctacaacttaatatcttcttgtgtaagccaatgcaatggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacctgaaatcggtgtctgaatccggcagggcttcgccccttcttctcttctcctcccctctcttctttttttttcactggatttgaggggggaggaatgagggctgggggctgggcagcacgccttttataggcagcgaggcctgccgcccggccagagggcggcaaggggccgcctgcaaaatggccggccccgactggcttttttgcattcgggccccttgccgccccaccagagggcggcaagggttttcctgcaaaaaaccctccctccgtcaccgcccgttcctcccccgtttgccacgtcagcttgccgccctagaggtgggtgacagggtctatttttgtaatttttttggccgatagattatttctgtaaatattttaaaaaaaatctaaaaccgaaaaaaattcccccaagcagagagggtccgccggtgccgccaccgccgccacagatgcccggtgtcgccggcgcccgcccccgatggcgtccctactacttccgccgcggccggccactcccctcctcgcttccacgctcgccggtagctccccttcaggcttcagcgagccgggacggcaggtccagccgtccaggatggcggccatcttgtcggcgtctctgcgcactggtatcctgctccccctgttcgacttgatttgttttttccaattttacgtaaaatgtaagcttagattatgtttactgaaattttataaatgctgtcctttatttttatcaaggtcttaatattttacatttaaattatttaagtctccatcaattgtaaatttattgtatgtcttgtgtaactaagtctttatcagttctaaattagaagttagagcaattcattgttcaatcttttatccaagtaagggataatgcttaaagttaaacagggaatcagaggagtgatgactgatgagagtggttagatttccatcaaatggatgaaaagaagtaactgaaccgaaaactaggcaatgaaattatatatcttgggattgtgatagctttgctcctccacagtatatatggtcctcaaacagaagataactctttggataaatccattggcatgtaaccttagagtcaatacaaaaaggagatagaaattgagaatataatcttatgctttctcagtatttggattgaatgactacagagcgtattttctataacctctgcagtgatccattattgccgaatgcatggcgccatggtggtatggatggcaagatacgtctagagcagtactgagtactgataaaatagaataaacagaaatgccctgtacgcatggaatcagtggatcacactccagtctttagcatcattagcctttaattataaactaataccaaagattaaaaggcagagacttcagatccgtttccttgtgagagagacacagttgttcagattcttttcttcactgttatcacacaagcatgcacgtcccccaatacccatctttcttcctgttggtgctcaaggttcccaccattaaaagcaaaagtgatcagtccataactaaacatcattagtacaagcaagtaatcacctcatcctcctccgatcctccaggctatcacaccattctgcacagaggtggggactagtggtgctgctagctgcattcactagcggcagccatggccggagttgtggggttgttggccatggccgtggtgagggaagcgggcgctaagctaggcactgccattggagagcaagtgatgatgatgtgtggcttcaaggaagacctggaggacatgaaggacatgctggaatccatggcggcggtgctcaaggatgcagagaggcggtcggttacggaggagtcggtgctgctgtggctgaagcggctcaagaatgcggcctacgacatctctgacatgctcgacgggttccaggacaaatcgaagtctgcaactttgctagctttagttgtatcaacttataaaggcacatatacatcttaattcattgcaacacaagcatcaagtttcctaaaggcacaaatacatcttaattcattgcaacacattacttccgttttaagtcagcccaaactttccgcatgtcaaatatgtgttgtgatgagctgttattagtttgcaaaaccgatcatgattcttgtttgagtaagccctgctggtaaccttcgtgtttgaactggtaaccttctcgttgagtgagccctgctgctgctttctcacttcccaagcaggcaaagtcagactcaggagggagggggcattaagtcacatccatcctattttgttttctcaacggttaagagatgatgatgccgtagagaacccgtaggcactattgaaagggattgtcgggttcggcatgtttatgggccgttgctgggtgtgctgaccattcttgttagatcaaaacacaacaaccaagccttttcaaagtggggtgaagtgtaacagaaggaacaaacaaacatgtagaatgaaattttacccaaattagaagacaaaaagataactattttctattgttctatatggttttcaaaaaatcaaataaaatcgagtgaaagcataaaaccaaatggcactaaaataatataaaaaaaagagcaaggttaccacactttcctttgcatgaatatgatcattatcgcatcaaagtgtttacaaagtgcatataaaacactcatctctaatatgaactgcagtctatatgaaagagtaaagagtataaaacctaggttttctctctatataagtgtcttgccgaattactccccctctagtgtttgtttatttacccacaacctctgtcaccccaaaaatgatactaaattttcagatgcattgcgtattattcactgtcatcatgggacgcaatgtacaagtttgataatttagaacaaacgaaataaaccattaaatattaccttagtataaagatgttttaggcctgcgcccagagaaaaacaatagccgcgagaaacgggccaatgactccactttataggcgctaattaggatataagccacgactcctcgtaggacttacttagctctattatgaagatgggacttgcaaaatgttgagtacaaatgtacccaacaaggtataagcaaaaatgtacataatgcaagggatagaaggaatggcataatagggtttattttcacgtaaatccatagttcaaacaattcactggtttaaagcatatgtttaaacacgaccatgttctaagtcataattatgatatcaaccatgttgcgaacccacccaaacctgcctaggctaaaccacttgaatatccatcatgatttcatcctctaggctcttagcctgggagtaacattgctcggccttaaccgtgtaaggccggtgtgtaagttggatacaactttatattgtccaatggatggtatgatgtggtctagcatcccagtactccactttataggaacactagaattggtttggttgagtaaaattaccttgccatgaaaatgcaagtaaaaattggttaagcattttaaaagtatggtgaatttataaaaaaaatactctaggtcacatttgaatttttctttgatggcttttattgtttgagattttctttttggtttttaattatttctaaaattatatttaaaagatggtttttaatttgagggtaaactttttaggcgctacaacctccaacaccaaggacttctacttactaggatatgattccatcacattccaattcttctgcgatatttctaaatttagaacccctctaaactttttaaatttgactctttttccataaacgcacacctcctatgtacaccatatggaaaccttgacttcacatgcactgttccctagcccgaacgtcccgtatgatatccttaacagtttggacctcaactccccttgagtttagtccttgatcttttcactaaccgctcttctctggcctcaagcaacttgaaacatcaacgaaagcatattcagagcacaagttaatcccaacttgactcaaatttgtgcgacaatgattcctttgccccaaaatgtaagcatttctagaggttttcacaaaacttaaggaagtgggtagaattgaatgttggaatattgtgattggttgataagagattctagatagagatatttaataggagatagttgtgattgattgagatgaagggatagctggagaaatagctatatttttggacaaatttaaactctatgaatagctacattttaggactgagggaatacgtaacatacataatcattataaaaacataaatactaaaatcaccttagatcaaaatcttcacaacttaaactcatcaatgaaattctttgctacatctacatgtgatccaccaatgatggtgcaagatgacacggtttggccgagcattcttttcagatgagcattcttcccactaacagtgtagtcaggctgagcattattttcggtccttccatactaaaggcgcatttgggccgatccactgatctcaccagctaagatgagttgtatattgctttaagtctaggtccatcaatgactagttgtccaccctccttggattcaagccaacgacagatatagcttgattgattggtggcagtgtcctacttggaagcgtctcttctagtggtggagattgaggcagatcagctactgtggacctatgatatgatgtcaatcaagccttaatatatactggttggatctgccactaagatatggcctatactggttggatctagtggtgtgatctagtttttattggttagattcaatgtaagaagtttgtcttgaggtgtggccgggcatcggtacctcctctaaagtgaaaatcctaggtgtggccttcattgtttgaatttggcgacggtttcaacctaagcggcttgtccttcttgaagacgtttcatggacaatttggtactggtggctctgtttgagaactcttttgacttgtccttcactactttggatcttgtgaatgatataagtcttatctttctttatgttgttgctacgaaggtatagacttcaaaacctcattgcttcatagccatcgtgattgttaggatctcttgattggtcctaaggatagggcaaagtggttatttttaggtagcctctatgacaatttgtttgccatgttgatggtattgtttactgctcttgaaataagctttatgcttcgtggtgtaatggttgtgtgtatcccttgttcgtgtagaagccagaagtgcctccattataagaaagagagacgctccggtgccctctacttgcagtattctactctaagtagaattaatctcgaccgtttattttaaagggtaaattagtaaagtgctaaaaccgaataggggtaaatctggcacttaatttttttctcatttgtgcgtcctatggtcaagcgtcgctcgatccctctccatcgaacagcagagtcgctctccatcaaaaaggagagcgcagggaaagaaaaagaaaagcagatcgcgaggtccggccaccgccggcgcttgtgcatcgcgttccatagatgtttcttgctgtaggtatttggtttccattcagcttgattgtttcatgtaaaatttaaatatattagttatatatctgaatattacacacgatggacaaatcgaaacactccaatccagcaatgacagatacaaggcaacggaagaataatccggtatgtttttttacgtagactttacaattgcaattacaacaagtaatatacattgaaccacgtacaaaaacgatgatatacacagataggcactttcaaaaccacaagctgttaataagctatagttttgaaaaaaaaaacatggccatcagtaacaagccaaagccacccaaagccatcttgagataatgaattcacaggaattacaggacatagcacaccaggaatctctcaagcgttgattgacgtagtgatcattagcttgtccaccttgtcatgctcagccattctgaacaagctcacttgctccggattcagtttactggcattcaacttgaatcccttcttctaggagaaaaaattatgaccaagaactgcagaacttgagtagacaagcagaaaaactattcgagaactagaggccaacgaaaaagaagattcagtgcagatgttcgagctgcaaacctacaagcagcaagaaaaacaaatcaaatctgacctgcaaagcagaaaaagagtcttctcatgtcagctaatccgttggagagcagcgctatagccagcgagaggagtcttggatgatgattcggaggtcgagagattggtggtcattggctccggaggttgcgggttccgcttgggaggcgatggattgggggctcgccctcgcggctgtgggatcaacggcgggtggagatggatagggctggagccgagcgtgggggaggaggccgacgacgaggaaggggatagcgaggtggacgaggtctcggcggcggccagtggcacggtgctgggtcggaggcggagatccgggaggcgaactcgtcggaaggtgggccgacgcgggggagcggcagagagggcgcagctctggcgatcccagacggagatgcgagctcgtcgagggcggctgaggcagccagtgcgacggaggcgagggagtaggaggcgtcgagggcggtggagtaggcgaggtcgtcaaggtggtgatgggagccgcggggttctctccgcatcggctccagatgcgcgattccggaaggacgaaaatatccctccacagataatttttcctggataaaagtacccctccacgattctactaccactaagtgtggtggtagtagaaatagatctgaaccattggatcaaataagatcaatggttcagatttttttctactctaggtagaaggcaccggagtgagactctataagaaaaccaagaatacttatgaaagtcaatacgattagttgagagtgtaatcataactagtgtcattttgctatcagtacctcactcaaagctttaagaaattgtcgatcctttccaaatttaatatggactagttgttatatataattcaacaagaggttacaaagctagatatgttcttccatgattttctatttcacctgaacatacagataatatcatttttttcctagatgaagacgatgctctcttgttttgcaattgcacccaagatttccatggctaataagatgaaaaagatgagagatcaactgagaaagatcaaagagggtcatgaggcttttagactcacacctgactccacaccatataatgagcatcaccgtcctgatccacgagaaacaacatcgaaggtgattcaatcgtccatcattgggagagacaaagaaagaaaacaagttgtgtctttgctatcagcaagtgacgaggaagacacagtaattttgccaatctatgggtttggaggcattgggaaaacagctttagcccaactggttttcaatgatacccagttcagaggttatgaccacagggtatgggtctatgtgtcccaggtatttgacttgaaaaaaatagggaacaccattatttctcaagtgtcaaatgaaggaaataagaatgaatataccagggagaatataaacggacgcctttgtgatctattagaggataagaatactctgattgttttggatgatctatgggaaacaaatgattttcatttaaatgagttgaatcttatgctaaatacaaaaggcaaaataaaagtcttggtgacaacacgcaatgaagacgttgcaaagaaaatttgcacacataaaccatataggctaaatcccctggactctaccatgtgttggaatataattaagcaacgcagtaatttagaagctagaggtgataaagaccaaatcgagcaagtcggatgggtcattgccaagaaatgtggaggcatagcattagcagcccatgcacttggtttcttgctatctggaatggaccttgtggaatggagagcactgagcaatagtgatatttggactgaagctttttctgataattcagtgttgccatccttgaaactaacttacaagaatatgccaccatatttgagattatgctttgcctactgcgccatcttccctaaaggtcacaatatagctaaagcaagtctggttcaccaatggattgctcttggttttattgagccatctaaaacattttcatccgtacgacttggcgagaagtatatcagacaacttgttgggatgtctttccttcagcgttccatattgcacactgtgagttatcatatacctcaatagggaagcaatgttttgcctgtcttaagtcaattataaagtaccatgcatttgtaaataactaataattataaaaaatgagtccgagcatactcagctgcaaggctaacacattacatgtacgcatgtttaccccaaataatatgttaattgtattagaagtagggcttgtataatttatcttgtcaagtatgtttatatcttttgggatattaagagctttgcctttctaaaataagaaatggaaatgtgaagaagttgttacaagtaccgaataatgcccattaacataacgagaaaggtcatatttgccacatacttattatttactctacagttcactgaattattactaaaactgaaactaacaaaaaaatgatagtactttacattgccaaaaaaaatatatttaaatttataatatttaagagatcaaacacaattcgtattgatgattttgttaggtgtgtgtttataatgaacctgatggtactttacatttttctttgttcatgtaaggaacaagaagttttcaccatgcacgatatggttcatgatgttgcgagatcggtcatggatgaagagttggttttctttaatgacacaaaaattagcagtaccacagaacaaaaattttgccactatgctttgcttgaaaattatagcaagtcatcaaatctatcaactatattgcctgccacgttaagggcagtacatacttcgaattgcagcaaattggtgctccaaggtgatgaattttcattcacaaagttcttgcgtgttctagatttaactgactgctccataaggatcctcccaagctctattggcaaattgaagcagctgaggtttcttatcgctccaaacataggagataatgtgttcccaaagagtattactctgctcccaaaactaaaataccttgacctccatggatcttttcgaatttcagcattgcaaggatcaattagcaaacatgcttgtctgatacatcttgacctatctggttgctctaatatcagagttatacagccagaagctctatgtggcctcaccaaactgcagtttttgaacttatcgtggtgctccattcttcaaatactgccagaaaatattgcaagtcttactgaactgcaatatttaaacttatcaaactgcttccttctcagccaattaccatctcatattgggagcctcactgaactacaatatttgaacttatcaggttgtcagggccttgtaaaattgccaatgtcgtttcggaatctgaagaatttggtacatcttgacctgtcaggctgctccagggtacaagatttcaaacaagtctttggtgggctcaccaaactgcagtacttaaacttatcaaagatatttggtagaaccagagtgggtgataattgggatggttatcctgaaactatcagtactcttaatgatcttgagtatctaaacctttctcggaatagcaggattgattatctaccaagaagccttggaaacctcaaaaagcttcaaacattggacctttcatactgtcggtctctgagatccctcccacacagcatagaattaattgacagtctggagtttctaatagttgtggggtgctcagatcaacttaaggagtatttgagaaaatctcaattcaagaatattccaatatcattaccacacttcattgttcactctatttctggtgattcccgcagcaaccttcatatgcttgaagatataaatcctgtcagacttgaaataagctgtcttgaaaatgtgaagtccatagaagaagcacgaggaattgagttgtcagagaaacaaaatctttcaacattgacatttcattggacttcaagggctgaccgacttttggaggacaaggatgttttgggagaactaatgccaccaagaggtctgtggaatttaagcatacaagggtatgatagcacaaccttcccaacttggtttgtaggcatctcacatcatcttccaagtcttgttaagattgagttgaaggatttgcacagatgcagacacctgccaccactgggacagttgccaaacctgaatgaagtgcatctccaacagatggacagtctcacaaaaattgatggcggtttctgcggtggcgacaaaggcgcattccgcaaactgaaagtcttcaccttgagggatatgaaacagttggaagagtggagcaccacaacacacagtaaaggtggtgaggatagcatagagttcatgttccctatgctagttacactgtcaatagagctttgtccaatgcttagactgaaactatgcccaccgatgtttcacagctggctcatatcagagagcgacaaggttatatcttcatggggtgagatcagacaccaacctgcagccagtgtcagccattccttctcttcttcttccgacaccaacttggagatcaaaggagtaggggttgcagcggacgagtggaggctgcttcaccaccaccccaccctccaacagctggagatctcctggtgtaaaaatcttttgcatcttccagacgccatccgacatcttccatcactatcttatccaaattcctaatccgtattttcactacatatatatactcgtatactccctccgtcccaaaaaaaatttaaatcctagggatgaatctagatatacatgtgtctaggttcattcctaggatcgatttcttttttgggcagagggagtactgcttaattatttcacatcacatcaaacaaaattgaaaatgtctttgctaagcagtgttgtcttatgtttaggctgtcgacacgggtttaacggaggctctgatgaagattttcgctgaagatttcatgcctaccgactcttcagagtaattgttccttttggtcgaaagtatgcaacaggcaagtctacagtaacctggtgttgttccattgatgtacactccatttcataatttcaacatgattcactattatcaactgatgccactctgtataagattatgcgtgttttcctatagtccttaaaaaccaactagaaggcatgaactatcatgataactgtatgtctctttcttccaagacctgttgtgtttgtgtcgtggttggcattacctaccaggggcacgccaaacgcatgatgtggcaccacagtagccagaggccagtagggctagttatcaattcaatttgttgcattagtttggatcctttgaatgttttattacattctattgttaggcgctagtaatttgaaaatcacatgagtaataaatagataaacaagtgttataaatctatctctctttttgtggattctcttcttccttgtgcaaccttcccccctgcacatgttcctgctatcctcactacagggtatgcaattttcaccaacaatgaccaagtaataataacccaaggattcagaattgccatccgtgattaccaagtcacaaaccatgcaaaaaaaaacctggttgttttatagtccccaattgtacaagttgttttgttactttcatctaagggcttgttcggttaatccctaaccgttgccgggcttgttgggaagggatttaccaaacaagcctaaacaggaataggtaagtatacagaaaatttgatttgctttaacttgcactgttggaaatttaagtgtataacacccaactggacagctggaaatttaagtcctcaatatttttccagttatatcccctcagtttcgtgatttgaattctttcctctttgactgctcatgtatctaccgtatgttctatacgtccatggctcctacattgttttcttggcaatactgtgttgctccttacataatataggccatttctgccataaaatagttgttgggcatgcttgtcaataagcaataatttctattacataacagtgtaaattaatcttgccatctcatgccaatgtttattttttgtttgtgaatgaacagtcatctcaagctcagagtttggtatatgacatatcccaaaaagaacagcctgtgaatcaaatgatcatgtagattgtggttttgatcatgattatcttggagactggttgtgatattgatgatgctatgcttcgttgaaattacactattgacatgcattcaactatgttgaaactttagagccaattatcaagacaatttcattttatactgatagtttagagttccataagttaggaatttatgctgtattaagtcaatgtttggtcatttttgtgaaaaaaatgggcactaggaagtgtacagtaagtagtgcgaaattcttgtacctaatgcaatattaattgatttattgctcaaaccttgagccaatgaatcttgttggtggtgtcaagcacaactacgataaatgtcaactgcattactcaaaattgcgtaaagaaaacgaagaaaatcttttttacttacatcaagaaagtgtgatggttataaccactctcacatattactgtggttgatgtaagacaaaaaagaaatcgttagaataggtgtccgaatatatgagtcatgtttggttacacttaggctcaaagttataattgtgatataggatacatatttcatcaatatcgcaaccatgactcataccctatggtgcagggtagagaggttggcggcaacaggtcaatcatacttgcggtggtagagtagagtaacaagatcagcagaacaaaatttgggtaaggccgatggggttcgtcaagctttgtggtgtgtcaacacgtcgtgcaagtgctggatgagggtgtgcgtttacagatggctcacggcttccaaatcggcaaggacgtggatcgattcggagtaggtgtgtgtgcacacaaggttctgaagcagtgcatcgaagggcgtaatggtactaaattggaaggatgcgaggtgatctagttggtttggctagggtagatacgagtacgtgtgatttttttttatattttaaaccttttaaaaataatattattttattaatagaccctataaaactgccacaccatttttgaaaatgaacctttttagctagtgtgaataacactggcatgccatttatgagaaccctaatgaaatcctgccaataacaatcttgggtatcgatgtcaacctgtaccactgtgccaatgttcttggtaatctccttcccatggcttctgttcatcagacgaggcggaagtgcgacaattttggcctaaatagccaatctgtgaaaactgacacgaagcggattaacatccgcatcgtacttcttgagaatcacagcatgcttgcccaccatccacggtttctatccgcatccgtcctgaattccgtgacaaataggttgttccccatcgaattgaacaataaaccccgcgaatcttccgcgtcgggcacccgataggggagaaaaatcaagcgccacgcctccgcgcccccaccacgtgcgcccattgcaacattcgcccggatataacggaaacgccctattaaggacattctacggcagccgtaagccgtagaagaaccatcatgtccttgatgcgaccactcacaactacaaccgccgctgccatggtcggcacgactttcgccatgtcagattggattggttcccaagagccactgaacctctccaaggttgggttcgaggtcaccgcccacacattatccacctcgctgatcctcacatccgccacacaccaccaaataaccaagggcagacaacaatgcaaagatcaccccgaattgacactacaagagatcttatgataggtgacgtttcatttacgtcacaaacattgaatttttcatcatgttccgtaatctgtgacgctcccgtgacgaaaatccattcgtcacctatcatgcgtctctaatgatgttctatgacgaaaccttattttttcgtcattaatctagtgacgatccttctgtcttctgtcgtcataagtctatgacgtccgttttcgtcaccatcaagcccaaaaatcgtcataagatgccatgtggcctgttaaggcccatgtagtgagcaatatgattatgggcttagcccaatggcaagcccaactagattttagcttggctcatctatgatgtaggacattttcagcctgtttatgggctgtttatgggctgagcccaattgaggatggatttatacactatttcagcccaattttattaatccatttacagtagtatcaaaaaagatgagtgggccaagcccattttgaaagacaaaggcccaagcaatatacccaataacaaacatatagcacaaagattgtagcccagttaaaatccaataaaattcagttcacatatgatacattgcaaatacatatgggccgacccattcacatattcaaatacaatcacaagtttgataaaaaaatagattacaaggtaacttgccaaaacaaaatacatcagtacattgaccatgcatatccagccataagtcactgaccaaaacaaagtcacatgtccacatgggccgacccaaccatgtccaaatacaatcataggttcacttaccaaacacaatgtcacgtatcgaaatcacaccaacatactgccatctcttcatgaatcagcaagacaacaaaccttacctctgaaattacatgcaaacaatttgtaaatgcatgtttagtttcagctgctgaaagagaaaatttacaatatctaatctaaactacttatttatgtacataaccatgaacaaagaattcaagtacactgcaaactacttgaacagatcaaaggtaacttatgcataaagtagaccatggagttatactcatttctcatataacagtaaaaaagaagcgaagcaatttactggtatcttaccatggcatgtcaatgagatcctgtcctttgctgtgtttcacagttaaaaggaacatggaacagtagaatagtatggaacattctcatggttaagtttctttcacacttgtcctatagaaaagcaaacattagtagcacagtatttgtaaccacaaccatacaaaactttgaacccccgcatgtggccatacaaagctttgaacccctgcattgcaaattgaggcacaggcataggcataggcattgcaaattgaacatatagtactagtaagtacctaaatagaaagagaacataggcatagcaaatcaaaacaatagagttatacatgccaagacatgtgagacatatgcatagtaatgtaagcctactgcaagcagaacccctcccccttccctctacgacaaaacaaactgaattgcaaactcaattggatgtgtacgtagtgctttatcgacagattttcagccattgtaacagtaaagtgtggatgataaaaaaaatcatatatggtgaacacatattatgaagctactattgggtatgttttcggttcagattacagggtagttacatggatctgatttcagtagaacccaaacatgaaaccatggctaattttttatgctctattattatattggatatgtgctaggaagatttctgggatgtgtgaaagatttaactaatgttctgtagtcatcattaaggtcatgatgctacacaaagcacttccagccctatatatctgatcacactaacaaaatgcagctacaagtacccaacacataagttatttatatcagaacttaaaagtacccttctatgtaaaagctaacatcccaaagagaataagaatcacctttgtcataaaaggtgagcacatgtaattatacaagaccaaaaagttgtaatttaaacagaagtgctgagactattgtttatatagatagctagatcattgtgcgtgctaaccttggaaaaaaaggaatagttttcaccacccagttactaccttcttcagatctcaccacccagttactaaaaccctgcaacaaacagaacccagttagttgaaaaaaaaatagctagttgatgaaatttgctatataacaaaatgttattttcctacacagtcgaatcgcttctgaaaagatgggtgcaaattttagtttgtcataaggctgaaaatttgcttacaaaacaactcatggtcaatgctaaataaatgaaagtcatctgtactgactgatgttttggtaacataagaaagtttttttttactgaaatttgagaattgaactaacctatattgactgaaacatacaaacaaaactatttcgataaactaacctatattgactgaaatttgataaggacctctacttgctgaatttgctaaaatataaaacctaactactatgcagagttttgtttctccctgaactagtgctctatatgccctacagtatctactcctactttgtccaagacaattctactgcatttacaaaactaatatatactttctgaaatttgttaacagaactaatatgtacttgctgaaatttacaaactacaaaaataactgctgacaaaaccaatacccattttgcatacaaaacaaaagactgaacatgggtatataatttagtttgtaagtacacttgattgctctagaccataattaaaaaataaactgataggaaacctaacctaacataatttgtcatattcctctgattatctccacctgcacatcacacatttctgaaattttcagttcagatcggttcagcattttgtaacaaagaaactaagcatgctcagatatcagggaaaacgatatatatatactttcttctgaaagatggatggtttctgaattctgatgagattaacaaacaaggcttcaatttgattacaagtcaagaattatgttactgtgaggttaggtgaggtgaggaatgcaaaaaatgcaaattgcttctggtggagagttagacagtgatagatgtgaaggactttctccttttccgcaacaacaaacaacatatattgcagatcttcagagcagtacactgctgctgtggctgtgtctaaatgcctcctataaagttatactagtacccatatatgcatgcacaaaagatgcgcacgcacacacgcagacaaatccaagtgatgactgatgctgatgcctgattccttgtggtggtttgcagtgatggcatttcactagctatagctaccttctcctcctctcacatgacagatcgatgccccaaccaaccaaacctatatattagtaaagctatagctaccttatcgtcggcggcaccggatccgcgcggggcggccgagccgccccgccgccgcggtgttgaggaggggggagggtcgccttatcatcgtcgttgtcagcagcggtgaggaggggatggcgggccgccgagccgaggtcgccgagccgccgcccgtcgccgccgtagccgctccctatggcggcggatccggccctcccgagggcggcgccgccggatccgccgcccgccgacgccatcgccgctcctgcccgaggtcgccatccgccgccggcaccacccgcgtcgtcgtcatcgtcgcccactcgtcgtcgccgtcgtcggggtcggcgtcgtcgtcgtcggggtcgccgccgccgccgccaccaccaccggggaggagcggccgcgcgcggagggcagcccgagcgacgggggcgccgagagaggaagagaaagagagggagaggagagaaagagtgagagagagagagaggaagagaacgtgtgaggactgagaaggggaaaatatcaggggggagagagagaagggatagagagatgaaatttttgaagtggtgtggagggaaaattttcattgaaatttcgaatcgatttttatagtactaaatcaactcatataaaaaagtaaaaaataaagttgtacaactcattaagatctatcaatttcgttttggtcatttctccatccgaatttgattgaagtatataaaatttgaattttaaaatataagaaattcaaataactttttggatagtaaatgatttcaaataagaaagttgtcaacaacaaagttgtataacttatcaagatctacaacttctgttttggtcatttttctatatgactttgtttgaacagtatgaatttgaatttcaaattatgacaacttcaaacaatatttacaagtacttaaatgatttcaactgaaaaagacatcaataacaaagtggtataactcatcaagatatataaattttattttggtca

SEQ ID NO: 7870 - DNA, 22719 bp, Oryza sativa
ggatgaagaaatgaccaaaataaaagttatagatattgacgagttatacacttttgttgttgatgatttttttagttgaaatcatttattatttgaaaatactgtttgaagttgtcataatttgaaattcaaatttaaattattgaaaacaaagtcatatagaaaaatgacaaaaataaaaattatagatattgatgagttatacaactttgttgttgatgaatttttcagttgaaatcatttagtatttaaaaatattatttgaagttgtcataatttgaaattcaaattcaaattattgaaacaaagtcatatagtaaaataaacaaaacaaaagttttagatcttgataagttatacaactttgttgttaagaattttttcatttgaaattatttactacccggaaatttatttgaattgagaggagggactcaaaatggacttctcggtgagggaggagcaaaagggctgggccagcggcccaaagagggaggaggggaaggggaagccggcccaaggagggtgagggaggctatgggtgaggagggagaaagtaacacttgggccgaaaaaggcccaaggagagagagggaatttaatttgttttccatttattttaataggttaaatgaaatttgtggtattaaaattagttattgagctccgaaaattcactgaaaatttcatagaataatttagaacatgtagaatattaaaaaaatatttctagccatgatttttaaaggaaaattttagtttcctcattaattcacttgattaaattgctttaacttttaatatattttttttagaaatgcattatataaatctgtgacgtttgctatttggcgcttatgacaaattaatattcgtcacaatgtcccattgaaatactttatgacgatttctagttggtattaacaacgaacacctttttttcgtcactaagccaccccatctcatactaatcgtcataaaatggaatgtgctaatgacgaatagctcagacgtcatgagaaatttgtcacagaaggtcatatttcttgtagtgtgatgtaatgcaagagtgagtaaaccagcagtcaggtaccaacaggcaggtcccaagaggtaggaagaggagagaaacgtgatcaaaatcacgatctcggaagttcttgaccgagcaaccatcaaaacaccgccggggcatcatggaaccctaggagaatcatcacaccacctctgttttgctgcaattaagcctactcaactttccatggatcaaggatcctatattaaagagcgtaagtgggtcagttcacgaaccctcatatactactaaatagataattatttatactacgaatagattcatggacaaacccacttgttccctacccacaaacatcgcacaactaacctgccatgtcagggtaaaaaaaaagaacgattgaagttagtggaaggcccactataagcagggaaactacctggctggccgctggcccaagccaccccgtacccacgctggcccacctcacccaacaaaccgaggcctccctaccctccctcactcgggtgcaacctagccagcctaggatgctagagcattatcttccacctccagccgcccatctctctccctctcggaagaaccctagcgctctcgcccttcttgatccacctcctagagcgtttcctcttttgattgaacgcgaaaatcagtttccatttcccttaattctcccccactcaatcaagtctttgatcacccataaccaatgactttactccctccgacgaatcaaagccattgatgacgacattcgagctccacggtgtctccctcccttcccctatgtgctataaaaggagcccgcaacctcctcttcaccttcctgatgctgttcgacaatcagacgtggacgtggagcatgatctaacgacgtaacaagaaaaacaccgaacgggatactgttgatggacggaggatggtagcagcttttaaaaatttttaagtaggtaaaaagtatcatgttattataaaatttatgtgctatcacattcaatattataaacaccattctagtactggggattggcgtcagcgggaactaggcactacttgaatgcctggtattgcgtggtccaataagtccacgtacctccaaaagaaaatgttgtgattaaaccaacttggtcctggaaacatggctagctacatagtacagactagtcgtgctttatttttctagcatatctagcagagcaattattatttttaaaaataactagcatagcaatatagtgacagttgtgggttctacctcatatataaaatttaatcttgtcaccttatttatataattatatcagttgcatcatgtagtttaattaacccgtctttttaatactttcatattttgggctacgtgtattcgtccgacacgtataacatatttttctgcagggctgttcagtaggcagcggctgcggcagcggctgcgctgttgtcttgtgtttgtggcattcttctactgattggagcgcagctgcaaacttatgtagcaaccaagcagctacagctcctattttactatccccatgtgaaaatatttaacacatcagacaataaattcttataggtctacccactttgtcgagaaaaaatcctttatgcagcctggaacatttggaaacagaggaactccctaatttttcagaatttaccaacctcaatttcttcctggaaagctctctttaagagtgatctgtcccttttaatttttagattaaatgtttataagagacggttccttttgaattggttaaatctcttgtaatttttgttcgttaataaagttttttactgtgggggcttcccctaccttgttttcccttaaaaaaaatatttaacgacgataccgttacaattggcatttgtgtcccatttttttttactggacggagaatcttccaaacgctgttgaattggtcgtgcacaatctaccagccccatcatttgacttacttgagtggcatatttacaaacaaaaaataatttattaataaaatttttatatgtatgttcttagtaatttaaaagaaatgctgaaaaataaacttcgttgaaaaattttaaaatcaactttaaatttaaagttgaagattcaaattttaatttataagcatgaatataaacataagcgataagcgaaaagataaggcctacattttacatacaccatcctatgcgacatcgggtactctctaaacatgtttggacattgtgagaaagagatttcccacgcttgaaaaattttcggaggcaacaaatgctttaaaaaaacacttaacacgcacacattaaccacaaaacacgcagatggacattgaatctactcctaatttaaacatgccgacctgggcacaacacaacatgacaacaacagtaaacatgttcatcgcgttcctttttttctttttactgcacgtattatatattatagtatagattccgtaaggaacctgtgttcacacacagcatccaaatataaaaaggtgatagaatacaaaagaggaaagggtgatttgagaaagcatatgtaagcttctagaagaatcctggttggtgggtgcactcgtggtctcgtgcctgcgctgcttttgctgtgtcagagcaagataataatagagccgacttcctactattagccaattttaaagccaacacatataatagattagttataagtttggctacaattttcttcttctctctatgtctcacttatacattaattgtatttgtctaggaggttgtgttaagctagctcttgtatgagagccaacacccttaactttttgtcacatctctcctctacataagcctataatagatttatagctcactattatacttactctcatgcgactgatgactacattcgctgcatcagtgaggaagaataatcaaacgtgaagcgtatactctctacatatgattatatgatgggtacggcaccgttgctcacgtgtgctgcttgcccgtttccttcgttgcgcacggacgtggtcagtgacagtactactagcatgtttttttttccccattcgacgttaatcagtttaaaattgaattaacgaacgtcaataagtaagaacaaaggggtactatataagattaaatatatacaaaacttgatatgaagcggtcggaaacggtagcatctttttagaaatgatactcgatcggctggtaattgatcatatttatcatttaaattactcactatcgacattaatacgatgcagaaagaattgtgaaaaataaaatttaaaaatagcaaaaaaaaagtatggtcggaaacgataccccttatacggaaacggcgatcggtcgatcgggaatttccgtgaccgttttcacccctacctgaaagagtgataccatgtacaccacctattaagttagaacggcgtagatctagagaagttttgttggtgctatagcactcgttgataggtaggttcggatctatataccagtgaccggtcatcaccaatggtcaggagggcaccatcgctactgcctctcctttaagtcaggaaatccacatcttttgaactactagattatctttttttacccactagaaacctaatttgtctaatgaaaatctctatgaagttggagcatgtggtgtcgagaggtaagagcatgaagcttcgtggttcatgctaaggttggatatgttatattacctccgtatttaagtactgagtaaattttacaaaataactatcacaaaactacataatctagacgtataacaaactataattttagcactaaattcttcataaagctatagatttaaagtcaagtatcacaaactatatatttaatattgaagttatcataaaactacaaatttgagagtataaatccctaggactatgattagcactatcattatattggagctataaacgttgtagttttgtgataaatttgatacgtaatatttattttttgacactccatctcaaatatatagttctgtaagaaatttcatgttaaatctgtagttttttttataatttggttaattgttttgtgaaatttactcataaatataaatatatgacatggctcgttttatttggctttggtatgtgctctctccgtcccgaaaaaaactaatctaggattggatatgatatattctagcacaacgaatctggatagatgtatgttcagattcatagtactagcatgtgtcacatccagtaatagactagttttttatgggacggagggattaagtttgaacactttattctattagaataccaaaattttaatattataaaagtaattgtaaagagaaatctgcccacataagatttttatgttttcaaactattttttaaaaacttatcgatgattaaactttcaacagtttgaccaaataaaggaaagtgcaactcgattagctcaaaccctgatataaatacatcgaaaatcaaatggaaaaaaagttgtttcttaatcttgacaacatgaaaattagatatagttaaatcggtttattttgtgtgtgtgtttttgaaaaaggggtttatttgatcgtgattgattagggccttacatagttccatgtgctccaatagagctgaactaaaacggagcagtaggacacgcgtcacacgatgcaaaaaaaaccgaattgacggcacccattcctttcttcttcacttcttttccgtctcctctgctacaagcgttcgtcaccgaacctagcttctccgcaggaaggaaggggcagcagcgtcgccgagccagtggccatcggagcgactggatccggcgttcctttttttactgctgttcctctaatcctctcacatcgcttgaggtcgagctcccatgattcttcttcccctgcaactgcgagatggatagcagaatttccttttccccaaatgccttgaaaatttgttgttttcccatgggggatctttggtgctgcgaggtaggccaaaaaatgtttttattaaagggttgttttcaaaaggggattttgaattgacgaaatttactacagtacactcaaaaattgtataattggttaagtgaaaaaaaaacactgccaataaacactgcaaaagttgtgttggacaaggcattattttatattttctgaacaaaaataaaggaatttttttttgaaatgacgggaatacccccggcggtgcagcgtcacgccgagcgccactccgcttcaccgccaaacttcaggcggcattgtagaagcagcaacaacagtcagggatatcggggcggtcgtgtgacgtcggcgaggaaggcctcagaggagatgcggtggccctcgagggatcccttgtccatgtactcgagcatgatctagagctcgtcggcctgttcatacatgccgtggcaccacacgatggccgggtgtggcggacacgctccatctccgacaacgaagacggggccggcgccacggagccgactgaattcggcggggtgaggacgccgctaagcgagaagggcctaaatgaggacgtcgactatggcaggagcgggagcagcacggcgagggacgtgaggtcctgctgcggtagcagaagcgtgagatctggtcgacgccgcgaccgccccggcgtccccaactgatgctgttgcagtcccatcctcaagttcggtggagaagtggagaggcgcacggggtgacgaggcgccgctaggcattcccatcatttcgaaatctctcacctctttcagcacggaaattataaaataatgcctatggtgtgctacaatcaattacataacttttgtagtatctatcgacagtgtcacgtttttcggtatctctcagccaattatatgattttttagtgtcatgtagcaaattttacaaatggatttgtacatgtgtttatgcttcacttttatcattttttaagatccggttgtatttgccgtgtggtgttgaaaatcgtgaaaaaaatcatggatggatggatggatgtggaatttaactatttgcaactattagtttcaacaataattcaaataccccttagatttgcacttattttttttcctcttttaagagatgccttcttaattattttccactttttcccatgtggcatagcaacatggcaatgcatagtagaaaccgttgtgttacccactagtcatcctctcatctcctcctcccctcttccttcggtctggcatacgatgacagcaaaacttgcggtgcagagcagtgacagtgacgaaggaggcagagcagcggcggacagattccttgcggtggtagaggaggcgaagcggcggaagaggagggcggtgatggaggaggcgaagcggcggcaaaggaggccgagcagcgtcggaggggcttctcgtggcagtggagacggcgacagacgggctcctcgcgatgctggagggggtggagcagcggcggtgactgagaaggagggtgacattggaggagacagagcaacagtgaaggaggcccagcagcggtggaggggctcctcgtggtggtggaggaggcggagcagcgagcggacctcaggacggtgacgagttgcttggaggttctccgatgcacgccggactagagggagagaggaaggggagagaaaaggctgactagtgggtttcacgtcagtttctaccctacgttaccatgttggcatgccacgtaagcaaaatggcaaatagttaagaggggaaaaataataagtgcaaatctaatagggcgtttgaataattaccgaatctaatagtattcataggggggatggataccctatactacgtgagtatttttcacgtattcctggtaatcgtagctccaaacatatcgaaaggaagcagctacacctaaggatacccagatacggttcacaggtaacttatccgtatcggatgtatcagatacagatatgtatcggatacacccgtacgtatccctaattaccgcaatattaaaaaaagaaaataaactggatacttctccgatacgttccgatgtgtttccgtcccaatacgctaaccaacgctccagcacagaagcacaacgcagatcccaatcctcctgcggcaacgcagcgacgcccgcatcgctgtccggggcacaccgcgcagggcctcgaccagctggccgccgggttccgccgccgctcgcgcacgacctgaggggcaagccctccaccggcagccgtgcgtcgcgtcgcgtcgccacccgtgggcgtaggacctccgctggggtgggtccaccaacaggcaacgcatacaccagccatttggttctttcttttcccttttaagtctcgatttagattggatttcgttatgtgttttcccatgtcatttagatccgatgaattttggaattaaaatcttaatcgcttactccctccggttttattttaattaacgttttggacaatgacacgatctacaatatatatatttttggcattatttttctattataatatatataataaataaatgtatttttatttttattatagtgttttaaaagataaatctatatatgttgttttagttcttttaaactaaatatttttaaagttattgatggttaaagttataaaagtttaatctcaatcatatccaaaacgttaattaatatggaaacggagggagtatttaacatgcgactatgttagtgtggggatgtaagacttccagccacatcgcagactatgaatgcaaacaacgcttatccattatgtttcgctttgtatcttttattttttaaatatatatatatatatatatatatatatatatatatatatagacgtattcctgtatccgcctatccgtatcttggtatcaagttaacatactgctctcctctgccacagaaaatcccaccccaacaaacccagcgcatcctcatcgtcgtcatcaggagagagagacccagcgtgcaagcgtcatcaacctccctccaccttcattccacctcaccacgcctcctcccattcccgtttcctcggccgcaaatccagtcccggcgcccgcatttcccgttcccaaactcacctgctcctcccctccctgtttgcaatccagcctctaatcgggatcggcggcggcggcgtcgctgtcgagggcgacgtagggaggagtcgcggtttcggctccgcggtttggagagtttgattcggtctctcccctttttctcatcctttaatccggtgtgtatattcctataagccgtcttggttcgctgcatgttcgatttttttttcctttctcacatcctttttattcggattcgattaggaaatttgcttgctctgtttcttggtccaccctcgccgccgctggacaggtggacgctgcggcggtgcggctccggcgccggttcgcctcccgtagagaatcgcgcggcggcaggatccagcaaggccgccgccgccgccgctgggaatcttctcttccgcgtccgggatttccggctcaggtgaggacggtggctgcgtctttcgttggaattcgctgcttttgcttattgggaagaagaatcctgttttcctgggtgttcttggtcacctcgtccgctcccaaatttatggaccatatggaattcctcgatctttgttcttcttttgctatattgggacttggagcatgcggattcaaattggttttgcttcgaccagagatttcgagccgcggaaaagctccaatcttgagacgcgcccggttgtcttgtccgccatcggaaaatcgtggctgatagtagtattccgataaccttggagcttctaacctcagctcgctgtcctaaaatttgttgatatcccgctttcgatttggcgacttagggcaaaatattccatgtttctgtcaattttgttgctcgatcaaaggatatgtgatgaatctccaagtaaagtttaggctcactttttttttattaattgaatttgattggtgggtattggaggctagctcatgtgtagtggtgctgtctcatttcattattggccactcgttcctaccatcacttttctagtagccttacatgcttacagattccaaagcacatgctccctcccccatttttctttactttatttgtttgctttgaggtttccctgtttatgctactgcacgaatcatgtgtgtttcatcacatggtcagtactgtcatattcttggagatgtcctcattatggtttctttaatgtgttcttgttttgctatgtttgtagcttcaagaaaatacttgctgagctttccctagaaagtaaaacaaataaaggaatatgagatcagtagttcggtcgcttcgccagctccggcgattcggccagctccatgcagagagacactcatcaacgaatagattgatcaagcagcagaatgctctagtgctgtgcagttcagcttccagttcaatgagcacattatgttgtaatagagaaattggcagatatgtgagcccaagtgtggaaatactgaggtccagcttttccactgtggcagctgattcaatcaaaggtacattcttgcactcatttgtattctggtagcggcatttcattcaacatattttctttcccaatttgtgtcagatgttgcaagaggtggtccgatggtggaatatgaaaggagaatagcatcaggggagcttgtggatggtgataactttcaggttgttgcaccgctcctgaatgtttcctttcttcttgtctattttcctttaatgtttggtgtaagatttttcttgccatttttcctcattatacagattgatactattcaacatttacaaaggctctatgaggagctggttgagaatgaagaagcttgccaactggacagataccagtcatctgagaaatctggaaggtaaatgcagttagaaaacacggagttctcattgtttacctggtagtgaatgttcctaagtcctaaaccttattattatgtttggcaggcgtagatggctatggtcccgcctcattacccagccttctacctattctccggtgcaggggctgtatatgtatggaggtgttggtactgggaagacaatgcttatggacttgttctatgagcaattgtaagtacctcaacctagaatctgtaggctttgttggtgcatccttgagaagttgagaacttgagataaaacagttatgtttcatagtgcagataatagataaaacttgtccatagattgcttgcttattagtaattcatcagtgtgcaagtatgtgtaatgctcttcgatgaaatgaaaactctggtgcaaaatagctcatacaggatttgcatggcaattatgcagtcctcaatgacctatttccatatttaatcatatagagaactgcataaagaaacaagtaaacaagtatgcctttctactttttacttgttcactataatccatatatgatctgcattcatggagaagcatacaatggatacatactgaaaattgacatggtgaacaatttcaaaatacagatggtatgttactttacagaatttaagaagcttcatcagtggttcatgtactgttacataatgctaaaatagtaaaaaaatctctatctatggaattttcttgagttattcatttggacattgtctagtatgaagggtctaggctattggcactgtctagtataattattaatggacattcatgtgacttccccaatatggagtcgataaattttcaaataaaaatttcacttgcttatatccctaaaatttgagttctggttttaatgaattcaaaataattcatgtcgaccaaaccaataataactagctcaaagccttgtcagtatcttaacacatgagttatgctaatgaattggcttgaaatcactcttcttaggcactaagataatgagagaattatgagctacacctggttgaactgaaactcttggattattaattgaaaaccagtgaagattaaaatttattacataacacataggaatttcttgattatattccagcattcttttgaagaaatgcactaaatcccttggtcaagagctttgtccattatgggatttccagcataaaaaaacactaaatggagtaaacataaacatgtctcttaaatattttggctctttctttgcagttgtttagaaataagtaggaaacatcaagtagtatcttggccagtccaatctctgcagccctatttgctagattggagcctacagtgatcatgatgatttaatattaaattaaaataaccatatttctccctcttgaaggaaagtacctggaaaaaaccatcatgcgtcttcctttcgtctttttatgaaatatcagtgtttgcatcaaaacaatttcactgtgtggtaaaagaaacacaaaattactttttcatactaaattggttttttttttttttttttggggggggggggcaggccagctaattggagaaagaagcgcattcactttcacgatttcatgctaaacgtacatagtcgtcttcaggtacttatgtggatataatgtgcataactagctttctcagttttagttcaggcatatattattggactttcatctatgtacagatgcataaaggtgtttcagatccccttgaggtggtggcagctgagatttccgatgaggccatcatattatgtcttgatgagtttatggtatgtgtatgcttatcgaaatattggattgataagtatgtgtcttgttaacaaattcaagacattgtacaggtaactgatgttgctgatgctatgatattgaaccggctattcagacatttgttcagcaaaggcgttgtatgtgattttttttcactctcttattccagttaagcaacttgcaacagtaccttagcatttcatattaattatcttgcatgatgatttttttctcagattcttgtttcaacgtctaatcgtgctccggatcagctttacgagggtggtttgcagcgagaccttttcttacctttcattgacacgttgaaagtatgagttagtttcacaatttttactgtcaaatcaattttattgtgcatgtttactggactcaacttttgtgaaccatttcaggaaaggtgcattgcacatcccattggctctgcagtagactatcgtcaattgggttctgtatgttgcctatcttttcaatatattactgtttaattttcttgtaaaccctttcctttgttgacatctttcatctgatacatgaacaggctgaacagggtttctattttatcggaaaacaatactcacttcttaaacagaagttgcaaacattaattggagatgaggaacctagacctcagacagttgaagttgttatgggacggcaattgcaggtcttttataagttaaaatttttaagtagctagttttgttccagtaaaaaaataacttggtgttattattgaaccttaatttgttgcaggttccactgggagcaaatgggattgcatatttcccatttgaagatctttgtgataggcctttaggtgcagctgattattttgggctgttcagtaagtatactggtgcaatgcattttctcaatcaggattttcaaatgcctattattgatataacataattgttgccaaattgttactatgcagaaaagtttcacaccttggcacttgatggcattcctaagtttgggtctcagaaccgaacagcagcttatcggtttgtcacattggttgatgtaagatcattgtttccttactctattattttcatgttcaagtttgcattggcctgactgcttagacaaccttttatagttatgactccgaactactagacaataagcaccttgaacctgatagccttataagcacagatgacatttgctttgcttctctttagtactaatgcactaaattttcttatgaatcttggtctcttcgctagattttattatataatagtgtctctgttcaagattgcaaagcatatattttgagtagttttgtcaataaatattaggtttttctcatatatcaacgcaaaaaacaaacacatttttttccttcatacccccagtaaatattcaccgttactttatattccatacatgcatacatttaatatagcccttaagagatactaattctgtggttaacctagtcctttttaatacatgctttatgtgcaagatgacatatgccttgtatgttggatggacaggtcacgggagtagaattttttttattgcagatagaaattattcttgagcataaacaagaacagaattcatgttaaccagaacctctgtttaatatggcagaagtaatctcgtctctaaccaccaaggaaatgatgacatttcaggttatgtacgagaacaaagcaaggttattatgtacagcagacgctgcaccaatagaactatttgagaatatagtgacagttgctgaagcacgaaaaatttctcctagatcttcacggtcgcagaaaactgatgatcctgacttgtgtgtggacaatgagctaggatttgccaaggatcgaacaattagtaggtaatgtcaaatttgtgatattatgcataatgatttcagaaggcaataagttttatcgtttctggtttttttgtttatgcaggttgacagagatcaacagtagagagtacttggaggactttgaagcgaaattgcgacagcccttacaaggtgtagataatgatattgatgttgtactagtgtaagtagcagcaaattgtctggtatgaattaagtctaccctcctggctttacaaaatgaagaaagaaaatgttggttttccaacattggtgcatgtaaatttgcaataagccccgtaagaaattttgcaaacaggcgggtcatccataaagtgtaacacctgtagagaagaaaaatgttgttcgttcttctgaaacctgtgttgtgtctttttgcctcctctcactttctattcccatgtatatgccaaaacaccaatatcataaaaatagaatatgttagattcagtgagtgatgaatattgtcagaagtgaaggaacaatttggccactgctaacaatgcctggttcctcttcaatcataagctcatcaagttatacagtgtgcaatgggaatgaataactgaaattcattttccctgcattttacaagaccgctattatgtctcgttctagatcatacggtaggaagctaatgcacataattgtttataccctgccgtaactagttgctacagaagataacccccaatccacaaataaacagaacccacacaaagatttcaacaaatttgggctgtcaattcttgagtagctgcgcttaacaaaaagttggtatttctttattaaaaaaaatctggttgtcacatcttttgggtgtataaagaatttcattcttcaacgattgggaacaaaatatcatgcaagaaacagagggatagggatgttggattctgtcttctaaagaagggaacgatcttcatactatacagagggatagggatgttggattctgtcttctaaagaagggaacgatcttcatactatactcgtgagttgatattcctgtcgttctaaaatataacaacttttaaatatgaatttggatgagtgtatatccatatttgtagctgatggttgtgatattttagaatgaaaggaatgtttaagtgcaaagtatgaactgtagcatatccgactctcccttttggagaactgttgcatattcagtttgcagcatatggttgttgtgatctgcagaggtggagatgtgtggcgatgggcaacacaaactagttccgattctcccttttcgccgtcatgctgtgacggaatgtttaagtcattgatgaagttgcaaactatatcttctagcttctcttttttgtgttttagttttcttcgtttgtgtgaggtgtggagtctaagttttggctatatatatccttcgtggatatagaggtcatattattaaaaaaaactattatttaaaaaatattatagctaacagttgctatattttgaaacggagaagtactataaaaaaaaataatttgtagctgacgtatcaaagtatataagatacaaatggtgctctgtgtttggcatcttatactgctaccagatttttaaggagcatcagttcacaagtactatgtttcctttttcttttttcttttttggagtttgtgtgtattttattttggtgcagatgtcggatgctttgatgtggaaaaatttgtggcggaatgctaaatgttaggtgcaatatagatttatggattgagctttgaaatataaaattctactttgactaatctgcagtctagaacaattgtccgatcagtaagacagatgatgttgttaaaaagaagttattaattattaggggcaatttcgcatttgatcctgttttgaggactaaggccgtgtttagttgttttggtaaaaaaaattgtcgtatacggacacacatttcaagtattaaatgtagactaataacaaaacaaatgtctgtaaattgcgagacgaatctattaagcctaattaatccgtcatcagtaaatgtttactctagcaccacattgtcaaatcatggcgtaattaggctcaaaagattcgtatcgcaatttacatgcaaactgtgcaattggtttttttgtccatatttaatgctccatgcatgtgtctaaacatttgatgtgacggaaaagttggaagtttgaagggaactaaacacagcccaactaccaatttgaccctcttctttcaactttgctcatttgagccttcttttcaaaattgaaaatataatctgaccctactccgttaagggcatgtaacggtgttaattggagcaacaaatgccccttcttcccttgcttatttgattctattttataaaaaatataaataaaatataagaaaattttggatttgtgaaccacccatcctcttcaccacggcgctgtcatcgtcgctgccgacccggcggcggcacttgaacggaggaagacggaggtcggtgcgcggggagggagggagcggcgccctttgtggcaaaggagctcgccggcgtgcggagggtgggcggcggcatcacacgcgcggagcaaggaggccggtgcgcagaggacgagcatcaccctgtgtggtgaaggagctcgccggtgtgcggagggtgggcggtggcatcacgcacgcggaggaaggaggccggcgcacagaggacgagcggtgacggtgcgtgcgtagagggagggaacggtgccctgtgccgcgccggagctcgccagcacgcgggagagaggcgcggaggacggtggcgagaggcagccagtgctggagaacttgttggcgcggggtcacacgtcgttgccaacccgcaagtccctaagaccaccgccacgccgccgtcgctgacccgccgcctctgaatccacagcccgcatgcctcggcaacgccgtatttgtggctcgcacctccagccgccgacggatccaccgcctgcacaccgccacagcccaagctatgccgcagttgctcctcctcctcatcgtcgagcctccgcagccgccgtcgccgtcgccgccgctcctttctccgcgcgcgccgccatcgccgcgcacgcgttgccgcgggtccagtcccttcgtgcctctccacagccgccactacctccctccacaagtggccgcgtgggctcatcccctttgtgcgccgccgcctcaagcggaatatgagagagatgggagggaatggatagggttaggtgtggatagggtttgagggtagtttggtcattatgaataataattatactttttttagaaaaaaaaagaaaccttaacattgcagtggaaacagggttagacgggggtatttgttcttgaaaagcatggccaaataagcaaattagaaaaagtaaggtcaatttagtagttaggcttcaaaatgagatcaaataagtaattgtccctaattattaatgtacgattaattagagaaagtttaatactccacccatttcaaaatataaggtacaaccatatggacacagaccacaaggtcgccagaattcttcagtatgtatcatccacaaatctttaataatctttaacaaccatctcaacttaaagaccaagaaataattagatcttcatggtggagaatttaaataataatattttagtgcagaagaggtgttagttaatggcatgcatgcatgtatgccttatattatgaaacaactttaaaaagtagttgtgccttatattatataatggagggagtaatatagctaactactacctccaaaaattaacgcatcatctatagctaacttaatagactaatattacaatagttaactatagatacacactataccattaatgcatttcccacatttctctctcacatgatttattgtagcccgcttttcctctctcccccctcctctctgctccacataagcacaatatgatatggcaacatgtataacccgcttatattatcttattgtactcgctcttagcaagagaaaccaactacttccgtccaattttaagcgcagttgtgggtttctgtgcccaatgtttgatcgtccgtcttagttgaaaaatttataaaaaaaattaaaaataaatcatgtacaaagtattatcatgttttatcgtgtaataacaataaaaatactaataatgaaaaaaaattcaaataagatagatgatcaaacattggacatagaaacctacaattacacttaaaatgtgatagagggagtattgagtttgtgtttacttgattacccctatttattaatagtatagcattgctctaaaagtaacaatggtgtgatgttactatctcggagaagcatctcttcgatgatgtagagacgaaagaaagatactccatccataaaaaaaaacactcaaactaggtgggaatgtggcccctcctattacaacaaatctgtcgacgggggatacccgtggaccggatatagaggttattggggtccgttggtacgaggatcgacgtagtatgacatcaagcaaacaaaagataaagactatactggttcaggcctcttggtaggtaataaccctaatccagttggtatgggattaaatgatggaaaccacagattacaaagggaatagcagaactcgatgataccgacgagaccgtagtcgagttggtccgactagatctcccggcgacttggctcctgcacgctccggctccgtaggctgtggtgggtgtgttggcggtgatattctatgccttaggtcttgcccagggggtcccttatataccgcgggtcagtttatctccaagtaggactcggagataacggacccctcacgatatggtgaagacccagtcttgtccgagtagaactccttccattcgtagacaccatccctatcacgtgatagatttccttaatgtatacggaaactatccgtatacgcgcgggtataccgtatcaatatacaacgcacatccaaggatagagggtataccttatccgtaaccctgacagtagcccccgacttctgcttaaatgagctcatgttatcgatcgtggcttctgatgtcggaattgttgtcgctctcatctagtcgatctcggtgtgaaaaccatagagacaaagagccatcgacaacaccgcgtgaagttcaatggtcatgagtgaatttaaattgaagtctgaaaaactaccgcacaactaccgcacgcaacggacccagaattttccggcggcaatctctctcctttccttcgaatacgcaccatcagaagcgtgtttatttaaagggattttggggatccatttgaagtccgtttgccagaaaactctcctgcgttctagcgctccttgtcctctccactccccgcaaaagaaaaaccctagctcacttccttcatcctgttctccggcgatcctccgacggtgatggaccttgagaagtcttcctcgaacaccacgtccatgaagaagctgcaggacgacggtgccctccccggtcacgggaccatgcagagggaggctggacgtacagaacctgaacccatcttgggccgcatggttgtagtcgaagattatgtttcttgcggttttcttcctccgccttccaagtttcttcttcttgtcttgaatttctacggcctttctttgcttcacctgaaccccaacttcatcgcctttctgagcatcttctctcatctttgcgaggcctacattggggtagtgcctttccttgacctcttccgtttttattacgggctgcgttggatggaatccaacagggtatctggatgcgtcggattccgatttcgggatggcctgaagtcgcgttacatccccttctagtgccccacttctcgtagcaagtggcggacgagatggttctatctccaaatagagaactcagaccccgtccttgttattcctgaggaccagccagaaaagatcctagagtggactgctaaacccgccctgactccctcactccctccaatccattatcgacatcattgatgatctccgaaaatgggggttgtcgggatatgaagtcgctgccgacttcgtagttcggcagattcaaccgctacaggcctacacccatccggccttcaattactctaggccagatgacgtgacccgggtctctccttggggtatttatcctcgcatttctatttttgttccaactgtatctgtttcttctgacttatcgagttctcgttctcgatttacaggtctggatagtgacactgtggggtgccgtgtcggccagataatgatgagcgcaccttcggaggcgaacggcattcctgtctcactctgcgacacggactcggctgaacgcgccactgcaattaacgtgagtgtactcgatgattcctttacatctttcttctcgagatcacgtcgtgacttcatgttgtgcaggctctccctctaacagacgccatcagaccacttgtggatcaccaggcggcgacgtcgttgaaggagggcgtcgccaaggaggcatcagacgttgttgctgccaccacaagtggtagcaatgttccgaagagggagaggaagttctcctccgtgctcgggtcccaccggaaggcgacgagcccagcgataagcttctctttcgtccttgagtgcgtagtcggaacgacttaacctcacatcatatcattttactcaggactcgggtgcgtctccaccgcctcagcgaaagcaaaggttggtgacgatcggcgagaagtaagtaaatgcttttgaggtttttatattctcaaagttttgatcacctagcctcatggagacaagatggcgcgtgcgaaagcggcgcatagtggggctgatgctgcttctagtgcgtcccctgcggcgacctcgacggaagtcgtggccgttactaggaccaggaggcggcgccacgtagtcctatcgcccgcctcatgcccgtccggcctccgtcccccgacgccctcacttggggggagctccaggctgagatggagagcatccttcaagcgggcgcccacggcgtgggccgcgagatcgaggaggccagggcggcggcgtcgtcggcaaaccagcgtgccgatcagctggcgcgtgatctggcggaggcccgcgaggacctccaaaagattaaggggctggtagctggaaacgagacgcagcggcgcggactcgagcactggatgtcagagctcgagggccatctgacagctatccgaggttcgctgcggacatcgttcaccggcctgcaccaactcgccggggagtgcggcgtcacgacttcgatcctggcgcatcctaacgagtggtcgttgatgtcgtcgctcgtggagctggctaaggcaatggaggtgatcccctccagccacgcggccaggattggtgaggagacgtctaacggcatctacatcggggcgtgccatgttcttgcgtgtatgaggctggcgcatcccgacttagaccttaaagagactttggatcggggggccactgatgacgcgcgtaaggacacgatggaggaagtcggtgacttgggggagtccgtcctccccctttttgaagagtaggattttcattttcctctatactccttaatcaacatgctgtaatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaa

SEQ ID NO: 7871 - DNA, 23192 bp, Oryza sativa
  unsure (1)..(23192): unsure at all n locations
aaaaacattgctcaactcgcccataacggcgggcacggctattcgaatagttttactctggcaaaaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaatgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcagctaggcggcggctcagcggacaacagcgggtacggtgcacggcaatgaccggctcgacgctaggaccaaacaatattagattgaattaagaccctagggataaagtacaccggtgaacgacaaaggagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaaggacgggcggccgggcttcctcactcctcggcgcacctcttggcggcggcggtaagcgccggcgacggcaggggcggcgctgcggcgcggctgcaacccggccggcggcggcgacgaactaaacgcgcgcggcgacgaggctacggggcactagagagctcgggagagggggcaaacgaaagaggaggactagggggtcctttatatagccataggaggccgggatcgagcccacatcgacgggaaaaactcgggaaagtttatcttcgccggaaaaaggaaaggatttgatccgcgaaattggaaaggatttccatataaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggaggcaaattagacttttggctgggcttctacttcttggcccgattgaaagagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttccaatgctcaaataatttcaagaaaaatcctgaaaatacttggacacccaaagtatttaacaatattaaaaccagaccatttaatgattaatttaatatgtgggtaattactgaaatgctctttgtatgattaaaattaggaattgagctccgaaaaatccgagaaaatttcagagagttgacttaaccatggagaatttaacaaaaattaaatccatccatgctttatattagggaaattttatttcccacatttaacttcacttgtaaattaatgaacatttaatataaattctataaataatttattaaataatttataaatcctgaaacaaaaatcaggatgtgacaaactaccccccttacaaagaatctcgtcccgagattcggaacggctagaaagaaaaagggaataggtaaactgcagtctatcttattccataactccgataattattctaaggctttaaagaaaactactgctgctttgaaactggtggctgagttgtaacacttgaagacacaactctagaagacgcaactggcactgcattggctcctgtgacaacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgctcgatgttaacttcattgctttcattagtctctgatttgatctcaccaccgatgtttaactgttgcgactgtccttgaccagcgaaagaagattcaccaatttggagtggcttgatacgctgcctctggctactaccttgtgcctcctggaatacagtcattttccttttacggttgtccatcctgttcttcttgtcttcaagtcgaattgctttgtcaaccagctgctgaaaatcagcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgctttttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggcggcctcacacgaagaaaatcagctaacttgttttgcggcggtggagcattattgttcccttggttgagctggttctgcatctgttgtatcatcatgttcattaactgagtctgttgagccagaacttgagcaagagttgggttcccttcattgttattgtttccacttccattagcacgagtgttcaccatctattgcatattagagaagatagaaggagagaggttacactaaagacaagaccttaaccaggttaacactgatctggtgtgtgtagaccattatattgttcaagttgattaagcaagcaacctagtataattacacactcatcattgaaccactccaatgacgggaatgcaaccatacctacacacaagcaagcaacaaacgttctaccctactaactattcttcaaggatagtttggcggcataggttctaaggtaggatccaaacttcattccatgttgacatctgggcacttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttataacatctatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaggattttcattttcctctatactccttaatcaacatgctgtaaaactttctgtaggtccgaactgcttttatttaacgagtcgtttcccttgtttccttagcatgtgatcccgagtacctttgtcattgtagatatgttgatgtcgaggatgtccagcagcgcgggcagcccgatacgccggtagtcgttccggcgctcacgcttgagccgcatgtgccggaggtggaaatcggtcaaagcccatccacggagacaaatatggcgatgacgtccttaggtttgtgtcttgattttcttcgctcctcgtgtttggattgacttaattagccgtgttctcgaaagagaagagtagcttgacttagtcctttccgtgttgggcagatttcaagaacgcgttggctaactgagatcgttgaatccagtattggaagacaaaactcgaggtggccgaactcgaaaggaccatcgtgggggcgaaggaccaggccgtggaaactctccgaggtcgcgaggtgtggtttaactcgtaccttaagagttgttgcacggccatggtagaagtttgcagggagctccgagttccccgcggagatcccgaggagtccgctgctggttatatctcgtggatgaagggggcctgcgcacagctcgaagggattggcaagcgcatcgacgaggccctgaagcaggagtgtcgtcgagcgagccgctacgccgggggacatgtgctggcttgcatccgagatcaccgcccgcctctgcacctcgagttccttcgcgaagggttctcttgttctcggaggacatccgcggagatcgacggtcttgcgcagtcgatggcgttgcttgccgagaaggttttctgctccatggattggcgttggccgtcctggtagcttttgtatcctgtagaaaaacatctcaagggagcatgtaatatactttgaagtattcatgacttgtaagaaatccttgtaaaataaaaatgaaatctatctaactaagttttcttacttttggtatattgtgtatgagtgttttctcattctacgacttcgatcagtcacttgagccatacactctccctagcccccagccttgtcgtcggagaattgttctcgggggataagactcttggacccttgacctgccttggttgaaaaagtgcagagcctagcccctagccgtgaagttagaaaactcaatttccgattacacggcttagttaatacgcacggtgagaactcttacatgaccagatcttacgtggtgatttgtctctgcataatctgacaaggccttatccgctctgggcgtccccagccgaagttcccttaggttcctcagaggccttgccaggacggcgtaaagggacatgaggatagatttcaactctaggtgtcgtagtggtaagggatcgttgggaaggaacactttgacgatattctttacctgaaatcaactttattgaaatcgtaagatatcttacaaatatggatactattgatttatacataaaatttacataattgatcaatgtttcaggagtttgctaactcgcgaccatcgccgtctgcactcttgaatgcgcccggccgcaagacttgcgtaatcgtgtatggtccttcccacttgggtgagagcttgttgcacccagcttggctttgaacccgtcggaggacgtaatcgctgatcgaaagtgtgcgtgctctgatgtgcttctcatgatatcgacgaagggcctactagtagccggctcctctgacggcaactctttctcgatgttcctcgagtagattcacatcgtcgcttcgctgctcctcctgctcctcgtcggagtacttctgtactcgtgtgctctgatgtcgtagctccgtggggagcatagcctctgagccatacacgaggtagaagggtgtctccttattggatgttgtcggtgtggtacgcacggcccatagaacagagggatgttcttcgacccacttcttgtcgtgtgacatgagtctgtcgtagacgcgggtcttgatcccttgtagcactatgccgtttgcccttttgacttgcccattgctctaggggtgagaaatcgaggcaaagcaaatcttgactcccaatccaatgcagtaatcctggaagtcggcactgatgaactgggagccgttatttgttatgatgcggtgaggcaatccgtatctgtagaatatccctttcataaacttgatggcattatcggccttgatttcccccgtgggcgtcgcttcaatccacttggtgaacttgtcgatggccacgaacaggaacttgtagccgccctgtcctcgtgggaatggtccgagtatatcgagcccccaacacgagaacggccaagtaagagggatagtctggagcacttgcgatggcagtcttgtgtgtttgctatgaaattgataggcttcacaccgctgcaccatgtcgcaggcgtttttgagcgcggtcggccaaaaaaaacccttgtcaaaaagcttttcctaccaacgtccgtccgccggcgtgtgacccgcagatcccttcatgtatgtccaggaggagatgtttgccgtcgtcagacgagatgcatttgagaagtactccgtttggcgcctttttgtacagatcattgccgatcatacaaatagatcttggcttgtcgggttatcttctcagcttctgcatcgtcctcgggcaactcgtcgctactctggaactcggtgagtggggtccgccagtcgtctgtggtctcgatatcggcaacgacgtgttccgcttctgtagcccccgagctgatgtcggggacaaccgtgctaccgtcgtcgcttgcctctttcaccgatggctttgtcaggatgtccagaaaagtgccaggttcgagtggctctcgtcgggacgcgcgccgtgctaggtagggatgaaactggttcggatagtttccgtccgtccggaccaattttcggatacggcaaaattcggtcggaactatccagaatttctcagattcggaaacgaatacgcataatttttctcggatacgaaaacgaataccgtaagggtgatattcaacggaaacggaaaacgatcggaaactatccggtaatttttcccggatatccagagaccttcatcagccattcatcagaatcagcccaaagagcccaacccagcctaactatgtgtgttatgcaaaccctagctcgctagcaacacagccaacaggcaacaggcagccgagccagccgactactcctattcccccgagtccccgacccccacgcatctcggccggcggccgccgccaccgcccacaggcgcctcgccccttcgccgctgctgccaccgcctcaccccttcgccaccgctgcctcacccattcgccgccgccaccgcctcacccctttgccaccgccgccgcctcaccccttcgccacagtcgctgcctcttcgtcggcgtcattgcatcggccctcttcgttggcgtcgtcgcgtcggccctcttcgtcggtgtcgtcgcgtcggccctcttcgccggtgtcgtcgcgtcggccctcttcgccggtgtcgtcgcgtcggccctcttcgccggtgtcgtcgcgtcggccctcttccgcctcttcgctggcgtcgtcacatcgccgtatcaccgccactaccggtctgccgcatcatcgtctcgccataggcccgtaagcaggttcgtcggatccacattcattttttgtgctcctcattcactgagccagtgagccctatatcagagtttgagacatcgagttgtgctgttgtggtgctccttattcatttgtttttttctttttgcatgtgtggtagatctgtgaatctgtgatgaattcctctcatgcaagtagcagcagcttcagcttgtgcagtgcgtgtgtgacagtcatcttgtgcaagtaatgtgtgtgacagtgtgactttgtcagtacgtgcaagtttgtggatgtttctcgttatggtattattaattattgatctttgcaaatgtaacatgctctattagaaaaaataacaagttatatttcttcgttgatttgtgaaggtcagtttgaggggcttttatgttcggattaatattcgttaccgtattcgtttcgattcgtattcgctccgtatctgtattcgataatattcgattctgttttcgtatccgggtttccgattccgatttcgattccgagaaaaaaaaatatgaaaacgaatatgataaaggtagtttccgaccgtatccggtccgttttcatccctagtaggtcgtctagttcgatgttgttcttacggtatacgtgtcggaccttgatcccatcaaacctcttctctagcttcctgacttctgcgaggtacttagataactcggggctagagcacttgtagtctttgtgcacctggttcgcgactagttctgaatcccctttcacgattagtcgcttgactccaagtgtggctgttgcttttatcccagcaagtagtccttcgtactcggctgtgttgttggtcgccctgaagttgaggtgaattgcatgcttgaactgatctctcgatggtgatgtcaagatgaaccctgccccttctccttggctgttgagtgcgccgttgaacgccattgtccatgtctcgctgtccgtttgactgtctgacctgttctcaggcatagtccagtcgattacaacatcagtgaggacctgggacttaatagctgttcgtggcacaaagtggacatcaaactggcttagctcgactacccatttcgcaatgcggccgacaacgtctttgtttctcacgacttctccaagggggaaggaggaaacaactatgactatgtgggcttgaaagtagtggcgtagctttcttgatgtcataattactgcataaagcagcttttgatctgtgggtatcttgtcttcgcatcgtggagagcttcgctgacgtagtaaaccttctctctcttgacaacaatgacattactcacagaatatggcgtggcagcgatatagaggaataattcttcattaggttggggagcaacaagtacagagggatttgacaggtagcgcttgagcgcgatgaacgcatcttcggcttcctgtgtccacacaaatttgtcttgtttcttcagcaggacaaagaaaggttgtcctcgctctcccatcctagcgacgaacctgctcagtgccgccatgcatccagttagcttctggatttccttgagtcttgtggacgacttcatgttctcgatcgccttgatcttctcgggatttgcttcgatccctctttcggagacgaggaatccgaggagcttgcccgatggtactccgaatgtgcacttctctgggttgagcatgaggcgatatcgtcggaggttgtcgaacgtttcccggaggtcatcgatcaatgagtcgcttgtctttgtcttgacaacaatgtcgtcgacgtaggcctcgacattgtgtccgagctggtcattaagtgccccttgaaccgtgcgctggaaagtgtttcctgcggttattagtccaaacggcatcttgacatagcagaatacacagaacggcgtgatgaatgctgtcttctcctcgtcctcttttgccatgctgatctggtggtagccggagtaagcgtcaagaaagcttaacaactcacagctggccgttaagtccaccaattggtctattcgaggaagagggaagtgatccttgggacacgccttgttgagatcggtgaagtcgacacacatcctccacttcttgttggctttgcgcaccatgactgggttggctaaccactctgggtggagaacttatctgatgaagccagctttgagaagcttgtcgagttcttctcatatggcttgtttccgatccggtgcaaatcaccgcagtttttgttttactggtttggcatcgggtcgcaccatgagtttgtgctcgatcacctccctagggactcccggcatgtcggacggctgctaagcaaacacgtctgcattgtcgcagaggaaggtgatgagcgcgagttcctatttctcatccagtgacgccccgatcttgacggtcttgtcggggttggcactggagagcgggacgatcttgattgcaccgtctggcttcggcgtcttgttggttttgctcactttcttgggcggctcagctatggcaggtgggttgggagtgtgctcgaccatgtcgaggctccgcttgtcgcactgcaccgccagtttcgcgtttccctgaatagtgattgttcccttcggtctaggcatcttgagcacttgatacgcgtagtgagatacggccatgaacttcacaagtgcagtcctcccgatgatggcattatatgctgtgtcaaacttagcgaaatcaaaggtgtgaaagtgcattaattcccctagtggtttttggtgattaatgacaaatgtggttaagggtctaatgagtttattgagctactttcaggtgcattagtccaaggcgtggaagaagatgtcgtcacctagccgttatacatatacaactcgtttccagctcgttgttagcctctcccaagtgtttcttgccttctccactcaatctagagcctaattcttgtgagaaagagagattgagagggagagaagaagatttggagaggtgtgaagactaggaacttgggtgagcacttggaatatctcgtgggctgtcatctcggtgcttattactcttggagatgatctcctagacggttaggtgtcgcccgtgacaattcgttgcatattgtggatgtcccgggtaagtttgtgaaggatctcctctcctccgaaagggaacgaggtaagttaatgaagttcttatgctgagattctagaggttttccaagtagagcaacctacacttgtggtggatttctagaagtaggttgagttggatcttggtggtcactcaattctagaaatttgtctaggagtgtttggggttgaaggctgtggatttcctctggggtttttgcacatgtgaggcaaggggttaatcgagacccagctttttggagctcctcaacggagagtaggatcgcaagatccgaacttcgagaaaaaatcgctcttatctctttctgtgatatttctgtggatgattctgtgatctatcctctgcttaaaatacctgtgcaccttcttgtgaagattggcttagtctcctgttttgaaatttgaatttcatctctgttctgttaccaggaagttcctgtcctagaacaccggaagttccgggcctggctggccggaagttccggagttccttactaggaagttccgggtctatttgaattttaccgccgcgatttgtttttaagttttcagggacagcctattcaccgcccccctctaggcttcatcagcgcgttcaaggtgatctgttcggaagttgtttacttggccgaaagtcatgggtagcgtgatcttgcccaatggcttggacgacgactcaggagtgattccatgaaagggttgatcagtgggtgtcaactcgcttcgtgggatccccatcgcgtccaaggtgctagcgaagagtaagttgatggagctgccgccatcgatgagaacccgtgcgaccttgatatcctgaatagtgggctcaaccacgatcggatatcgccctggagtaacggcagtcttggggtggtctgcttctgagaactcgatcttctgctctgaccacttcatcttggacgcagccccctgccatgtcgaacaaacttcgcgctccactttcttgtactctcgctttgaggagtacgccgtggaacctccgaagatgtgcgaaacatggagaccggagtctgggtacgctgagtctgagtcctgagtagtcgcttcggcggccttctcgactacacgtactcgcttgcatttctccaacgccagttgcttcgtgagtgcctttttaagatgaaataagtctccagagagtgcttgtccgtcttgtatatagggcaccatattttcttcgtgtcgtcgccttgtgggtttgggtgcttgggcgggtcaacgtgttctgctatgagaacctccgtttgcgctttctgtttcccactcctgcgaatctttttcttgcttgactcaggcgtgtccttggctggtttcttctcctctcctgtcttcgacttgtcgttcttgcgtctcagagcgtcgtccgcgtgagcgcatcaattgacaatctcgaataacttgcaagcagttgtgatatgccttgttgccaattcctgggttgtgtagcgatctcggacgctagacttgaaaacgcggattacagaagcatcggtgatctcggggatcgtatttctgcactcattaaatggttgaatatagtccctcaatgattcgcccggattttgcgttagcgcgtgtaggtcgtccttgatcgcgtggcgcttgtatgttccttggaagttagcgacgaactgttgccacagatctgcccacgaagaaattgagtagggcgggaggtgaaccagccatgaacgtgcagatcccttcaacgcaaccggcaaataattcgtcaatgcgttgtcgtctgctccggcagcatagagtactgtagaatagacctgaagaaattcttcagggtcggtgcttccatcgtatttctctattgctcccggtcgaaacttctcaggccatcgaacatctcacaaagtacgagtgaaagccttgcacccaccgccaggggcagtaggttgtcggcgatcatatgctcatcgtggatgtctgtccgatgatgaagatgacgaagatgacaatgatgatgatgagtcacttggttccggggcgcgatttcgagtatgatgctcgggttcttgcaagcctcatcgtcgcccatagttgttgtcccggcgtcgatctccgtcgtcgtcattgtcacggcgtcgacctcaactggtatcgcgcggcacccgctgctcgcgtttagtatgttcgcggcggttgtggcgatcatcacggtctcggttctcgctcggacgtcctccttgttcttcgttctcgcgatgtcgtgaagagacacgatgttgggaacggttttcgttatcttgagtgagtcgcgcttctcggcggccatttagatggtcacggagatcactggtgccgcgaggtggaggggtagcttgacgaggtggcgtccactgatcaggctgttccccattagcgccgccggtcggcggttgttctggtggtgccctggcggcggcctctgcgaacgcgttattgaagttagccactgattcccgtagtcattctgcccattgatcaagatcagtgttcaggacgggatcgaaagggctttcgttcaatatcgcattgagggttctgatatgttgggccggtgtcggtgtaaccgattgatccgccgttcccgtgtggccgcctccagatgtgttggttccatcgatagcatacacgtcgcgtggtgtacttgtcgatgatgaggcctggacttcgagcagatgtaggacagatggctcatagggatcgatatcgattaccctgacgaatcgatctgatgtagtcgccgcaccttgttccttgtcctcatctctaggagagattcgtgaccgctggaccttagggggtgacgtcttaatggcgctgagaaggaccttgcagctggagaggtcgtgagtctttgccttgtggatgggacaatagacatcatgagttggagaagtacgttgaattccacgctctttgcaggcacggacttcagcttgtacgttgaggaaaaccgaacaagcttgcaaggtgtgcttgctagtcctgtggatgggacaccaagcttttgtcgccccggaagttgtccttgtcggctcgtacttcttgtgggaaggataagatttgaccacattaggatctttctcaggcttggatgttgtcgattctccgttctccacttctgcgggaggatcttttgacatggagtcaaccggggtcgtaaccacgccgttctcgctcccgataattgctgggccagtcgagattggcattgtggtgtagagcgggaagacgatttcgccgacttgagtccacaccagcatcgtcgaagttgaagctccttggttgatgccagtgttgacgctatcgtcgagaaggcttgaaatcataatagtagaaccttgagcaccaagttcccctacctgatgcgccactgtcgacaagggatacccgtagaccggatataaagggtattggggtccgttggtacgaggatcgacgtagtacgacatcaagcaaataaaagataaggattatactggttcaggctccttggtaggtaatagccctaatccatttgatatgagattatatgatggaaaccacaaattacaaagggaatagcagaactcgatgataccgacgagaccgtagtcaagttggtccgactagatctcccgacgacttggctcctgcacgctccggctccgtaggctatggtgggtgtattggcggtgatattcgatgtcttaggtcctacccagggggtcccttatataccgcgggtcagttgatctccaagtaggactcagagatatcgtacccctcacgatacagtaaagacccagtcttgtctgagtagaactccttccatccgtagataccatccctatcacgtgatagattttcttaatgtatacggaatctatccgtatacgcgcgggtataccgtatcagtgtacaacgcacatccaatgatagagggtataccttatccgtaaccctgatagtagctcccgacttctgcttaaatgagttcatgttaccgatcgcggcttctgatgtcggaattgttgtcactctcatctagtcgatctcgctttcaaaaatggattaatctgatttttttaagtaactttcgtatagaaattttttacaaaaaaatacaccgtttagcagtttgaaaagcgtgcgcgcggaagacgaggaggaggagttgggaacctgcccaaacgaacagagcattagagagttattctaatatgcaactctgcatggtagacaagttcatatataggagttgctgtgcataattaaatttgcataacgaaacaaacacagctggcaatggtggcatcatcactgacagtaagcaaatgcatgctgcagtttagcaccaagttagtgataaatcgagcttaattagcactagtgtgcgcatcttggtgcaccgaaaggttaggtcactgcagtcgcttgcttccccaaggagtgactgagtgagccagtgacccagtgacccacacgatatatgttggagtcggaccaaaacattcctccagatgtcggtgcttttatagagactcttctcccttttttttatcgcaccacaatttaattaacaacaataaatataattaatatgagtcttttatgacttatgaggtataaaaaaaaaactctgttgagtttttattagcttgataattctcatatctccctctccctatctctctccgaggggtaaaatttacaccgaacttagataatatctctctaaaatggaattaccagcatagtattaaaattaaaaaaacaattattatctaaacatttctaatcatctaaaatgtggtcaacttatcagataattactccctcaacctagcttgaaacagattattggccaaattataagtggattattaactacactattttagaaatagactaaatattttgataaataaatgtaactgatagcttctaagacatctaaataaaacagtggaaggaagttttataaggaaacatggaaaaaataatctgtgacaataatttggtgaagcaggtgaaaataataatgcaatataatgttgacataaacccaatgtttgactactcatcttattaaaaaatcagtgtaaatatgcaaaatatatgagtgataattttagtaataaaagaagtcacaaaaaaataatgtaaataatatttttaacattacaaatagtcaaatggcatgctaaaaatcaacagtaattacaatttttaaaaagaggtagtagcattatgagaaaatcccgtctccaaacaggcaaacatgggttggccacctctttgtcgaccagctagaatttcctttccgtaaaagccataaatcattataaactccgtggcttgcatctttgtgatatgatgcatctcttcttctttatccttttaaaaaaaagggcttagaaaagtttattaagcattattgtctggtatataggggcattcaaattatgtcttggtcagctgtattgtgttgaccacttcaccagaatgtgataaaataaacaatggacttgccaaaaaaaagtttgactggtccaaaataagtacggaatatttgatatataagggcattcaactgcgtacagaccaaacttccccaataaacaactcaaaaagatgcttatagtattagcaattgtctgctctctatgcattttgcagttatacttggtatttgcaattttgtattttgtcccccacttccccagaaattgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaataatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaaggcacaaaccgcgtctccctctccctctctccgcccatccatcctcctagagagggagcgcgcgcaaggaggaggaacaagggctcctcggatcgggaccagctgaggtgagcgctcgatcatctcccgttttctctcctcggatctgaccatctttcttgcctttgttttctttcttttttcttttcttcttcttcttttcccctacctgttcttggtcgatcggggatttcgctgccgtgaggctgacccttcttgtggtgcggtggtggcagtgggtaggatggctgcttgatccccttgattttagtattttattttatttttcagattagatgcgtagtgtagctcgtacctcgcattgcccgcccaatgcgtgttcttcgttttctttaatttggataatatatggcactgaatttatcaagtttaaaaaaatgtcatcgtattttgcttaactttgtcaccatcaagtacacctagaacgaaaatttccaaaattagacggaacattccgaaatatcgtattatagaagttgccctcgcgtatcttccccctttcccttggcgtaaaagaaaatctccggtgtcgtctcctccgctccttgttcccaagacgagtcgcggctgaacaggggaggggaggggatcctggtgagcatccacatcctctttctgattcatctctgtcccaccgggagtacttttgtctagaatttgcttgcgttccttctcttctagatctggaagaagctcttctcttgttaattttacagagagccttaaccttaataccagtaacagtttgtttgttcccccaaaaagtttggggattcaacgagttgtgagtttctggaattggagggacagaggattggcatgttgattcttggtccgagcatgtttaccaattggcaggaaccggcatgcggttcagcactgaactgtagcaggagatgagtttcttgcctggatctggagccatcatcagtgaagaaaaggaagatttcttcaagaattcaatcacaagtgaggtttatgcggttccactgttgacagggatagggataatgccgcatgatgggtcgttttcagtacagagtgcacactgatgaacgctgtgggttccattgttccacctatggaaattccacggtcgaggcagagagaaaatggctcatgtgtggtgactggtggttctgttccactatgttttttgttctgactttttcccctcatctgaagctcgtgttaaggtcatatatggtttggtagtcctaattgtcatgtattaatggccagatggattggtagagtagtatgtttgaatttcctatgttctaatagctgaatttgttaacttggacttagatgtagctacaaattatggcctagaacagctatatcattatttcccgacctgacagaggaatctagagcttggctgcagatttagttgaatagtgtgatagtatctctgtgttttttgttcattgcagtgatgtatttagtgtttcagtatgagctatcattgattacaaatttacaatataacatatttgaagcgtttggacaatgtgatgacgaggatatatttgacaaatttacaatatgctgatgtacttgtgtttcagtatgtgctggtaacagaaaaggcataatcctatcacttgttcactgccatgggagctgatatacaatgattttttcctattgatggaaaataatatgatgctccagatttatgttagaataagatgcttctctatttattaaaaaaatggaaatataactaggcaaagccatgtaatgaagaagatatggatgtttgtcaatattcatgcacattgtgtttgcataatgaaccaaaccatttttagaataatctcatttaacatatgttattgattggcaggtgcatgcttgaaaaatgtgaatgtgtgtaacattagtgtttttgtatgttttaggttggataggtattttaatgaaccattgtaatagtatgacaggtccatgccctttaatgtcatgtaatattcgtacagtagaggataattgtttgtttccagtattcagaagtgttgattcaactatttgtccattattaaaggtctactgtaatttagaagtggacttatttttgctttcttggtaaaaacttgaatgataatttccttgagtaagatcaagacgtatggagcttgctactgatgatatctagactaagacggtataatttagtaaaactgttactgttattattggcgatgtttcagtttagctttaggtaatcaacacatgtgcatatcatatttctttaagatgtatctcgccaagcataatttttcagtggcaacttgcaattgagttcttgttgagttgacctattaatttattatcgcgccatataggcatatgtgtgttgaattgaatgcttgaagccttgaagcatgttattttcataatgcaatctttctagctagtatgtactatgtagtactagtttgagaatatatgtgtttcctcatcttttttattttatttttctattggacaggatttgaacaagtcagcttgtcgccaccatggttcttgattcattatcatctcctcacaggaggtcacagaacacattttttctatcatccccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7872 - DNA, 835 bp, Oryza sativa
gaccaaaataaaagttgtacatcttgatgagaggatcaactttgttgttgaccatatttccatttgaaatcattttgtatttacaaatgctgtttagatttatcatatattcaaattcaatttcaaattgttgggaaaaaagttatatagaaaaatgaccaaaataaaacttgtacatcttgaaaggctctacaactttgttgttgaccatatttccatttgaaatcatttatctgaaaatgtatcatgactaataaaatgaattattacacaacagctatatattttgcacttacaaatacaaatacttcaaatgaaaaaatagaaaaaatagtcatcggtgatgggccttggttatagcccgatagagattaatctatctcaaaggccaccactctcttattccagctaaccaccttgcaacagtaccttagcatttcatattaattatcttgcatgatgatttattttctcacattcttgttccaacgtctaatcccgcttcgtatcaactttacgagggtgctttgcagcctagaccttttcttacctttcattgacacctttaaagtatgagctactttcacaatttttactgtccaatcaattttattgtgcatgtttacctgactcaaccttttgtaaccatttcacgaaaggtgcattgcacatcccaatgtctctgcagtaaactatcgtccattgggttctgtatgttgcctatctttttaatatattactgataactttcttgaaaccctttcctttgttgacatctttcatctgatacatgaacaagctgaacagggtttcttttttatctgggaaacaatac

SEQ ID NO: 7873 - DNA, 245 bp, Oryza sativa
gcgacgcagcagccgccgttgggcgcggcgcggacagccgtcccgtcgcccgcggcgttccctgccatggacgccgccagatgcagctggtccccgtcgaacggcccccaccgtgcctcgcggaagcggtcgaggaggccgtaagagagcgaggtagagcgcctcgcgccccccggcaaaaccttcgcgttgctgtcgaagaagaacagagaaagagagattgacaagtgggccatggacaaact

SEQ ID NO: 7874 - DNA, 704 bp, Oryza sativa
atcaagcttctttattgcagatttctgcccatcactaagctctccaaagaaaactctggcgtctgggccctctcctattagggcatcattactgaagttgctagttatcttctccaatatgttcaggggaatgatcgatacaatagttggtggagttttgacaaacttcttggtaaggggaggggctacatgttggtttggtttgttgtcaccactagctgtattggagaaaccaaaagaataaaatccaatagattaagttaattgctgcttacaaaattcgtattttgttagttgtactccatccagtaaaagatacttgacatttgaaaattgaccttttttaatgtctttaaagtgcatctcttaacaataattttatgctacctccctttctgaagagtgcctttttagctataaacatggacaacacagtctaggttcatagctaaaaagaaatttttttaggaatggaggtagtaaaatacaagtttatgagattatggaagtacctttctggacaaccagacaaatctacacatgtcattttaatgtttttaaaataaaacttttaaacatcaaagttttaaaattttgactggatcgtatctaaaacgtccaagtatttgtggctagagggagtgctacttaagtacttagcacaataatatttatatttttgcaaacaaggtgcacatttaaat

SEQ ID NO: 7875 - DNA, 1477 bp, Oryza sativa
agatttattgtagtagaaaaaagtctcatccaataatagattgtttttttagaatgaagggagtatagatgtgatatcattgttataggatatatcacatctatacaaaattgcgctcctacttatattgggatggatgtactccctacattcagctagaactggatatatgggtctcacatattctattcttgtaaatctggacacgtatagcaacttgtactgaatatgaatatctagtcttacgagtctcaggttgctatctcttggatggaaagagcagtactttctatgtttcatattttaggacattttggcttttttctaattaattttgttttaagtttagtcaagtttataatataaatatagcgatgtttttaacaaaaataaaatatattatcaaaacatatttaatattaattaaactaattttgtgttatatatgttgccaactttttatataaatttggttaaaactttttaaaaaattgaatatggaaaagtcaaagtgacaatagagtgaggtactccacaataaacgtgtggtaccatttccattatcaaatatcagtgagtacaatttatctctccaattcagttaaaagtaacctctagcacattactagttttttaggtgttctttagtcatgacacatctttgtgatgtctatagtaaattacataaaatttaagtgttttatagcaaatttgctagttgcatggatatatgtaattcatttaattatatataggccttgtttagttcgcgaaaagaaaattttttggtgtcatatcggatgtttgaccggatgttggaaggggttttcggacatgaatgaaaaaactaattttataactcacctggaaaccgcgagacgaatttattaagcctaattaatccgtcattaccatatataggttactgtagcacttatagctaatcatggactaattagactcaaaagattcgcctcgcgattttccctctaactgtgtaattagtcttttattttatctatatttaatgctccatgcatctgtccaaagattcggtgtgatgtttttaggaaaaaaatttggagaactaaacaaggccatagttgtaaagaggtgttttcaacagagtagttaggctgtgtttagttccacgctaaaattaaaagtttgaagaaattggaacgatatgatggaaaagttagaagtttgtgtgtagacaagttcaatgtgatgaaaaagttaaaagtttgaaaagaaaagttagaatctaaacatggccttagcaaactggtccgtttggatttttcttttcctcgtacagtctgcattctcactcgtcaacgtttcggtcagaccaacccaccaatgttaggccacagttcgcatgctactagctgtctagctgacacgaatggaggctaacgaacacggagtaataagtttacatgaccttctagggagttttgccgcccccccc

SEQ ID NO: 7876 - DNA, 10126 bp, Oryza sativa
tgctttgctgttttacactaaaccgttgtaagtatgtagtactgtgtatatactgctgctggttcaattcatatggtaattaaggaagataattaggtttaatctaatgagacatggttgcatcagtcggtggagccgggtagccaccccccccccccccaaaaaaagtttccaactagtcttttttagctctttaacacgtttttaaaattgctaagtagtgtgtttcatgtaagagtctcactctcttatttatcgcgcacgctttctaaactactaaatgatgtattttttaaaaaaaattatatcaaaaagttgctgtagaaaatcatattaattcattttttaagtttttaggtaatacttaattaaccatatcttaatatgttgcctgttttatacgcagcgaagagattcgtaacccctaaaaaaacacatcctaatgaattaggtggtgtttagatctagggacttaactttagtctatatatttagacactaatttagattattaaatatagactacttataaaactaattacataaatgaaaactaattcacgagacaaattttttaagcctaattaatccataattagagaatgtttactgtagtatcacataggctaatcatggattaattagactcaatatattcttctcgcgaattagtccaagattatggatgggttttattaatagtctatgtttaatatttataattagtgtacaaacatccgatgtgataggaacttaaaagttttagtcccatctaaacagggtcttactccaatataatagaagggtagccctacccacttggttcaagaaggttggccccaggccatccgaccttgaacttgactgattgggatgtcatggcccacggtgggggaaaaaagtttgatcagcttttgcattcttcgaaattgttttttttttatattttttctctattgtttgagagttgagactagttcaagctaatgagccgagccacgctagagcgaaaatcaactttccttcaaaattaaattatttttatgttgaaagaaaaattacagatcaatcgtctagctgcacaagtgcacatcctagggcggtggaggcgtagagctcactgagaatagacgattcacaaaccatcccaatcttgaagtagtacttcctccgtttcatattataagtcattttatttttttaaaaaaattaaatgatgattaagtttgttgaaaaatataacaatatttttaatacaaaacaaatatattattaaaatatattcaatgttagaattagtggaactaatttggtgttttggatgttgctaaatttttctataaatttgatcaaacctaacaaaatttgatttgaaaaaattttttgaacgactcgcacaagacggtgcgaagttctattgatagagcaggaaaaaattacaagattacaacccaggagggttgtaaccaggaaaaaggaaaaaactataccaccacccacacgccgacatcgctaacacacaagcccaggagaaggctaacaccggaccggccgccgctaagcgtgaccgaccgccactagaccaacaaaggaacacagacgagaacgccccctagggaaatccacgtttgaggcaccgatgctccaccaccacacaagctttgccgacatgtgagacccctgcaccggcgtcccccgctggccagccttcgtgcgccgaagaccaccacacccaccggcagctcctcctcacacctaggtcgcctcctccaccgccgaccgcgcctttttgccccaagccagcctcctccaccggacgcgcctctcgagccgatccggcctccctccatcggctgcgcctctcgcgccaagccggcctcagctgccatcggctgcgcttctctgcaccaagccggtctccgacccctccaccaaacgatgccgcgccgaccagatgcagccgtctcccacgccctcggctagttgatttgaaaaaatgacgacttataatatggagatggactatctaagaaattaagaagcacagacagacaaacaggggcggagataaagatgggcaccttgggctttggccgtagacttgcctcaaaattgtactgaaatcttatcaaaatatactgaaaattgaagtgtctaggattaaatacattactctgccctaggggttgcaaatctctggctctgcccctgaggccctgaccggcaagatgttcatccccctcttttggctacttttcatctggtttgaattgtaccaatttttaatactcttttctttagtttaatcaaatggagaaaagttgctttattctttggtttcttttatatgctagatgtgcttcacctaattaaagctagttaattatcatgcataaccgcacagatggctccacttttttctctacactggcactaatactttgccctaaacaagcatcaatgattaatactggcatttgtgctcccagttgtacttaatcatacagatcaaaagccagcttagggtactctcctctctgaatcaaaactacatgttgagctgatttgagttgtcccaggtatatacctgctcaaatactctaaaataatgtataataatatgctgatacagctagctagcgaatccatgtcttgtgattagtagtaatgttttaaagatagtatcttaattttcaatcatcaggctgcttcatccatatatattgagcaagatatcaacacggctagccatcggttgtcactgagcagatgaaacaccccgtttcttgcatgaatattgaactaattcctgtgaaattctctgtttgcaaacagggcttgttattttcatggccaaggaacaagatcagctcatcaaggtatgtaccgtaacagagcaaagctacctgataatacattttaaaaacgcttacctagtaataataagcatcaaattgattttcatgtaatcttatgaagttactgttgacttgttcatgcagagagttgagctgaaggtgagtgtcaactgctgcgacggatgccggagcaaggtgctcaaagccctcaaccttaaaggtactaccttcgtttcagattacaagacgttttaactttgatcaaagtcaatatgcttcaattttaactaagtttatataataataataataatattttaaaccaaagacaaatttattatgaaaatatattcaattatcgatttaataaaactaatttggtattataaatattactatatttgtttataaacttagttaaatttaaagtagtttgattttaatcaaagttacaacgttttataagccgaaacggaggaagtatctatcaaatggcattaactgtcttctcggccattgatcttggctgccatggttgattcttgaagctttgtgtttttgacgctttaattgtgggtgatggcatgcatgcaggcgtgctgaggacggaggtccacccgacggccggcagggtggcggtcgtcggcgacgtggacgccggtcgcctcgtcaagaggctcgccaaggtcggcaagatcgccgaggtgatcgtcgtcgcgcagccgtcgccggaggtggagaggaggaggcgcgacgtcggcggcagcaagaaggaggcgtcgccggacaacgggaagatgggcggcggcacggcgccgaaacacggcggcgccgacgacgacaagcgcggcgagacgaatggcggcgcagggagcggggctagctcagctcgaatccatggcggtggcgacgacgacgtgaaggcggccatgtgctgctaccaccgggcggagccgccggccatggccgtgcccgtgctgcagccaccgtactatgcggcgaacttcacaatgccgccgccgcagccgccggcggcggcgtacggttttggtggctgctaccacgggactccttcgccggcgatggcgctgtgccgccgcggccgtattccggtggtccggccgcagccgacccggttcgccgacgagtgctgcatgtacggcgacgacgacatcgccggctgccacgtcatgtgaagatcaccagtgtgcatcgaattttttttttctttaatcttctttctggttctactaatggagaacactagcctaattttatttatttaattgttttttttatgaattttcagcaaaaactaaaagtcttaatgtataccatcgaaaaaagtaattagtgttacagatccagctcttagtctctcaaatactaatgtccagttttggtctggacgaggagctagtgcatcgaaactttttctttaattctttgtcgttcttctactaatggagaacactagcctaatttaattaatttattttttttatgtattttctgcccaaaataaagtatttctgtataccatcggaaaagtaattagttacaatacagatccagctctaaatctctcaaatactatgaacttaatcataattgttagacttgttttacaatatatcttaccatcttaataacctacagtgatcaaaaaaccctttcagaaggtactgaaactacaaagcaaagaaaggtgcaacagctcaataaccaaatcactttcgatagaggcatcagttttcatttggtgataatacagtaacttggaagtcttggaaacaaactttcgcatatgccacagaaacaatgtgatgacccatgtatttttaccaaattgatcataccaatagtccaatactggtaggatagagaaatacaaagatgtacatatgtgtaactagctgtctgatattatttgaaatagcttcaagttatgatcataagaacagacaactttgtgatctcacaagacagttccactgggaaattgttacatcaacctttacatatcacaggagataaaatgacattttaagatgaagcagcagtagcttcaacaggtgcaggctcagcatcccagaacgaggtcttcttgcccgtctttgaaacggtctgaagaacggcatctggtgtaacatttcccttgacagtgaccttctgctccttgatgtctacgtcaaaggactccactcctgaagcaaccacaagtccaactcagatgtttagatcgatgcgctaaatattgcagtgacacttacaagaatacatatgcaagtataaataatcatttgtgcttccatgatctaatgcagaatattggaagtcattagggctgattgcagaggttgggtttgaaagatagccttagcattattcaagcaactgccttggaccaaaatgtgccaaagatgaagcacatgtagttttcctttttaccaaccattctttcaatttgattaaaaattaattgaatttataaatagcatgcaggagagaaattcgaaattatatgtttgcccactatactctatagttgtggataatttcaaatagcaatcattaacaacagagctcaaaattttatttataataccagcaaaacaagcaaatacagctataaattctcatttgaatactaaagttgttgcctaacttgtttgcgtctgcactccggataccttaatttccttttgtctatggacattgccacttacacaagtggtgagtgtcatggtagtgacagaaaggtacataattgccaaagtatgagtccaaaatacaatcgaaagcaatattacaaaacaatatctttatgcctagaaatcagacgcaggtacaatttgaaactagaaattgcacaagatttcacccaatcaaaattatccagtgttcgtcaaaagcatacagttaagggaatttttaaagaggagataccaattgcagagatataccaggattggttcagattcagcattggcataagttaagtccaatgttgcattgcacgcgttacattgtaaaaattgctcgcaaaaaggaaaaagttctcaacaaacagaacgctgaggacagagctaaactaaccttgcatctttcccagtacccgcttaacagctccaacacaaccttcacaggacatcccaaccctgagcacaacagtctgcacaatagacaaaaatagcaaggatcagctaagtcctcattcgtcctcaatcacatcttcgcacacgccacatggtactcggaatacatcataattcccaatcaagatttactgtaaccgacaacaattaaatgaatttatgcttcattctggaagggaactagtaataatcagatggggacaatcatgctctatcattgaactcacagaccataaccaacaagatggctcatttaaggtaggtacaacaactatccaatcgggcctactccgcaatctgtactcgtttcaacaagaacgtacacaaatcaaaatcatcaagctagtttcgacccccaccatgaagttctaaaacttgtccatcagttggtgtttgaactactgaaactctgaaaggtataccgccctcctagcaagatttcgcccaaaacatcatccccaagtcataccctggcctgcaagcacgatgaaggaaagccaagacaagcacgcgcaagaacaagcaagctgatcgatcagcgcgccggccaatcatcagatcataatcagatccctaattaaccccacacgcaagctaaaagaacacgcttcttcccccatattcaaacaactcgacgccaaaaaaaaaaaagaggaatcctcctctcttggcctccccatctacccctatcgatcaaccctctcctctctctctctctctctctctctctctctctctctctctctctctctctcttctctctccaggaccgcaggaagggaccgcgcccctaacaccaaacgaataaacaaggagttctgtcgcggggccgtacctcagccatggcggtcgacgcggcggcgaggcgaggcggagaaggcggcgagcggtggtggggggaactccggtggcgtctcgtctccgggcgggttgggcgggggctaaataggtaaatagacggaggcaaggcggtggcgtcgttgaacgggcgagaggaaggtgagaggagaggtgacgacgtgctttgatttttttttctttttttcttttcgaacgtgggatgacctggtctgcgcgtatgacatgtggggccacgggtgacgtgtgggtaggtgatgaggaggaggaggaggaggggggctggttctagattttccttttctttactgtacggtgctgacttagccggtcaacgcgacgaacggctccggggacgtcgtgattcgtgccgtccgtcaccgcgttgcccgccccacgtcggcccgctgccgctccaaaatactccctccctccaccaaaacaagaaggatcaacccctccaaattgatgtgtccacgtgcatggtcctagccctaggagaggtcacatctgtgtttcctcctaggttgattcttcttggacagaggaagtaggcttgttgtcgaaatctaaacttaaaaacttaatttatagctaattttaatggtttttagtagctttttcaatattggtttttaagtcgctaaagtaaatatgtaaaaattttacttataaattattattttttcactaatacttctttcgtcccgaaaaaccgaatctagtactggatgtgacatatatctagatttgttgtactaggatgccggtgctagattggttttttatgggacagggggagtatgttgttatggttaaatagtcggttgtagggcaaccaataagaactcaaatggtgaatagtctggcaggaagagtagaaagtcctactccgtgtgatcctaacatatttagaattttagctaaaatttgattgtattttgtaagatggaaacaaccatatttatccctctcaaatatgttctaatttgtagcactcttaaatatattaaaattcgtagctagaattttttttcgaagaattagtttttactttctgcttccttgatatggctgccactatttttcaccccaccgcaattttggacagctagtaatttttaaaccatcgacaaaatgccaaacttcttgaacgataaagccaatgccaggtgccagcatgtgaaagtgaacggaggtagtactaacatataaatgattccttttacaactaattttaggcagaaaacatgaaccagtacgaaaagcacgagccgtgtcaacaacccgtgataaccaaccaggcaaagccagcctttgctctttgccatctatgcagttccagaatgatgaacaaacaattgcccaagttgcgaaaatgcaagcataattcaaatgaaatgagatttgacctctcatcagtagacaagagatgcaatgccatacaatcaactacaccatgacatgacaaaacggaatgtttcaagtatcacaggagatcagcttctgactgcataaatttctcaagtctaaatcaccattctagataaagggggagcattagaaattgtacagaacaagcaggactccctacaacggatacacattcatatatacgttgctgagtacaagaaggattgctagttccacattcagtcaatgaatgttgttctgttcatacatctctccatatttaggtgtattaaactcccgtttttgtcaaaactccaaccagtttacagaagtactcccaagtcctaccaccaaagtgttatgagctcctgtgagataacaattcacattgtcagataataatacagaaagaaaaatggtctgaacccttgtagaatcaaagacatatgcccaacatagttgatttatcacataacataaaccttcggatttgctatttcactggcagcttcaatttgacttggcattagcctctccagtttcatttttttttctctgaaggaataagccaggttatacacctagcccaaacatttaggtccatttgagcaaaataaaggtatgaaagaggcgagggaccaagcataattatatgcgccctggttatctagcgctttcaaaattgggggtggaattatgtggctaaagcttttttccttttctaacagaaaaattccagtgactaccatcccatcaggccatcacttctcaaccctagtcagctatctcatgaccaagtttctactgaaatggtattaagtctcttaggggactcgattcgattacagcaaaccagaacactaatccacaaataacaatagcatattgaacaatgcaccagtggtggtggagggtggtggctgttgtcaatagagatgattctggtggttttcacacgcttatttgccaaacaacagaattattatttaatacaaagcaagcaccgaggatcttaacatccactttaacaagttaacagtattccgaatacaagtgaagaagcttgattgattatccagtaaggaagcacttcaaaaggtaaaaccataaaagatcccccacataaacaatatcttaattaacaaaataaaatggattacgattgttgcaactaggttagcatttcagctcagtcaaatatttccttatactctatacagatcagcaagtgctcatggattgaatattacggtcttggactgtgtaggatatcaaatcaaaagaccaaaccgataacaataatgacagcaagtatggaattcttacccaccaaaagaagcagcaagcagatcggttatgcttagctcatcctaatccgccatgctggaatcaccaccatcaggagcatcaatttcatcttcgttcttcaggttcccacagacattgcactcaaacacatgggacggctcaccgtttggcaagggcggaagtggcgcaagcatgccatagcattcaccatggttacacagataccttacaaagaagtatgagtgcgggaaatcatcatcgctatcgctaccaccataccccttcttctgctccatcccatcatcaccaccttctccaccattaccatcctcttcctcctcttccgatggtgtcatcctcatcgccgccatcgctatcatcatcttgcttccacttgctctccacctgacaccgctcacactcgcatcggaacccatagtcctccagcaacctctgctgccgatccttgtactgccaattggccgcgaagtagctgaggcacacctccctcccctcggtgatgtcgtgaag

SEQ ID NO: 7877 - DNA, 3806 bp, Oryza sativa
gaggtccggcgagaaccctggcggaagcatctgcggcggcaccagcgccgccaccatggcgtgcaggctccccgggtcctggtcgctcgggggcggcgttgcggcggaggagagggagaggagcacgcggagggagggctccgggagggagtaggcggagagaaggaagaggagcggctcctggtgcggctcggcggcggacgcgaggtttccgttgccaccgccgccggagagcgcggtgcagaggaggcgcgggtgggaggcggcggcgcaggacggggagcagaatcccgcggcgcggcaggaggggcagggggatgcggcggcggagagggagcggaagcaggcggagcagaaggaggggagggaggcgagcgaggccgggtagaggagcagcggctgctcggtgaggatgacctccccctcccggatgctgcgcgccgcgaggagcccgcgtcctcggccggggagatcggccgcacgcagcgcgtcgccggccatggcggagcagagcttcttcctcggcggcggcggcggcggcggtgggagaagtgggggtttttttggggttaaccgtttgcttgtaagaataaataaatgggccgaagattaagtgggccttgtgatgtatgtgggccggaattaggggcccatgtttataaatggaataagttcacatgaggtctctcaacttaacagcgagattttataaggtcccttaaccacaaactaaaaatgtgtaccctaaactcactcaaaccgtgcactcaaggtcctatggcagtatatatataggtggtttcgctgacgtggagaaaaggagaggaggcggccgacgcgacggcggcggcgggacaggaggtggttggcgcggcggcgggagagagagagagagagccggccggcgcgacgacgacggcgggagaaaaggacggcggaggccgagttggttgcggaggtgagctcaagctccgcgtcttggagcgccgtgaagtcgtcgctgccgcttcgacgctcgagaagagaagagaaggagaagaaaaaatatgcagctgatatgtgggccccacatacttttttttggctgactaggatgccacgtcagtgaaatcacccatatatactgccataggatcttgagtgcacggtttaagtgagtttaagggcacacatttatggttttgtagtgaagggttcttaaaaaaatctcgctgttaagttgagggacctccggtgaacttatttctttacaaatcaagggagaaattatgagtgggcatttaatgggcttggattggaatcatgggcccaagttggaataattaagcgagaaattacgaggtgatttataatttgggagttgacaaatggaagcgaggaagcgcaatagggcacgggcatcggatgtgtttcgtgcacgcaacattccaatccatggtgaccattattcttcttcttcagattcacaaaaatgagatcccgtgaccgtgatcaactgatcattacgtgcagaactagctatattttattttcttggcgaattttttttattcgctcaatcgctctcataggagagagattttcgtacaagaaaagaactttcataatgttcgaaatactatttttggtttttaatagatggtcgtggttggctttttaatactaacgttcaataatgtatcttattaaaaaatacataattattatttatttagttatgtcttgatttaattattaaagaaactctaagcataatctctaagcacaatacattttctcatatttacataaaattttaaaataaaataaattgtaaaacatgtattaaaaaaataaatgacatcatgtaccctctttgatttatattataaattgtttcgactttttcctaattaaattttcttttagatttgataaaaaaattactatcatctaaaacaacaaattgtttcattaaactatcagttaatatattttgatattgtttattttgtgttgataatattattttattttatataaacttagtgaaacttaaaatatgttaacaaaaaaaattaaatataatttttaatataaaacagagggagtattcaaaaccagaggagtataacttaaattcctcactacttaaaataacttaatctactcagtgtactaggcctcatttgttgcccatattttctgataagctaaaatggtttgttaggaaataaaaaataatttataggtaaaacttttatatatttgtttataacaatcaaagaatcaagttagaaaatttaaattttaacttttattttggcttattaaatcaatcgatgaggctcctaggctacatggattaaatttaatagcctagttatccactatatcaaattgtcatgtactagcattactgtacactaagcagcccaacgacccgcaacatctcgtgcaccatgtgcagatttctctgcttatcacgcatgccattaaagattaaactatctgtgtcaatgctatgctacagtgacaccagctgctgtcagtgagacgaagaatcgaacagttggtttttgttaaccaacttcgaattaaaagccacatgcgagaggaatcatctgcaatagcggcgaatcagtggtgcaatgcatgtcactgtacgcctgattttggtgtcctttagtatctttttctctttaattcttttttggagactgatagggagtcttctcccatctctgttatttagtaccagaaatgcaaagcagtgaattgagtattaccggttacgaacttgagaaatgatatatttaattttttaaaaaagtttctatataaaaagctcttttaaaaaaataatgttgttttgcatttccgaaacgggattgctatatagcattcgaatgaaatttgggatgaaatcttacagattttgaaccattggatccataccaagactcgtgcattgacttctctcctccaactccggcgggctcctcttcttctccggcgctggcgacaccccaactccggtgggttagggtttggggttagggtgagggtagaaggagggttgggggagggagaagaggggggtttcctcgggacttagagggatggccgtgggcagcgaaggactggcagtgggcggtggactccggcgggcggcgaggcggcggcggcgccgcagaagccgccgggatggaggagggcggtgggccggcgtcggcagcgggggcaaagcaagcgtaagattaggagacggcggccggtggtggtggatccggtggccgggagccaccggagacggggaagacggcggggcaagggcacctcgtcgtcgccgccatgaggagaaagagaggggagggggggctcaccggcgccgttgactctttccggccagccggcgaggcgggcggcggcgcggtggggcggtggcggcggtgacggtggtggcggcgtgagaggacgggaggaggagtggaagcggcaactgaaatgggaggaggaggagtagggttaaggggctgcatgaatcttaaagcatatccaatggtccaaaatttgaatgataggaggtgggattttctatcacatgatatatagacagcccctttcggaaaacgtagggagaagctgatttaagctcagcctgagtcgaggagatggccaagaaatcgcattctcgatttcgatctgatatttcaatatcctataaggatgtataaaagcactacattggttgaaagaaatatgagtaggagaaaactatcctggtcccctttaacatttaatcacacgaattttatattcaagta

SEQ ID NO: 7878 - DNA, 8772 bp, Oryza sativa
  unsure (1)..(8772): unsure at all n locations
tgagagggcaagtccaacccctatataagggacaaggccggttcattgtaaagatcaatctacaatcaatcaatcgaatcgttcttttcatattgctttcagttttctcttagtttgtccatctttgtcggtttgcgccgtaaaccgtacgccaccgctgcgagtgtgcgacacctctttgtaggtttgtcctgaaaaccttccgttttgcccacgagacgggtagttatctagaaatcagctccgctagccggtttagttatcaaaacccatctaggtttagctctttgctagatcgaggtggctggcgactctaggatcaccgcaagacttaaggtgatacgatcgtgcttgtcaacttgtcaaaaaagttgccaacacgatttttggcgactccgctggggaggagatccgttcatcgtcaactcaacttcgacttcgccatgacgaagccgccatccaagacggaggtggagccatctaatgtgatgctggtcacattggatggcttcgaaggagaagatcgtaaagctatggaggagtacatcaacgagctcacatgggaggcgttgatgagagcaactactaggactcgtcaaggcgtgatcatcaagcccgggccacatcccaagcttgctcccgacgtggtaagtaatgacgaggtatcacaatctatccaacaacaaattgcatctacaatagattcatctatggctaattttaaagatcgattaaatgtaatgtttaaggataaagttgatgggtttttaaggagtaggctcggttcttttatggatgattacacattaaaagataaagcctataccactgctgatcaacctcctataggtcaaacgggtagtaaaaccgacggaacggcgttcacggccggtccgaccgggcctgacagtcggtcagaccgcgacacaaccgtcggtccgaccggccaaatgaccggtcaaaccgggtattatcccatcggtccgaccggccagatggccggtcagaccgggtattatcccaccggtcagaccggccctcaggccggtccgaccgcgcaacatgacgccggtcagaccgggccctgggccaatcagaccagtgcaatcgtcccgatacagggaattgatccaatgattaatgctagttatttgtatcactttagaacatttgatcctcctgtatctactgccaccactagtcctcaaattcccccacatattcctaacatttataatgatgtttctaggggatatcctcccgatactaggcaaggccaatataatcatattgcgccacaaacgcaacctattaggccaccaaacccaccaccaaatccacaagggcctaataacatggaggatatgattagtgatattatgaggaatagattcgggatcgaaactaggaatcgtgctagagcttacaaaaagccatatccccattattatgacaatgtgctgtttcctagaaattatagagttcccgaatttgccaagtttagtggtgaggatggtaagaccacatgggaacatgtaggtcaatttttagcgcaatgtggtgaggctaatagtgatacttttaaattgcgcttgttttatttatctttatccggtaatgcttttacatggtttacttctttactggcaaattctattcatacttgggctcaattagaagaacaatttcatgattatttctatactggagaaactgagcttaggttatgtgatttaacatcggttaagcaaaagtataatgaatctgttgttgattatattaagagatttagagatgttacaaaccgatgttatactttgaatataactgatagagatttggccggacttgcttttaatggtttagttgctcctcttagagaaaaactagatggccaacaatttcttgatgttagtcaactcatgcaaagggctctggctcaagaaagccgggttaaggataataaaaaatttgatagaccattcgacaaaaagcctaatgtcaatatagttgattactctgatgctagtgatagtgaggaggagggtgatcatgatatttatgttgccgagtggtcatggactaacaaaaataaaccttttgtttggtctaacctaatgccaactctcgcaaagatcggcagagtgagggtaaatatagttttgatgtggccaagtgtgataaaatttttgattatcttttgcaagagaaataaacctatctctgtaaagccggctagtgtagcacggctaagccatataagtttgtataatgagtaaagaggctagtttagagttgttacaaaagagggtgcaagaatatcggtctacaaagaacaatattggagaaaccgttgaagattttgatgaagtagagaagcttggacaagggtttacatcggccgatccattagaagaagtagatataggtgatggaactaaaccaaggccgacttttgtaaacaaaaacatgaaagccgattataaggttaaggtaatcgagctacttaaagagtatgttgattgctttgcgtgggagtaccatgagatgccgggtcttagccgtgagcttgttgagcatcggcttccaattaaaccgggttttaggccttataaacaaccacctcgtcattttaaccctttactatatgaccgagtcaaagaggaaattgatcggttgttgaaagcggggtttattaggccatgtcgttatgcggagtgggtttctagcatagtcccggtggagaagaaggggagtggtaagattagagtttgcatagattttagagatttaaataaagccactcctaaagatgagtatcctatgcctatagccgacatgatgattaatgatgcctcgggtcataaggtgattagctttttagatggtaatgccggctacaatcaaatctttatgacggaagaggatatgtacaagacggcttttaggtgcccgaggtttgttggtttatttgagtgggttgtcatgacctttggtttgaagaatgccggtgcaacgtatcaaagggcaatgaatttgatcttccatgatttgctaggtattatcttagagatctacattgatgatattgttgtcaaatcggatgatatggaaggacatatagctgatttgagattagcttttgagaggatgcgccggtatggtttgaagatgaacccacttaaatgtgcttttggtgtgtcagcggggaagttcttaggattcatggtgcatgagagaggagttgagattgatcctaagaagatagaaaaaattcgtgatttcaaagcgccgacatgcaagaggttcaaaagttgctaggtaaagtgaattattcgaggaggtttatttctaacctagcgggtaaaatcgatgcttttgttcctatacttcgcttaaaaaaagaagccgattttacttggggggcaaaacaacaagaggcgttagaagagttgaagaggtatttatctactccacccgttgtgcgagcgcctaaagccggaaagccttttcggttatatattgcctccgaagacaaagtcattggtgccgttttgacgcaagaggaagatggcaaggaatatatcattacatatttgagccgccgtcttttggatgccgaaacgaggtatgtttttatagagagactttgtctatgcttatactatgcttgtaccaaattgaggcattatttgttatctagtacatgcatagttacttgtcaagccgatgttattaaacacatgttgcaaaggccaattctaagtgggagaattggcaagtgggcatatgctttgatagaatatgatttgacttatgaaccattgaaaactataaaaggccaaattgtatgtgattttatagtagaccatcatatagatgttgcttatgagggagaggtttgcttagttgaagtcataccatggaagatttattttgatggttcttcttgcaaagaaggtcaaggcataggggtagttttgttttcgcctaatggcatgtgttatgaggcatcggttcgtttggaatattattgcacaaataatcaagccgaatacaatgctttattgttcggcttacaagttatggagatggttggagctaaatatgtggaggcctttggtgattcggaattggtggtgcaacaagtcgccgggatctacaaatgcttggatggatcactaaataggtacctcgattcatgtttagatattattgccaattttgataattttgctattagacatattgctaggcgtgataattctagagcaaatgacttggcatagcaagcatctggatataatgtgaagaagggattatttatgatattagaagagccggtgcttgattttaaatctttgtgcgaaattggcaaaattggagaccaggggcggtctgaccggcattgcacggccggtctgaccggtgaccaggggcggtctgaccggccgcatgccgtcggtctgaccggcgaccccgagcagtctgaccggctctgtgtggccggtctgaccggtattgagcagagcgctggggggcacgcttcaatcgatttggaggccgaattatgtgagaattcggacatttgtgcccaggatatagaagaggattggagaattcctttgattcaatatctaaaagatcccacacttaaggttgatcggaaaattcggcggcaagcattcaaatatacattgcttgatggagatttgtatcgccgaaacatagatggtgtcttgttgaagtgcttagatgaagatcaatctaaagtggctatgggagaggtgcatgaaggaatttgtggaactcatcaatcggcccacaagatgaattggttgcttagaagagcggggttctattggccgaggatgattgatgattgcttcaaatattataggggatgcgaggcttgtcaacggttcggcaatgttcaattggcgcccgccgccgtgttgaaccctataatcgaaccatggccgttccgaggatgagctttgaatttcatcggtcaaatttatccttcgtcatcaaaagggcataggttcgtgctagttgctacggattacttcaccaagtgggccgaagccgtgcctttgaagaatatgactcatacggaggtaattgactttattttgaagcatattgttcatagattcggtattccgcaaacgttaactacagatcaaggtgcttcttttatgtctaaggaagtgaagagttttaccaaatcttatggtattaaattgttgagttcttttccttactacgctcaggctaatggacaagccgagtcgagtaataaaacattgttaaagctagtaaaaaagaagattgaggaacacccgaagaggtggcataaagtgctttctgaagcattgtgggcacatagaatatctaaatatggttccactaaagaaactccttttgagttggtttatggtcaagaagccgttttaccggtggaggtaaatcttggctctcttcgttatatcaagcaagatgatttgtcaagtgaagattacaagacgttgatgggagacaaccttgatgaagtcatcgacaagcgcttggaggcattggaagagacagagaaagagaagaagagggtggccaaggcatacaacaagagggtgaaagcaaaattgtttcaagttggagacttggtttggaagacaattttgcctttgggtactcgatccaaggagttcggtaagtggtctcctagttgggagggtccttatcgagtgtgcagcattgttcgagggaacgcatactttttagagacacttcaaggggagcattttcagcgagcaatcaacgggaaatacttgaagaaatacttcccgagcgtttggcaagccgcttaagaggtactatggctggtaattggattatcgtcctaagagcaaaaacatgctctatgcttttagattcacgttgttcatcaaaaaggcaggggggcatgtgtttacacccaaatttagcacctaggattaaaataggaaagattgccaaaatttggaaatctaccggtttcctccgagtaggccggtctgaccgccatgtgttgggtggtcagaccgccggttgtaagccggtcataccgacggtgtgtggccggtctgaccggcgggtccgagtccgaccctatttcgtcgggtctcgaggtttccttgctcgggaaggcatgtttagggtttcctttggtttctaccccgagttggacgtggaggagggcctgtagagggcaagaccaacccctatataagtgacaaggccgggttcattgtaaagatcaatctacaatcaatcaatcgaatcgttcttttcatattacttttagttttctcttagtttgtccatctttgtcggtttgcgccgtaaaccgtccgccgccgctgcgaaagtgcgacacctctttgtaggtttgtcttgaaaaccttccgttttgcccacgagacgggtagttatctagaaatcggctccgctagccggtttagttattaaaacccatctaggtttagctctttgctagatcgaggtggttgacgactctaggatcaccgcaagacttaaggtgctacgatcgtgcttgtcaacttatcaaaaaagttgccaacaagtatatgattgcgacatttgtacggtgacaacaaaatgcttaagcgattgaagtgctcaaaaatctcgtttcaaaaaaaaaatgctcaacaaacacctaccatatctgcctaattcaaaatttccctacatatctaaatcttaatttgaatattcaattttacccatgatagaaaactaaatttaaagcggggtttggatcctgggactaaattgtcacatcgggtgtttggatattaattagaagtattaaatatagactaataataaaactaattgcataaatgaaagctaattcgtgagataatttttaagcctaattaatacataattagcacatgtttactgtagcattaatccataatagattcgtcttgtgaattagtacatggttatggaataggttttataattagcctatatctaatacttttagttagtgtctaaatatctgatgtgacagggatcttaattttagtccctgatccaaactgggcataaatcctgttcaaatgaaatccactcaaatttcaaattccattcgaattcagattctaaaaaccaacctactactctctcctctacaactaccaaagaggcaaagcgaaaggctcaagaaagcggagtccacccatccatctcctccaaccccaagatccccacccaaatccacctccggcggcggcggcgatggccggcggcgagtacaccccggccgacgctgaggcggacctcctcctcccgccgccggcggggtcggagccggacgagccggcggcgcggccggcgccggcggacacgctgggcgtcgcctacgccatcttcttcaccctcggcaccggcttcctcctcccgtggaacgcctacatcaccgccgtcgactacttctcctacctctacccgggcgcccccgtcgaccgcgtcttctccgtctcctacatgctcgcctgcttcctcccgctcgtcctcatcgtgctctgcttcccgaaatccagcgccccggcgaggatcaacaccgggatgtcgctcttcacggtggcgctcctcgtcgtccccgtcatggacgccgtctacgtcaggggggtccccgggctgtacggcgcgttcgacgtcaccgttgctgctacggtgctttgcggcgtcgccgacgcgctcgtgcagggtggggtcatcgggttcgccggcgagctccccgcgcggtacatgcaggctgtcgtcgctggaactgcaacatcaggtagtgctccgatttcttggatttggatagttctcctgaaatttttaacacatcatgttcacaaatcagtcattcggttcggttgacatttagagctgtcgaatgaattcatggcgattttaattttctgagcagaatccagtgaaagtggtcaattgtcttggtccagttgagttctctgatggttggattgttaccccttaaacttgttaacacgtccgttcacaaatcagtctctccgtttgacatttagacctgtcaaattcatggcggttttctgaaaattttctctggtactaatttagtcaaaatggtcagttgtcggttgtcaattggacaattgcaaatgtgtgagctgagaaattcgatcaggattatccattgtgccagtctattgttatgcataaacaaggtgatttgaagttagtgatcaagaaacaactactggccatctctttaaatccatcaaattaaagttagagtgacacgccaatggagtacttgcaaactttacacattcaagtgaagaaattgcaaatgcaggcatttcgagaaccaaaaggcaatgtggaaacataccagcaccttaccaatccgcgtacttgttgcaattcagattggtttgacaattgttgcaatacactgtaacattgtttcttatattgaattttgcaggtgtacttgtctcagtattgagggtaattaccaaaggagtatacccgcaagatgccaatgggttaaggaaaagcgcaatcctatacttcgttgttagcattgttgtcatgatcatctgcatagtgtgctacaatgtggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 7879 - DNA, 245 bp, Oryza sativa
ccattggaaagagatgatttcttaactatttgccatttttacctacgtggcgtgccatcgtggcatgcctaacaggaaaacaacatggaccccacccgtcagcccctcccctctccttctccttcttcggccatcacagtctcctcctccagatcttggcggtggaatcaggccagcgacgcggcggcatcggggcatcggagacggacctcgcgtacggattaaaaaaaaagaaacggagaaaa

SEQ ID NO: 7880 - DNA, 11289 bp, Oryza sativa
tagttaagaaatcatctcttgccagtggtaaattattaagcgtgaatcaaataggggcatttggataattacaaaatctaaaagtggcaaatagttaaattccccttaaatttgggcttctgctgcttgcatcctctgccgctagtggtgcaactggaccgtatgcggtggtggatctcagccgtcagatgctgcattgacggttggattgagcagcggcggagccactccccttgcgggtcgggctccgcctctaccgtttcctccatccatcaacaatttataaaaattagttgatcatctgaaaatgctagtagtggctcgggcttaacaatgttgctcgcttcgctgctgctaggattgagtgacaaagtggatgttccgtcctcctgtggtcactggtcacgaacggtgagaagttcagtgtgtggttactcatagtactgagttgttgtatacatgcactggctagttttaaaaatatttaaactgaaatttattcggttattatgatacataagttacatgcacgagctaattcgcttgaagatattgagttacggagaaaaataaaatctattactcttactagctctgccaaacaggcttttagtaggaagtacagtggcatcgtgtttgatgcagagcagcagaggtcgagcttccaaaagacagaaaaaaattcaagtgaataaaattgaaatttctgatttgatctataaaatgtggagtagtagatacgacctttcaattcgggaaacatcaaattaaaattgctaagtttggagcattcgcatctacaatctttttacctttcatcattgagacacgaatcaactatagcaattccgatgtagacggccaagccacaacaaacaagaacacgctctaattcattgggggcgatagtgattagtcaaggttgtttcaacgattacgatgtgaaactttgaaagagaaaccccatttgttatcgcacacaccatactcaaaatagtactctctccatattttaatgtatgacgccgttgacttttttacaacgtttgaccattcgtcttattaaaaaaaattatgctattatcactttattttattgggacttgattcattatcaaatgttttttaaacatgacataaatattttcatattttacaataattttgaataaaacgaatggtcaaacgttgatcaaaaagtcaacagcgtcatacattaaaatacggaaagagtacaaggtttgtttcaacgattacgatggactacggatgcagtgccatgatcgataagaccactatataagagaaaaaaatagacgattaacgattaaaatgtaagagaaaaaaatagaataccatcctataatagacgattaacgatacgataagaccactatatataattaggcccatatcgatcgaataaagccgaaaacaaaagttattgatcacacgaagccgaaaacaagatgtcaaccaaatgaatccgaaaacaagagtaacacaaagataccttcctggtgatcaggagaacgacaaagagataccttgagaatgagaaagaccaaaaggataaactgaaatgttgccaaagcagcaaatcctacctagcaattagcaagatcggttgggttttgccagatgtgcattggccagaagggaacggaatggctttgctggctagtagtgaactcctacgccggaagatataaaccgagtatatatttgctacctctatcttaaaatataaacacttttaaagttagacacatgtattaagaaaacagatttaattaaatagataaatagggtgtgtggttataatttgttaagaagataatatagaaaataatttatatgaattgaatgtaatttaactggttaggtttcttatggtggaatcagtgtacttgggtttaatttctagatttaacacggtgtttatatttacgactaatttttctttcagtggtaggtttcaaattctatatttggtacgggtgctcgcatttacggctaattattcttttagtgatgagcgacgtatccatcgacagcgaaatacccgtgatgattttatcaatctcaaaaaaaatatcggctcggtcttcgaccctttttaccgaaggtgtttataggccctgtttagatcctccaaaacgttttgccattttgtagcactttttgccattttggatctaaacactagtagcaaaagttggcaatttggcatttgacatttgctagtccatagtagcaaattgtgccaaaaaatgttttgggaccactacctctctctttctctctgtcactttagtgctagaatggcaaaactttaacatacatctaaataccaactagtacttttgcaatgccaaaacttttaccaccaaaacttttgccatttgctatttgccatttcaaatagatctaaacagacccatagttgtaaggcgtgcgtgtgtacgtttctacagtttatcatattgtaaacacggaaaactagtgacatatgccgtcaccttttttttttttgggctgagctagagagagctctgtcgagtaggcgtgttgacaccatgttgccatcctctcctgcaccatgatgtggtcatcattgccgctcgtggctcgctgacgccccgggcccacgtctgggttcgcctttctgcctgcctgttggctgttgcgaccggccacctggggctcttccctcttcagtttgggcagccagtgacgcgtgtaactgcctgctggttttagtgagagttaggtacaccaacgtggtggttgttggctactgctgctgccagaggcaagggagcatgcatgtcatgtttggcctaagctctttagcttccaatggtcaatgatgtgtttgtatttatatatagtgaatatttggtctggctatagggccctgtttttgagtcatttctgttcttttttctgaattaatttaattagaggcttcttttcaatttgttacaggtcttgacttttaggctgctaacagcaaaattgtagaagtcttattcaaaaaatcgccacctccttctctaaatgttgacactagttaattcaaatttaagctaaccaatgttaaaaaaaatagagataatggagggagtacctttattatgtcagttatgtgtctttggcttttaagccgtcgaaaaaattttcttctaaacgtgttcttaatttatgtatgcatgtgcagctaataatcggtacaacctatacggtaagttattggaaaagcatgcaccaaaactattaagtacacgcataacttaatttatgagagcttagatattagtgtctaactacatgcacatttttatagaaactatttattttctgagtttatcctttggggtttctttgacattggacgtacacgtattcacaattatatgcgtgtcgtgtacatatatatataagtaatgagatatatgtctatgtaagaaaaatgagcattaattcctgcaaatatttttgatcgcgttatatatccaataatattgactgaaagtagtgaaaaataaacaagatggcgttgggacttcgcttgcatcgtaagtgcttggctgactaacaacaactaattaaactctacgagctgacatggtttgtcctcgctgaagaggttttacctaattaatcagctgttgtttttggaacaacatgacccttgtttgcaacaataattgccatggcgctactatatatatgtcatcttccaacttgtttggaagttgggatggtacagtactaaaataactaatatgatttcacctatccactgaaattaaaatatatatgtgggtggataatttcaagacctttaatttgtttggatttggattcccctaatatcgattaatttcaatccatacgtaccgtgctatactagctgtgcttaactaggagtataatattaatattctctcaacttggttggaccaaatggcaaccatccgaaatagaatatgcataaaggtattatgacgacatccgacaaagttattttcaactagctgaatgagcaagacacgctttcgtgaacttaaagatatttattacccgggtaaattaacttgtttggattactaacaaataatcgaaactttgtatatatcatagaaaaatatggaaaaaaattatattaggggaagctaaattgaacagggttttgcctctcctaaattcatcattgtccgcacgtttgtcaaatgctagatgggaaaaaggcacgcccatctcctctctcaattaaagtaagtttaattagttctaaaaaaattaaagtaattaagtttgagacagtgatgaatcccgtatgtaaattgagcgagtgctctagactaaacaaaatagagatatatcaccttaatatttttatatgagacctaaatacacatacgatcaaaagaaaatacattgctttctctattttgattttcaactatattaatatatctacacaaatctataggaacaaattcccaaatgggtatgatctacccagagagtagattggatacttgcagctttgagcgcccagcacttcacgtagcatgtggcatccttgccgtatgcatggccagtagagtcactagtactcgctccatttcgtgttataagtcgtttattttttcttctaatcaaacttctttaagtttactaaatttatagaaaaatacagtagtattttcagcacaaaacaaacatatatatattatcaaactatattcaatgctagatttaatgaaactaattttatattttagatattgttaaacttttttataaacttgatcaaatttaacaaagtttgactagaaaaaaaagttaaatggttcaaaatatgaaaaaaagagagtagagagtagtgaattataagctgaggttgaaggttgggcttgcgcaccaacaaaccccaccgatggatctgtcactggtttgagacaagttaaaactaactctttaaagcaggcttgttactccttccatttcttccttttagcatttaatttttttctcaaaatattttctttacgtaaaacagtaggagaggctcctactgcgctacattaaataatataatatagaagatttacaaggttacgagaatttacaaaagacaaattaattaaaaatgtctaaccatgattgtcacctaggtttgtccatctcttttgctctatgcatatgcaaggcaaactccctcagaaaatcagccttccatttatcaaaactgagagcaacattgttaaaaatgaggtcactccttctgcaccagatgtgccagcagccgattgtcaaaacttcaaagaagaaagtgtgctgaaaagagatctgagctgaagtgatcatgttcataaattccaaggccaaattccagtgaataccaatgtgttgccagacattgttgtgctaatggacaggagaaaaacaaatgtgccatgctttctgtggtcatggaggttcacatcaaacagtttgtgccatcttatatgttgaattgctttttatgtaacatttcctttgtgttgagtcgattcattagcatgagccaaagaaaaactttaagcttcattgtgcatttgcttttccagagtattgatagatgcctggcaacttgaagatgttcaaaaaacattgagtaaactttcttgggttggtattgatctgagttccataaacatgaccatttgtcaggctaattgttaatctgtaagctttgcaatctgtcatttaaataatgtcattagtatattccaaagcatttatagatatatctttcccttcctctattatgggaatttgaatgcttgttttgtgaaaaagataatcaggacttaattaatgagagtagcaatataatttgtcacactttctagtttagtgtgaaatttactgtaatgaaaagttaatttgaaatggtacctataatttaattttatttatatcctctagtcatcaattaggaacttaactaacatatatatactccgtacataacattaacttttagtgccttgggccaaaataaactacaacaatatttttttttatttgtattaccctatatttcctctcttttttgaaccagtacacattgctgcctcttacagtatatgaggaacactcctctttgagtctctagctcctcagcctcattgtctagcacttgagatatcactagttcttactgaaaagctgagccaaaccaaaccagggaaatcaattcatttttattcaaactgaataattttaattctaaaataataaaatgggaatgccagacaatttcgatatatccaagacatcctaaaagcgtctttttttcacacttcatatatttttcgacttggtttttattttttttaagaactttgggcttgtattctagaggatgatttatgtcctagggatggaaaaggaacccatgcatcctgacccttgtcactacatccaaacgacacactgatatttgtgtagactttatggatctctagcaagatgcgacgtgtatgttatagaaatactatacatgaataatgtggggaggtttaaatatatgtgaatttattatttgcaaaccgctagtggtgcaatctcataaaacctttgggaataaatttagctctatttgtatctggggactagtccctgtcacatcggatatttgaatactaattagaagtattaaacgtaggctaatgacaaaactcattccataacatggactaattcgcaagatgaatctattgagcctaattaatctatgattagcatatgtgatgctatagtaaacatgtactaattatggattaattatgtttaaaatttttctcacaaattagctctcatttatgtaattagttttattattagtatatgcttaatacttctaattagtgtctaaatatccgatgtgatagggattaaaatttaatccctgtatccaaacaccacctaagacttatcaacagggtgtgccacgactctccgtaactgtttggcacgtacttcggattcgtttttttcttgcttaaattatagccatttaaaacttcacatatcatcctccatcgttttaaagcttctatgcaaaattatatagtactctaaaatgcacggtacttactagttttttttttttgctaggccatcgaagagaagctggccaagaattgttaatattgtgcaaaaaattgtattatacactactgctgaaccagctatcactggcggttaaaaaccacactaccgctatcaccacataattaactcagcaacaaggtcaccagtattagtttcaaactctcaatcttgattttttttttcaaattgaaatttcactcaacaaaaccgaaccattctggccggtgttgaaagccggccaatgttcaggcgaaattcctgatccttacaagcaaatgaaatatcaatatggcaccgacgtttctggtgcttcaatcaacaacgtgcttggtggtgatgaatgctcaagaagctatcaatcatcagtgatcactaaattgtccacgtttatgtcctctttctggtgtctttactttgggcacatcaccattttgcaaccagtagatacggctcttccatatataagctagacagttgtcacacacgcacaataagaaagctgacatgagagaaagcaaattaggaaggaattaagacacatgtgaagaggcttatatatgagattaactgaattctaatttgaaaagagatatgctgcgctaactgttactctacgcattcatcaatataacgaattttgggtttcaattttatccacaaattataagaaattggaaaatactattttacttaaatttcacatgagcttatctccaaccacctcccatttgatgagggggtatcctatttttttcccttcaatattaatcctcaaaaaatctagaatagattatatttatgaactgagagagtatatggtattttacttgctgtactaatataattttttataaaatataagtgaatcatcttatcaatttatatgcaccacttttttttaagatagtggatttaaaaccgggcctctaagtctaagcacggattttcacggtcagtgtaccacaatcttatatatgtactccctccgttttttaatagatgacaccgttgactttttctcacatgtttgaccattcgtcttattcaaaaaattttattcaaatgtataagatataaatcacacttaaagtaccatgagtgataaacaactcataacaaaataaattataattacgtaaattttttaataagacgaacggtcaaatatgtgagaaaaaatcaacggcgtcatctattgaaaaatggaggtagtattaatttatacgtaccacttcatatgttcatgagtgcatattttcatgggatactgtatatagcagcatgtcttttttttttactggcaagtgcagactttcatctgtagccagtgaaaaggatcaccgacatcaacacatgcatacaaccatatattgatatatacaattgagatcctctgcagtactgcatgctctgctcaatgcctgaatgcaactttcatttatagccagtgaataaggatgatgttgccatcttccacttgaactccatctagtctaggacgtctaggagtatataaactagctaggtgatgactaatccaatcaaggattctgcagcttccacatacatcagttcagatatatagcatcaaccaagtgtatccttggagcgtcttagccatccattttttattttccatatgaattgaactttttgcattggtgttcatcatgggctctgaagatttctgccgtgtttttagcattataaaagtgaaatggacatgatcggaatactgcagccttatctttctttttgttctgtgatgaagtctgcagctacaacgatgtaatatcagaatatatagatcttcagatattagtgtatctttatatgattgacccctgacaaagatggcacctgaatgcatggcgtgcttttctccctgtttcaaacagatttttgcgttctaaaaaaaagatttttgcatcaattattgaggcaaattgtttactcgattagcacgataaaatataagtaaactttacatctggcttacaataagtggtaaattaataatgcagtagatgatattgatttttagaaatcgtatttttaaaagcgtggagcaagtaatctatggcaaaaatctgaaaatgataaaagctaaaaggaagagggcaatatatacgatgtctgaactctgaagggttcattattagaaggatcatgttcatggtcctggagtcctggactcttgtactaccagtgatgaatagaaaggttgacaatgatctcctgtatttcctctgttgtcaacactctattgtattattagactcttgattggcataaacggcgatatttcaaggttagctgcaatgcgttcatactataaatagtggcttgctattggcattcattacgcgtgtgcaacactcaaattattggtcttgtattcatgcagacaataatctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagcatcctttcccccagccaccacctctttccgcatcttggacaggcggggatcgtctttgtccctaatcttcgtctgcagcacaccatccttgaatagcttcacacaaagtagcgaaagagagagataatgccagaatagattgctagtgttgcccagcagaaaaaggaaagtctgtaaattcattctcacctaagatgaacaacagaggtctgcccccaattctgtgtgtctgcaaaaatcaaccaagaaacaatgaggataatgagcagcacaaccgaattagccaaggaggaagatttcctcttgttggctaaacgaaagaaaaaaaagggcaccaattaacctgcagcagtagagtgggcgagcttccaagagagaggaaccgatgatagcagcacgagcaacagaagcaaaggtgctgctgcccttgtccgtggccgccgtcgtcgtcactaccgccgccctcgaccgctgccaccgccctcatccgtgtccgccgccgccaccgtcgagtacagccgcctcgtcctcgtccactgccgccctcgaccgctgccgcctccctcttccgcgtccgccgcagccgccctcgtccgcgtccaattccgccgcgctcgtccccgaccgccgccaccgtcgctgtcaccatcgacagagtctgtcaccgccgtagtcgctgttgctgggggaggcgatacggtacaggaggcgatgcggtggggagcgaagggacccagggcatgctccaaaacgcaatgaggaccactgagatgtaatccaacggtcgataattaaatgatgacgtggcttcaccaaatctcagctttgggtcttaactttatgaaagaagggattatatgggactaactttaaagaatttagctccagaaacatttgcctgtcctcattttctttaaaaaaattgcctgtccctgctagtttta

SEQ ID NO: 7881 - DNA, 33876 bp, Oryza sativa
cccttcttcggtgaaatcagcggccatgctctagtgtcatgccattatctaaggtcattcttgcttcccgcaactctcctgcatcgaatccctaaactttccacccaaaaaacacgctttgtggccctaaatcctctattcgtcatcccccattacctttccatccattaaatgcgcatgaccaccttttaaaaaactgacaccttttaaaaactgagcagtgagcttatgagcggataaggggaggagagtgcgcggtgacaagcggataagaccgagagtctctctctctctctctcggcctcccctccgccagattcggtgggaggagaggcatcgatgatggtggtggcaggctccggatctcacgggcggtgggctccagatctcacgggcaagggcgtccatgggcgacggcggcctctccgtccgtctcccctcccctggcctgccttggcctctcctctccatccggccagcaacggtggccaacggtgtcctgctacttccggctccaatgagcacccatgtcgacttgaatcctctttctctctccatccatctcttcagccttcggtgagcaccaccatttctctttgccttaaccctatcttcatttctagatctagagcaagcttttctccggtggatgcagccaacagcgactttttatgatgcttgattctatgatgtgaacttatcgatgaacatttgatcgtgtgatccatgaacttgttgattgtctgatgtgtacttttatatatatatatttggatttatttttggtgactttgaagcactagcttagctcaaattgagctaagctggagtttttttttttttgcaaatcgtatacctctaatagacttcgtggtgtcagttgggaaatccggcacctatgaaagtttcccaaccaacaccaatagccttttctataatagtgatatagggtatgttcagcagtcagtcacatgctaccacaaccactttggttgaacctttctaaggtttggtggttaaaatctttgctacggcttaggagctgtttggatggggggattgatttttagcctctgtcacatcggatgtttggacactaattagaagtattaaacgtaaactaatgacaaaacccattccataaccctggactaattcgcgaaatgaatctattaagcctaattaatccatgattagcctatgtgatgctacagtaaacatgtgctaattatagattaattaggcttaaaaactttgtctcgcgaattagctctcatttatacaattagttttgtaagtagtctatgtttaatacttcatattaatgtccaaacatccgatgtgacagagactatacaaagttagtaactgaattcaaacactaccttagtaacgggatccaaacaccaccttagtaagcttaagagagaatcgtgtcatatttttcttaatcacttacacccgagccctagttttttagaagtactaatcttgctacaactgtctaaatagttgatcaaatttatctaatctatgataagttatggccgacaactaaacggggcttataatatcttccgttatatttgaagaaaacacgacccagttagctcagtactaatacttatgtgcaaacagtacgttacacagtacaatgtcggtcttttgtagtactacctccgtttcaatataaatataaatatagttgtggttttccatatctaacgtttgaccatcattcttatttaaaaattttatgattttttttaaaaatagttacacataaaatattattcatgttttatcatataataataataaaaatactaattatatttttttaaataaggcagatagttaaatgttggacatgaaaactcacacttgtactgatgtagatagtaattagggtgtgtttagttcacgctaaaattagaagtttgattgaaattataacgatgtgatggaaaggttggaagtttgtgtgtaggaaagttttgatgtgatggaaaagttagaaatttgaagaaaaagttaggaagtaaaccagaacttaatttttttgtctatgaaaaagagggagagggaggtacgtacgagctagaaactgcagagtgtgaatgcattcccaatcaatcagtcactgtaatctcaaacaccatggacagatatgatatggagtagataggagtgaaaagggtcggaaacgatcggaattgatatcatctctttaaaaacggtgctcgatcagccaataattgaccatatttatcatttaaactactcagtatcgatattaatacgatgcagaaaaaattatgaaaaaaatttaaaatagcaaaaaaacgatacggtcggaaacggtaccctttatacggaaacgacactcggttgatcgggaatttccgtgaccatcttcacccctatgagtagatatgtgatcaatcctgcagtctgcgctgcgttgtttggttacatgttttccgaactactgaacggtaatattttttctaaaaacctttatatataaaagtcgctttaaaaaccatacaaatctatttattttaaatttaaaataaataatactcaactaattatatattaatagctcatctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattactatattagtttctttctctcctccccgtagaagtttgtgtagagattgcttctttcatgacatgagaggtggtttctcctctctctcctttgttttccttttccatctcatcatgtgatcctattatcctacaaatacgagcgtttggatgtccgtagtacttgctctcataaatatataatattattttttcttttaaggagagacactttggtagtatatttttacttcatatcaatttgtgttatgatgataaaagatgaagttatttttggaacgcatgtagtactatagctggtgcatgaggctgcggtgcagtgccaccagcagctagagatgaattgatcggctgcacaagaggagggcggctaaggcctctcagagcgcaagcaccggttgccggatcctagcccaaaaattgtcccaaagacactcctccccacagtacaagaatcctattctgtgtagcttaattgaatgaaggtactatggaaggaaactgagcccacagtgggcggaaccccaagcgcatggacacgggtagtgcggaacaaatttattcctcacttaccctcgagcggtccgtccgctgacttatctacttttcctcatcctcctcttcttctgcctcacttctcgaatgcggccgccgctcctgatcctcccctccgccgccgagccatcacagaggcggcggtggcggcgaggtggaaacgcgacgctggcctcgtgcaacggcggaggaggaggggaaaggctcgagcggggcacgccttcaccgcggcgaccttgccgaggggggcctcgagcagcgccgccggaccccggggagtggcggagccgcacggcacaggccgccgccgcgaggaggaggagcagaagcaggagccgccgtttttttcttgcactgtctagatctgttggttcggggtgatttgagttgacttgagttgatttcagcggtttggtccgcatctgtggtggtttggggtggaattcgctgtgcgtttgggttgatttcatcagttcagcgatgattccgttggagggcgatttggggttttctgcaggcttgttcggcgcgagggcacgggaccatatatgaatattcagtatgagcttctgctagctgcctccacgcgctccaaggaactgatgaatctccattctccaaataatcctccggctgcttgcccatgcaaacggcataggatataggatattgatagtcatagctagggatcacatgcaggggtatccttttttaaaaaaaatttaactttattaactttagaagcatagtaactatgttaccctgatacggagatacggatacggatacgcgttacggggatacgaggatacgtcacttttaaaaaaacaccgatacggggatacgtctatatatacttattaattaaaaaaattactaaatccctgtaaaaaaacaataacactttcttgtagctaaagagattagcctgaaataatgaactttctgattggattatattatctccaccaaagcccagataacagaggaccaagaataatgtataaattagtgtaagactgtaagcagtgccaaaataaaaacaagttgatgttttttccttgctggtggtccagtcagccttgatgaaactccagccgaactaggcactaggaacgatagatgcagtactctgaacttgcaaatccaaaacccatcagacatatgaaacaagatgcattagttcttagaaaaaaataaggggggaagaacgtacacaaaacagatccatcaacggttccttcagtgggaacgaaggacccatattgctcagtgcggtggctctgtgcccggcgatggcggccatcggcggcgctgcgccccggcagtgaaggtggtacacgtctggcacggcggtggtccgttcgacttatggccgccgcggctctccttttgccgtcgttggcggcagcggctttgcggaggcggcgcagccgcgcgcccacgcgtagatgcggcgattgacagtactccctccgtttcagattgtaagactttctagcatttctcatattcatttaaaagttaatgaatctagatacatatatatgcctagattcattaacatctatatgaatgtcggtaatgctagaaagtcttacattgtgaaacggaggaagtatttgttagggttgggacttgggactatccaggatgcgcagagccgtatccaagaagtatccgaattatctttatttatttgaaaatcagaaaaattgaggatacgtatgggatatgtatcggagcgtatccgatggagtatccgatacggatacgctgactgttagccgtatcagtgcttcgtagcatagtacatcaaccaatgatacattctccataagaggagaggattccaaagcttccttaggcctttaagggtgctccaccctggaccggtgctatggggcgccatggaggattttgttcgacatggaacgagcgcccgtgaccaagttaggctcctcacgtccatccatactgagcgacgtagaaccttgtttgctcgagtctacgcgcggccaaaaaaacgaaaggagcctgcgctgtgggcttcggttcttcgccacaccgtgacctcgcgccgcatccagtgaagaaattcccgattcgcccacgaaaaaccccatcccgcccagcgatttcccctcccaccacatccatttttcctcccaccatcgagtcaagaaaaggcaagaaaatcgaagaaccgaagataagagcatgacaagcaagtatagataggagtaggatccctctgggtcttaaaacaccacaggaacaaacatcacaagaactgaatataagaacataacaagcaaagataaaaacaggagagcagttcttgatttttctcatcaagaactggagaacagaacatgcaaagatattaagaacaatgattcgcttcttgatttcttgacagagctgaccgcggcggcgccggcagggtcaggattggcggtgggcagcggtgaggctggtggtggtggccgaccgccggatctactcccccacctcctactcctcctccacctcaccgccaccgcgtgcagtgggtggcgacgccttcttgctccctcctccccgcggcgtgagaggcgagtaggcacggcggaccgggaggaggagcggcggcgccggcggtgattgcctacgccgccgcggtagccgggacacctcccgccgccaagaactggtggccgcttgcgcgaccaacaagaacaaccggccctccacctcgccgcccgccggatctactcccccaccacctcctcctcctcttccccctcgcccttgctggttggcgaggcggcgcgatcgacgggagacgaggcggcgtggccgaccaggacgaggcggcacggcctaccgggacgaggcggcgccgttgacggaagaagaggcggcggggttgacggcgaggcgaggctgccggagtggagcgccggtggacgaggaggagaagcggcgggtgcagcggattgggaggaggcgaagggctgggagaggagtcgctggaagggtaggttaggaaaattaattcgttccgctccctgtgaccacgcgactcgggtaacgcccactgtgggctgggtttctttccatagtaccttcatcctatttagccacacatatatgggtgcttgcactgtggggtagatgtctttgagctataactttgggctaggggtatgggccccatagcttgcactgctattgcccttagtgtgtgttcgtcacccccttttcccaacccatctccctcgtttttcacgtgcacgcttttcaaactgctaaacagtgtgttttttgcaaaaagtttctatacgaaagttgcttaaaaaaaatcaaattaatccatttttttaaaaaaatagctaatacttaattaatcacgcgctaatggaccactccgttttccatgcgtactactccgattgggaaccgggaatggcgaacacagccttagtagttagtagggcagctggaatgagaacataagcccttgtttagttcccaactttttcttcaaacttctaactttttcatcacatcaaaactttcctacacacataaacttccaacatttttctttaaacttccaattttagtcaaaattccaattttggtgtggaactaaacacaccctaagtgggaaatgttctgacaaactatttgattttgtgtttgaccaatttttcccctagcttgcttggcaaggaagttgcaggggtatcctcaaagatatatatggatatgaggacgtacgtacggtatggctaagatatatctgatcgaatattgatttcggtatcagtcttcggtctggtcatcaaatacttagttatagtataaaatagtcgagatcaatcaattcaatctcaatcgtcataaaccaattgtatgctacgcaaatggtaagtctgttggtcaatgtcctcctaaagtcctggccctcgacctcagcctcacgttgagatatctaaatcaaccaaatgtattgtcattgtgcgctggatttagatcaaaggactagattagagtataggcataggcgcttgcaatgaatttacagttgtagttgccgtcaagtctctagggcttacttaaattgatgttcttcaacatttacttattgagtttattgggccaattttcagccaatatggttaaccgaaggtggtggtcgaattgaccaaaaaattaaatttagtcatttagcagttgatctcttacctagagaagacatattaattcgtgagattatgagagaattggactcgaaaaccaaacaacaaatggggactaaaaatgtaactcccataaccaattccaccatcaacttcctccttcaaactcccattcctcttcccttctcttgccaaacatgccattaatattatgggacaggagtagtcggtgaggctgtgttctttctcatgggttcccaacccatctcccttgttttctgtatgcacgtttgtcaaaccgctaaacgatacacgctttgcaaaaagttgatataggaaagttacctatttttcaagttctttatagataatacttaattaatcacgtattaatgtatcgctccgttttccatgcggaggagagggttcccaacccctccaaaagaacacagcctttagggtcctttcagcaaaatctcattttcatttcacaatgtgactactaagcacaaattccaaaaaaatcagggtcctttcagcaaaacctccacattgaatgagctcctaaaaaaccccctccccattctgtatataagatcatcacacctttctcgttagggtttccgccgcccgccgccgcatcgccgctgcagcctccttcccccttcgccgccgtacaccctccagccagccatggcggagcaggtaagcgcccgcgccacccaccccgcgtgatctctctctccgtcgatgcgctgtttctcgcatcccctcccattcctctcgtttaggatttaggaccagttattaattggcgcgtctagggtgttcgagccatctactggtctgatctgatctgatccagtgtagtgtgatgaccgatgcgaagtttgaatcttacggtagtgaggctttgatctgtgggcatctcctgaggatataattaggaaatggcggcatattttcgttgaatttttttaaagattctgtttaagaatccacgatgtactatggttttgcgatggggatgtgaattcagagctcgcaagctgagacacaaatgctttgtacattttgagactcgatgacattaatgtagtttgggttgtcgcattggcgctccccaagactccacctgtttatttatttcaacccaaggttcattggttatctctgtatactgtgattttcattgacaaaaaatcgatgatgtgtttgggggtgggaatgatggttagattgggttcagatatgtgaaggaagctgtatagtgtatagtacaaagtaaagttgcataaagggtaaaggaaatgtcttctctattaagtaaaaactaactagagttgtcatgatggctagatgcttataaaatgttttatttgggtgatgctcaattgtttgtgttctgataaaacctttgtcatgtttcaccatagcagagttatgttgcatttaccgtggtacatgtcgatgtcgtgcttacaatttgttgactattctattgcacactttagaatgtagtcattatacggtgccagtagttttgacgtatgtcattctttgtattgttcagactgagagagctttcctgaagcagcccaaggtcttcctttggtgagggttctgcttctacctgtaatttttgcggttcattaaatacatcatttgtatctaataattaggtgcttgatttcagcccaaagaaatctggcaaagggaagaagcctggcaagggaggtaaccgcttctggaagaatattggccttggcttcaagacaccccgggaagcaattgaaggtaataaataaattcttccctgtaactatgcaaatcatgcaccctgtaatttggcatataatttagtttctgaagtgtgcactgccatttctttatactttggtattctttcttttacatcctacatcatgaactacatttgccctatgtcgaaacaggttatctctttgtgaatacctagataagtaattggttccaacatagtcttgatggtattacattccctgctcaaagtaatttaacttggcagtgattctttttagataaaagtttttagttatcaaatttattcctcagttttttttagtgatcagtgatttcttagtgataccatttcttttaaaaaagagcttgatgaaagcaaacattgttccttggttccttaccagataccaatttgtatgcgctgttcgttgggctacaggaagaaaaatgcttaccttgaatttttctttttgctacagttggtatttattttgcaatgcatgtaacaattgttctgttgatgatatacttaggaatacctagggaaacttgctactttcatcataatgtaatcaaattgttaactaattctgtttcagggacctacatcgataagaaatgcccattcactggaactgtttctatcagaggtagaattattgctggaacatgccacagtgccaagatgaataggacaatcatcgtacgcagaaactacctccattttgtgaagaaatatcagcggtaagtaaagcaatggaggactatgaacttacatttcttatctgtgatggcatcttatttagaaggtgaacttgttcatcttgtagatatgaaaagaggcactccaacattccagctcacatttctccatgcttccgtgttaaggaaggtgaccatgtcatcattggccagtgcaggtaatgttctctagctgatgctgtacttagtacatgttttctgttttgttctgcatacctgaatattgggattacatgacttgaaagttccactgaattatctgttttctttaaaatgttcttgaaaattaagaaactaatttatattttcatctgctctgtcattcctcttggattacattggtgatgccataactcagaaccaagcatcatattgttttggatgaggctgttctattgtcttaaccaggttaaggtcctgtttggcacagcttcagctccagctccacccctcctggagcttgagctcagccaaatagtttcagctccaccaaaactgggagtggagttgggtggagctctctcacaaaatatactagagttgtggagctgggtttaggtagctccacaactccactccagactcaactcctggagcaatatttagaagttggagctgtaccaaacaggccctaaattgcaaaaatgtttagttcatgtgattattatttttttgttctgtcatgaaatttattctggttatgaacaaaaatgcatttccagcccctgagtttatatttacttctgaattttctttgccctgtgtgtggttgtgcaggcctttatcaaaaactgtgaggttcaacgttattaaagtcatcccagctggttccacaggtggtgggaagaaagcattcattgcagcttgagcttatcgaaaatgcctaatcaatcactagttaaatatacaagtgttcacttagaattcttctagcttgctgttttgaccttctgtctaggtccctggagcatttgccactcatctgaaatgtatccgtgcaagttttgtttagatctctggtcatgcaaattgtggttgctgttgccctgtcgttgggccatgttccttctttgaagcaatagcatcaacagcctgtttgtttcagtcttatgatggtgatgtgcgttatcgttgttttttttaagctggaaattgttcaccatgtcactgacatttcaaaagatgtctatttcacatgaactaaaagatcttgtgatgtttgctattgtgaaattgttgctgcctgataagatcatctctaagattctgacggtgacttgataatttttgcacgcattaaataaacatcttagcctcctagtagctgttgtagttgtaggctgcgtctcaagcttgaagaaaggagatcggttgtttgcaaggcatgcaatttaagcttcttcttaaagtgcatttcagcatgttaaaaccccaaatccatcccagattctccaagaaatagtgaatcaattcagtcatacaaatgagcaccaaatttatcgttcctctctcttgctgcatatctgcacttgtgctgctctcatcacatctccatagtccagccatttcttcattccttggaatccttcttgatcttgcagcaccttcccttccattctatctgctaacatctggcactacaaattctactggaaatcatcggtatcgcgacgaatataatccgttatgcgatgatttcccaccggaatttccaccgccagataccgcggcaatttcaatcttctgtgtcgatcccaatggctgctgcaacttcacaacggtgcaggcagcggtcaatgctgttccaagcttcagcaagaagaggaatgttgtatggatcaacaagggaatctactagtaagcatcagtgtttcttaccttcttcagatttgtagtgctctttccaaagtgcactgttggctgttgcgaagtgtgctgttaccgaagctgaattgttgcagtgagaaggtgacagtcccagcaaccaagcccaacatcacatttcagggccagggattcgatctgacggcaatttcttggaacgacactgccaactcatcgcatggaacgttctacagcggttcagtgtccgttttcgcaacaggctttgttgcgaaaaacatcagcttcattgtaaacacagagtacacagcaatttcagcttaagtcacagactgcaccttaggtagcaatccttgctaactctgaattatttgaaaccagaatgtggcaccaatcccaagacccggtgatgtcggtgctcaggcggtagcactgaggatcggcggtgaccaggcagcattctggggttgcggcttctttggtgcgcaagatacgcttcacgatgatcgtggccggcattacttcaaggaatgcttcatccagggttccattgactttatctttggagatgccaggtcactctatgaagtgagtaaaaccataatccaaagattggaagacaacaaaaatacactttgtcactgactgcttccacctgtgcacttcccagaattgcagggtgatttccatagcagatcctgttcctgcaggggtgagaaccatcacaggttcagtcactgcgcatgcccgggaatctgtagacgacaacactggctactcttttgtcaattgcagcattggcggcaccggcaggatatggctggggagagcatggagaccatattccacagtcgtcttcgcctacacttcaatgtcagacatcattgcctctgaaggatggaatgattggaatgatccttcaagagaccagtatgcatcctctctctattcagtgtcaattgttacctgcatgacaaaaaggtaaattagcattaatatttgtaatgtttgaattgtcaggactgtgttctatggagagtacaggtgcacgggtgatggtgcaaacttatcagatagagtgccatatgctcagaagcttagtgatgtgcaggttttgccttacctgaacacttcttttattgacggagacagatggctaaagccatactgtgattcactgatatctgcttgaagcaaccaaacataggcattaattgtattgcaaacttgaaaaaggaaaatgtgtactccattctttgttttctttttcttctcactttagagcacgttgaattaacaattgtgcatagaccagtcttacagagatgtattattttttacagaagatttagccattgtttgatcatctacatttgagcagcacaaaaatggtacatggaaagggagccaactccaattgttgaattacaattactggcattacaacaagctgactaatatcaacattctaactgcaagagctcaagtccaactatctcatctcatgtcccaatgaaaattgagggatcctgccattctcttcttgagacagatgctttttagctgggtctgagactgttgctttcgacagacactattcctaaaatgaaatctcactcggtgcatggaatgtccgtccacggcatatggcttccaggttctctcccgcataagagctaagtggagaaacttcaacacctgaagtacaagtaaagttatgcgataatcaattcacaaatttccatctaaaaaaatttcagctagtgacggtcttcaaaagtttctagatatacatacaaaacgttacctgtcatatacaagggcacggaatgagtcaaaaagccacctgcagctaccacccatcggctgtgaaggcggagcagcattaatctggcactatcaggagtatcataagttgcaccattagcattctttactggtgcaaattcctcctccctcaaaatctgaaacattaggtgccaacaataccaatgagatctttccaataaatgtttgctttcagtaattaaatagaactagtaatagtgaatttgaagtcaaacctcaaaaagagctgttgatggagaataggtgaacacgtcaaatataaactgttcaagctttaagcctaccgtgtacccatggattgaaggaatcttcttctctgctaaatggtaactgggcacaggattttaaaattaagcacaaaatatggaaagagtaagttgacactgaagtggtattgctgtataatatccaacaatcacattgcaggaagaagaaaaattaaaaaaaaaagaggttgtataacgaaaaactagtcacaagtgatttattatattaattgatataataatgtctgttctattattaaaacaaggttaaaagaagcctcttaattcactctcaagggctagaaattaccacataaattagtaaaagagacaattatcaggtcgattgtggtggtacagattataactgtgttgatcgatctgaaagagttatataagaatattttatatttaccactaggcaaaacagttatatgcaaaataaaacttctaaaataaaaatgcattgaaatacagccacacaattgtccttttctttaaagtttagtaagttagctatatagtactaaataagtaataaaataattgggcgaagtcatttacaagaagttttctattattcgagcctacaataagaacatagctctaaatactatggcaattacctatgcttaaaccacaacttttgatacggaaataaatgttggaacgaaatgaaacatcatgaatcataatgctcaagaacaaaatagttcttcagtaacaatacttacatgctgtccttttcaagactatttgttacttgattaagaaaatccaaagtaaacatatgcaggcatacctgacagaaagatagtaaaatgattatcaacacttataaaggatggacagtggaggggaaagggaataagaagagacatacattgctccaacaataacgaaggcgccctgtgccttgatttatttcagtagtcatagctgcatccatttcactgtactcaactacagaaagaggcccacccctgccacgctgaacaaacactccaactttctcctgtggatatgcctttaacagcaaagcataataatgaaaaacaaaaatgaggtgcataattgaagttgaagaatacttctcattctgctagggattggataatgcactggcataccttccttacgacctttgcagcagcagacacgcccttgtcaatgaaatatcctaggaatgttggatcagcaacacggacctgtatcaaagagattgattattctggtaaaaaaggagatcaattaaacagatggggagagagaggccccattacaatatatatttttttaaaaaaaaagtgtactcaccaatacattgtcaactccatagcaatctacatatttcacacctcttccagccatatcgtccagcaacctttgagattttagagctgtggcacagtaaaaagaggaaataaacaacataattgtggctaacatcgataatatataattgttgtattctgatacaaggaattaccagcatacactccaccattgccatcaggagcccttgctacctagttttcaacagaatgttgcaaaagatgtcattaaccccagaaggcaagcaccattcaagcaagtttattatcacaatacttgtattttgattagatagtccaatgctggttcacttgcaacggaatgatggaagaatgggagatgaaataaaaaaatataaataaagcaaggtaaaaaccttgtatggtgtttccataataaaccttccatcagctgagacacatgggatagtcccttgctggaaaaatgttacctacgaataaagaatcaagtcaaacataattcttagaagtttcatagggcaataggaggtcacatgttgaacttcactggaatttccgttcataataaagaataaagtagtgatccttacttggtcaggctctaagccaaaatatctgtggctttcaaaaaattttcgagtcgcttcatcagtaaaggggctagtcattatataccagtgtatttgtggagtacctggggttgcacaaagttaacatgttgaacatgtgattttttaagaaagagtaaagaaaccattaatggcatgcttgactaaattaccatcagtggactgagcagccagcttctgtatgcacaaaattcgttcagcttgaagttggaaaagtgactttccagatggaagcccgatgcctgagcagaaatcagaggaaaagaacaccatgaatcttaagatcactgaagactgaaagcagactaaaacgtaggatattactccaaaaatactctataatcatcaacacaacagaatgaaaaacaattgcagtatagaataccagcaaaggtttttctcatgagtaaaaaagtttatttttatattgaccataggacaataaggagaacatggaaaagttaacactgaaacttcctgttgaaatatacaatgagaaaataattctaaaaaatagtagggtaccaaaaagagcatttatctgtagttaaaaataaataacattaatggcacagtggaagtagcatgcaacaagataaagtatgacaacttactgaagcatcccttaggatcagaactgccaagccttgttccctgtccgaaattggagagaaagaggatatgtgagatttcatttcctgctatgcgattcatagatcttttccaatcatacttttcaggagttttgagagtacctgaccaccagccaaaaggacaacagccaatttcccctctgaaatggctttcaagcccctcttccaccacctctgcttgtcctcaggagttctatcttcgacggtcgagacactcgactccggcacaggctcgacggctggcaaaggaacacctgtgctcccgagcaccatcacatgatcgaattccagaaaattgcacacgttacatgggaaaatgcctatggatggatgatctcacaccttgtgatctgagcgagcatcggacgatccggtcaatcctagcaagatctaggctctgaaatgcagttcacgaagttgagtaagccaaggtcaatatctcacgatacacaaaaatgcattgctgtcaattcaccttgtgcatgagatcacaattaagctcaatgtacaaaggcagcaacagtgggctgtgtacatccattgtggatgtagaggccggattttaatccattttctaaaaaaaaaaaacaaaggcagcaacagatgatgaactacgaatacatacaaggatcaagctaaagctaaccagtaactatttcaactaggaatttctccatctccatgagatcagctgcgcatctgaattgcgccacaatcgcaacgcaaaaaaaaacaaaaaagaaatctttaccaaacattcgatcaacaaacagactagtgtccactcaaaacggaatctttacgcagaagtctcaactgagcaaccgaatctaaaactctaaaaaagaaaacatcaaaacgcgaggagaagcagcagcagcagcagcaggagcaagggatctcgacctcgatgtcccggacgaggaagtcgcgctcctcgggggcgagctcgtcccagagcgcgaaggcgccctcctggccgtagtccttgagcctctcgaccagctcctgcggcggcgcggcgccccacctccccgccggcgccggcgcccgcggcgccaccacgatgtccgccatctcctcctcgagcgagagctagagcgagagcgagagagatctgcgagcgatggcggatgggcggagactatgatgagatgagagtatgatccaatcttggggagattattagtaggagagaggctgctgctgctgattgggtcgtcattagcgtttgtgcgtgcgtgtcagcgtgagatgaggagaggagccccacatggcaatattagggcctgctcactttgataccaaaaaaaacttactaagttttgtcattattaaaattttagcaagttgccaaaaatttacatagttgtttggcaacttgccaaaattttggtaggatttcttatatagttaccaaaatttgacagcaaactaaatgtaatcactttttggcaactttaccaaaatttggtaaggttgaaaatggcatcaaatcgaacagacccttatttctcagttattattatttttttattaaacacagtacaaacgcaggagctcacaacgcgcaccccatccataaatgactgggccggcatatcttgagattgacgaagtcactaataattagccctttgagagcaagtttaatagtatagccaactagtaactctaaatcacttatagtcaacttaatagtcaattcatacaatggttacttataaactgggcatttgtaaatttgccaccagtttttttaaatattgaaggatgtcgaataacagttctagtggtatttttgtaattttctagtggtaattttgcaataacgattcaaagtagtggtaaatttgcaattgcccttgtaaacatatattgcactattaatacatggtcccaccttttatacacatattgtgtctaggaatccgtgctgcagttggttataaattgtagtccattgttcttctctctcctcgatatgtgtttatagatgggttatagtctactattgtacctgcactgagcatatttggaagactgggctggtatatcttgatatttacgaagtcaccaataattggctcaaaatatgagcatcagtatcaaatttaggatttgaacccggatggactgattctactagtgcaacctacccctagaagactgtcggcatatcttaagattgatgaaattacactaattagtcaaaaaatacgagcattcgtgtcaaatttaggatttgaacccggtggattggttcaacaacaaaaaaacttaattagctgaaaatacaagcatccgtgtcaaatctaaaatttgaatccgggtggactggttcaaccacaagaaatttaaccagctcatgtggtggactagttcaaccacccgtgtcaaatcaaccacgaggaacttaattagggtgtgtttagttcctgaaaaaagttgaaagtttgaagaaagttgggagtttggaaaaaaagttggaagtttatatgtgtaggaaaatttttgatgtgatatgatgtgatggaaagttgggaatagggggaaactaaacacggccttagttgagctatgcttacttcgtcaattatttaatactctctccatttcatgttataagacgttctagcatcgcctatattcatatagatgttaatgaatctaggcacacatatatgtctagattcattaatatatatataaatgtgggcaatgttagaaagtcttataagactgtgtttaaatccagaggtgtaaagttttggcatatcacatcaaatatatggacacacatttgaagtattaaatgtagtctaataacaaaacaaattacagaatccgtctgtaaaccgcgagatgaatttattaagcctaattaatccgtcattagcaaatatttactgtaacaccacattgtcaaatcatgtcgcaattaggcttaaaagatttgtctcgcaatttacacacaatttgtgtaattagttattttttcgtctatatttaatactctattcatgtatccaaatgttcgatgtaacaggatgtaaaattttgccaggatataaacagggcctaatatgaaatggaggaagtatttagggcctgttttgttcaagaaaattttccccaaaaacatcacattaaatgtttagacatatgcatgaaacatcaaatgtggacaaaaaagaaaaactaattgcacagaccgactgtaaatcgcgagacgaatcttttgagcctaattagtcaatgattagccataagtgctacggtaacccacatgtgctaatgacggattgattaggctcaaaagattcgtctcgtggtttccaggcgagttatgaagttaattttctcattcgtatctgaaaaccccttccgacatctggtcaaacgtccgatgtgacacccaaaaaaattttttccccaactatacaggcccttattatccctgattctacttgtgcagtcagtagtgattctactagtgtcagtgtttcatctgaaaaaatgtcactgctttctcagagcaggtacaatagcagggtgtaagctagctataaccatattttaaagagataaaggaagagagaagagcagcgggctacagatctgtagccagctacagcacagacttcaagatataacgtgtgtatgacagatgtgaccaaatattaatagtatagtaagcaactattgtatgaattggttattacattagctatagatgatttagagctagcagtggactatactattaaacttgctcagtgcaggcagtagtgtcagtgttcctctgaaaaatatgtcagtggcttctttcttttcactggttagtgtcagtgtttactgtttactggtggtggtttcgtttcatgttgcaaatgcagtgtttgacttggcgaaagttctaggaacttaaaatgaactttcaccagagtggatggtaaacttatcccaaggattaaaatcctactctactcctataaaaatataaagcgtatttgaattgctttctactatttgtatacataaatagtgtgacactaaagtacaataataagaaaatgtttttgaatatgaatctaataacatcaattttacaaaataaaaaaatatgttctatagattaattgctaatgaaagtattgtcctaaagaaataaaatatcttatatttttattcgtagctgtcatttataagtctttaacaatttttttcgtagaagcgtcgcaagattttcaacaaggtagtttcactataactttcagctcagagaaagaggaaaaacaactgagggggcaatcgttatcttttccatctacattagataataataaagaaatatatttagacatacccttcttcaggtatataaccaaaagttgttatattttgataagaggaagtaataaaataactctatactattgcaatcgcaccattaatacataatacaagctgcgaatcagaattgcatcaaagattcagcattgttgcacttgaatgcactggcacttttactatcccatcgaaacacaattcaatacatgttggccttaaaagcaaaattaaagggctcatcatccgcatggaagaatttatctcaaataattaagacactccatgtgatggcacatcagtgagctagctctgacagtatatggtatgaatatcccagcaactgcacgcaaccaaaaaaagacagaaacaacattgatccctctactcgacattctgttcttgaagctatgttaaccctacaaggtaactctagtcggatgtacattttgtctacaagttagagcaagatacaatcatacaacagttttacagcatataccagattagatcatgaattacaacatagttctaacaataagtaccagacttgggctttcctctttagcatcttagcaggtacatcgtagtgctgcacttttttccttctagggaagtcacttgggagggaaccaaccaccattgtatagtttatctgacggattcggtgctggaggctggcatggtcgacttgggtaaagtttctagtattgtcaaaagaggaactaaaacaacttggtgaagcagaataatctggtgatggaggtttattcaagtcatggtgagggaagtattgttcaacagctgaagtatcatccagaacaggaatgtcacctctaagggtcttgaaggcaaactcaatgcatggatctgaccaggaattcccaaatagagatggcacagccagcccagacggataggaggctgcttcaggatgtggagctcgcgttggctgagcgggtgctgtggctggcacattttggtattcaacatttaacgcagagctcacaacaggttttccatctgtttgcatggaaaccggtaactcctgatttgcaacatttctccaaaagcttgtggcaggtgcttcttccggctcaggagttaaagagaaaccaacttgcatgatattattttcagcataatttggctgtaagtaatttgcagtattttccccattggcctgtatttgattcacagttaatgcttggatgaaccgtggctgatcagtggtgctatcctgcatagtttgtattttgttgactgtgtcagctcgtctaaactggaactgattggcagtgttatcctgaataacctgtatatgattcacagtatctgcttgccttgactggaagtgattgacaacgttttccctattggcatgtatttgatccacagttaaagcttggatgagatgtggctgatcagcggtgctatcctgcatagtttgtattctgttgactgtgtcagctcgtctcaactggaactgattgacagtgttatcctgattaagctgtatatgattcacagtatctgcttgccttgactggacgtgattggcagtgttttccccattgacctgtatttgattcacagttaaagcttggatgagctgtggctgatcagtggtgctctcctgcatagtttgtattctgttgactgtgtcagcttgtctcaaatggaactgattagcagtgttatcctgattaacctgcatatgatccacaatatctgcttgtcttgactgagactggttggtaatgtattcttgtggagcctccatttgaaatatggcgtctgcttggctcgacggcaaccgatcgacagcggttcctagatcaatctgtatttgatttgcatggcttacttgtgactctgactgttcaagaatgtattcttggatacgatgtatttcattgaaagagtctgcttggcttgactgtaaccgactggcagaactttcctgctctgtctgtatttgatccagagaatctgcttggctagactgcaactgacctgacatgttcctttgattagtctctatttgattcacagtggcagcacggctcaactgtgattgtgagtaattggtaacgtattcttgtctaggtcgtatttgaacaaaataatctgtgtggctcgactgtaattgactgacagcattttcctgatctgtgagtatttggttcacagtgtcagcttgtctcagctgtgacgaatctgtagtgtccccctccataacacgtatgtgattcccggtgtctgcttggcttgacagcaactgattgtcagccctttcctgaacagacgtcatttcagtggaaatgcctgcttggttcaatcgtgacttatcagtaggattttctttagtagactgtacctcattgacaagatttacaccgataagttcatcttcaggctcagtatttaaatcatgagtgatcttcagtgaagctaagcgaggtgatgctcggacaggcatggcaaccatttttgcagggacgattttatgcttcttgggcttccctcctgcacttggctgttttctttttctcggaaaagatttcttttcccttggagcatcaactttgtaggcatgtttttgagatgctatcatgccctccaactcgggcatcttttttgggttgttgagttctctatatggactgagctgttcctcccacggcagcatgagaccttctgaagttagcaattcacattgaatggccttgtcggcggtacctggccttgtatgttgcaacaatgttgctgtctgattttcacaaaatgatctaataagtacaaattgttgtgaaaaggggacatacaaaaggaaatttttgccatcttcaaaacacaactttggccacaaatttctatttaaatattttgttagtaatttttaggcagatctgcacacatgatttccatgtatctaaacgacaattattcaagactggagggagtagagtctatagtaaaattgaattcagaaggaatcagagttctttatctgatgtaatagtgcatgaaaactctgattctttacgcacgcaaagaggggcaaccaggacaaggagcagttgacacttcacatgtggctgatgtctgagctacaagaaacatataattactagggctggactctataaattttaaccaaagcaaatatgttcaatttgaggtgtgcatggtaattaagatacctagtatttttgtttatttaatgtcctgatagaaaaagcaaaatgccccagtaactcaaaccaagaagaactgcaaggaactcacatgagattggttttcaatagtacaaggatcttggatagttctctttcttggccttacaatgcatttatagatgtcccctgatttaagaaaacggtgcacatccttcagagagcgaaattcatatccactgactggatcaatgtagtactgcagagattaaaacaaggcaaaaataagtttaagacacaacattcctggaatgccctgaaggctttcattattaaaggatcacaagagctagcaatgcaacatgcattataaagtcaacaaggggaacagtgcccgcctaggctgacaaactgatttttcctgcttaggcagtcagtaactcgccttggtggctgttggcgctaggtgctggcctgccatcatacccgcacctagcaccaaaggtaacactgggcacgctaaaatgtaggttcaactgacaggagcacaggatatgctcatataaaaatgttcacgctatgaaatcataattgacatttcaaacaaagacatgcttcaaataatatcacaagtaacaccagcacccacatgtgccacggaagaggatgactaacaaatttggcctccttggaaatgtggcggttcagaacaaatgagcttattgtaaagatggtaagttaacctatggatacgacaaaagggaacttttgcaagaaacacacaggccctatattgcttttaactgcttttcttattgagatggtcgcatacgacagcatacatgcagcacctgtagaatatatttcttgggtggctactctacctcaaaatagaaccaagatgcaagtggaacaatattgctggttgcaattatattaggcatagggtattgttgctgcacaatattgagatgaatatggagagttgaaactcagcttagagttcttgagatattaagtgcaagtatccatagacatgctaatgactttggaccgatgcggtgattgtgctgcagtatggaatctggttctttactgattctagtaagatttagttgtcacggctccaaagaaatgagtgtttcaaacaacaattactcccaccgttcaaaaatatagtgtgtattaggtttcattaggacaaggctttgaccaaaaattactctgttaggatctcatttttgtgataaaaggcataatcataattcataagtacttttgaatacaaatctaataacatcattttttttcatataaattatactccctccagtttgcacatacttgccgtttcggacaagacagatgtcaaacttctaaacattgactatgcccttctaaaatatttacttcaaaaatatggacaccatatatataagattaatcttgaaaattacctcaataaaatcatatattgttgatatttgtacttttgtacatatattgtaatagaaaacagaggtcaaaattgttatttggagaccatgtccatgtgcaaaacaacaagtatttgcaaactggacatgtcaaagccttgtcctaacgaaacctaaacaccttatattttttaaccgagggagtagttcacagttagaatcaaataagcactttgaaccgagccttagatgtattgttttaggcagaaattagcaagaaaaaagtaacacattgcagcataccggatcagtcttcagatttgatccattcttccttggtctgtcctctttccaccatccatcaggaagcccatcaacaattagatcatcctttctttgaacctagcaatgaaataattagagctagttagatatatctttttcagataaggagtaagagaaaatggatcattacagcataccagctcattcttgtgatttgatacattcttttccgcactgttttctttccattgtccaccgggaagcccattgatgcatgcttcacccttggtttgaacctataatgaaataacaagtatattggtttagacagaaaggcgcaagagaaaaagggtcatgatagcatgttgtttactcggtttagatagaactcagcaagagaaaaaagggtcatgaatcatgacagcataccgggtcactcatgtactttgacccattctttgttagcatgccttctttccaccatccatcaggccccttcatgactggtttatcactattttcaacctaagaataaaataattataatgacaaagtgaagtgttttagatagaaaaggcaagacaaaaacaaggatcgttacagcataccagattactcttgtgatttggttcattctttcctggactgtcctctttcaaacagtcatcagacagcccattcatggcagcttcatccttgacttgaacctagcaacgaatatagagtggtcatcattgacatatatgtcatgttgcacttggaacaaatgaaaaggggtagatgaagttagaaatctgcataccataaagggctttcttctgacaagcccacttcgagttctagagcatgaactgtcactgtaatccatctggatgctttctctgacaagcccacttcttgttcttgaacatgacccctctttggaacccacaatgatgtttcctctaacaaacctgcttggagttgcagaatatgaaccattactggcagccacagtagtgtttcccctaacaagcccacttcgtgttttagaggatgaaccttcactgaaattcataatgtcacctcccctaacaagcccacttcttgttttagaggatgaaccttgatttaaacccacaatgccatctcccctagcaagcccacttcgtgttttagaacatgatccctcattggaatccaaagtggcatttcttctaacaagcccacttcgtgttttagaacataaatctcccacgttggaatccacaacgccatttgccccagcaagctcacttcgtgttgtagaatatgaaccttcattggatctcacattggtgtttcccctaataagcccacttcttgttttagaaagcgaaacctcattggactctacagtgctgtttatcctaacaagcccacttcttgttttagaaaacagaacctcattggactctatagtgttgtttaacctaacaagcccactgcatgttctagaacatgaactgttgctgtaatccataatgtttttcccctgacactttgtgttctagaacatgtgaactcctgtggaggttacttcagttcacaaggacctgttcaatcacaacaaaatataaataaataaaatttcctgaagccacagaagagaacaataaattcattccataaaatcaaaatagtctgatgatgacgatgatgccccattatttgtcaaggcccatgttttcaatttgtccgactaatcgcgattagtgtgctggccggtactaaggtggcttgattttaaccccgattagttggaaagtaactcgattagttgttattagtccctattagtcatcctagtcagtattgaggcgactagactgttttttccaatttaaacacattgctcagaactaatatttgaaaaaaaaaagctaaagaggtactgttacgaaaatactttgttcattaagatttgcagagattaacgatgatgataatgtttttggattaccactcaagtagagagaaaattagacaagctatatggtgcacaaatcataatttagtacgacagataagtaattgaggtggtcgcatgtcttagccttcataaggacattctttccatctttctgtgcccaaataaggaaaacaggcttccaagaaattgcaaccttctgcagccccacttagccttatctatcaaaaaagggaagccatactattaaagaaacaagttattctcctcgatctcccataaggttagaaatccagtgccactagtcacttaaaactagtagtccgcaattctttttttttcctgatgggcgcataaatccctacctattttccattggttcataggaaaaaactgttcatagcttaagaacgagcctcaactcaaaaaccgtgtggcacaaactattaaaaataacaaaaatatagctagtggcggacataacgtggggatattgggtggtgtggggcaaagaggggaaggcaatcggatccccaatttctctcttttcttttcttgagatgccatggagggttaacactatcacactacggcataagcttgacaaatccgcaatcaggttaaatgattcaccgattcagtggagtagaaagcctctcagcgtgccacaacacaatttcccccaaaataaattcaaacgagctagggataatcaccataagaaaatcacagaaatcaacaacgtccgggtggattcccccaactttacccgcgacgactactccgaggcggtcgagaggatataccttcgaggaggaggagtccgcggaagaagcaggaggaggagcacccgcacaggcacgcccagcggaggaacggatcgaccctccctcgcagcagcagcgggagaggaaaaccctcggaagcaaaccgagcggcagtcaacgaagggacggaccggagagaagcggatgaggaggaggaggaggacggggtgggggggcctcgccgtcgctggccgccgcggctagtggtcggatggtggtgcggccatggctagggttagcgagcgcgcgggggggagcgcgtgcgtggagagggggttgaagagaagaaaaaggagggagaccttttttttttttctttttaggcttagcgaagaagaagacgaggtgggtggtggtgaggtgaggtggtgacttgggtgagtgaagtgaaccagtgaggtggtgtggtggggcgccacgtatgcaacgttgaagtgtatgcaggctcactgttactctgatgaacccacttactgacagtgtgcttaccagaagtttcacaaaccaccggggccgaggttatcgcgctcggccctagcggtaagcatggttaccgtgttaaccattaaaaactgtatgaaaccgtgcaaaatttatcaaaaattcaaatcattttttaaatttatttgaatttaaggaggttatcgcggtttttctattaccgtacccacgcggtaaggccggtaaccgcatgcttgccgacaataatgtaaaccctggtgcttactggctgacacgccatgtttagtcgtcgtagcaatacttaggcttccttcgcccaagcaaagttcgaaactttctttcctctacgtttactactgcgttcgattgttgctttttaggctgtgttattctcccttttttaaactcacccctcttttttccgcgcgtatgttttttcaaactgctaactaatatgttttatgtaaaagttttctatagaaaatttactttacaaaatcatattaaactatttttaaagctcttttaggctaatacttaattaatcacaagttaataggtaacccgttttccgttcgggaagactaagccatagatgaggtacaatagcatactataaaccagctataaacgcatatcgaggagataaaagaggaaagaagaagagcggtgtgttacagatttgtaactagctgcagcacgggttgcatgaagcaatgtgtgtatgggtgggaccaaatatcaatagtgtagtacccctccgtcccataatataacaaccgtgttcgctagaggctgttcccaactagaacagtgcgcacgaaaaacggaacggtccattagcgcgtgattaattaagtattggcttttttttcaaaaatggataaatgtgattttgttaagcaattttagtatagaaactttttgcaaaaaaaaaacaccgtttagcattttaaaaagcgtgcgcgtggaaaacaagagagatgagttggaaaacctgagataagaacacaacctaagattggatgggatatttcatagtgcaataaatctagacaggaggcatgtctagattcgttgtactataaaacatccaatcatgttctaggttactaaattatggaacggaggaagtatatgtttatagataagtattgtatgtattggctattaaattaattatagatgatttagagctaataattggttgtactattaaacttctcttagaggtcagttttgctgtcacgcgaaacaagatagaccattattagcgtatgattgatcaagtattgattattacgaacttaaaaatggacttgtttaacttttttaaagaacttttatatagacaacttttgtaaaaaacacattgttcagtagtttaggaaacgtgtaaaaaaaacgaggaagttgtagcttagatttggagctttagagcagggaaaaatgatgcactcgttatcttatactccctccgtcctactacaagtataatataatacatacatgacatatatactacgaatttagacaggcaattgccatattcaaattactttgtgttttactctattctaggcggtgctcttttggaggggttcgcaattaagtagtagctacaaaatttttttgaaaaatggattaatatgattttttaaagcaactttccaatataaactttttataaaacatgtaccgtttagtagtttgaaaagtgtacacgcgaaaaacgaggaagatgggttgggaacccatgggaaagaacacagcctaacccaaacacctatatatctcaccattataatttctaaaaacttatatatctctaaccattaatttctaaaattttatatcgttttaacatcggcgctccaaggacagtggatgcaccaactgaacctgcctgctagccaccgtcggggctgtcggaggcgagtgtccttctgtgagcctgactgagatggcaccgccgatgcatgctcaagccacctacatgtacaagatgcttctgtatgagtagctagcaacctatcacactgggctgacaaataaaaaagatgggtacctgtgctgctgtgcggcttgcaaactcgcatagagaattttacaatgagtacgagacatcctaatcttattatcaccatgaatcttattgcaaaatgtcaagctgatcaaattctgacacaccagtggcaggcagcctagtacaagccgtcaagagttgttctcaaggtgatcaaacgctggtcgatctgcatgctcttgtgatacagaaagagcgatcgatctgacatgcccatgttttttttcctttttttgcaggaagatcaaggttcatgaggctagctagctcagtgcctgaagtgcctgacgccggtgaagaggagggagacgccgtacttgttgcagcagtcgacggcgtcgccgtccctcatgctgccgctcggctccgcgatcacgccgatgccgttctggcacgcctcctccacggcgtcgttccaagctgtcgttgcattgtaaggaaggcatcaacgaacacgaaaaatgtgattcttacaaaatgtgacaacattgcaaagctgttcttgtagtgtgtgtgacagaacgtgcaaggaagtaatcgttgaacatggtaatggtggttgcaatggtaaaatgtaattcttaaaaagaaaagagaagtatttcatgattcagaacctacggatgctggtggcttggtcataaatcaaacataaattcaactactactgatcagcaaatgaatgtttcagaacctacatatgctggtagcttggtcataaatcaaacataaattgaactactactgatcagcaaatgaattggctcagaacctacagatgctggttgcctgggtcataactcaaacataaatccaactattaatgaagtttgcattatcattttgttttgattgccactatgttaatgttgtgtgcaaacaaattcaggaaattatcagagtccagattttccagtaatgcaacatttgttcttaccgaatgggaagaatgcatcactggccaaagcagctcctttggcctcctctcctgctttcctgaaagcaattctcagactctccagtctgtttggctggccacttcccatgcctaacatgcagttattttaaggataatccacagcatcatgttagtccaccaaatcaacaaattattttgttcatgtagcagaggcaaatatactgaccttggctatcacaatggcgttactctttacgtgctttacacaaagccaggcaaatttggcatcagagagctcactgtcttgaggagctctctcggacactgttgtgaaggtgatatcttcaggggttagatcatcagactcttgagccaaccagccaccactgacttgcctgagtgatagcatcccttttccacttctcttcgcctccagtatcctcaatgtctttgatttccctttgaggatctcaagacccttttctgtatagccgggtgcaacaacaatctcgtagaacattcgcgtctgtccatctgtagggctcctgaattcacggatttcttttgcaagatcctgaaacatgatatagtgtgaataatggtcatgcccaacaacacaagtgtttagaggcaagaagtctactggatacctcatcaattgtcgtattgaaagcaactatcccaccaaatgcactaacaggatctccctttacagccaacctgtatgcttcaagaatatcctgtcgggatgctactccacatggatttgtgtgcttaaccacaacacacgtaggactctcaaactctgatacacagttccatgcagcatccgcatctaagtagttgttgtaagacatttcctgtaacagaaaatgtcatatgtaaacacaagaaacgtcacattactggtacaacatgagttcgcaaagagtggaaatggccagaaacaggttatatgtactgaaaaaaccaaatactaaagtcagataaacatgcaagtagtaaaaatcaagttgaaagagatatttttttgtaagttactatccgtgtttcattttagttgaatgaaaggaggcatgattttctcaccttcccatggtgctgaattgctgttgcaataccaccagcattaactacagaaagactcttgtccccatagaaggcagctttttgatgaggattttcaccataacgaagtgtagatttcagggacaggggcacggtgaagttcggggggaatacatctcctacatgagaacatgatagtgtaatgatatctgaggaaatgttgacaaaaccatcatatataaactagatcattacaaaaagttagtgttaatacctttgttcgattgcttccacaaccattctgagacagctgaatcataagaagcgacatgttggaaagctttccatgctagcatcttgcggaattgctggtcatcttgttttccttgcagatactctaatagagcagggtaatcttc

SEQ ID NO: 7882 - DNA, 286 bp, Oryza sativa
tctccccatctcccatctctctcccctctgctccctccactcccgcccccatgggcctaacgtcggcggccgccgcccctattccctttcttccccaagacagacatcaccgcggctcgcggcacccgcatccgcatcgtctccatcggaccgcagcacaacaacgaggtgcgccacgttctcccggtcgatccacgcatggatatcgctggcgacactgctagcccgcacgcgcgacctcgaccctgatccggacaggtccggtggcggctctgtcgacgtcaca

SEQ ID NO: 7883 - DNA, 537 bp, Oryza sativa
attattaataaaaaaaataaaaaaatcgattgatgttactagatttatcattaaacaaaatattataatatgtaactctttttatttagaatatatatagatgtatgtcgaagaccatatcaaagttaaaaataagtgttctgagacggaggaatatattgcatataggacgtcgtacttatcagcaaagaaatgaaatggatggacggtgatcacgtgttgaccagacctgacacaaactcacattcattactgttacgcgtctccacgtgcctcctctccctccaccggacctcatatcatatttccttcccttagtcgccattttcttcccatatccacgcgccacgtggacttcctgacgacggccggcgacacgtgaacccagaaccttccccaacgatctcattctcttgctgtcttgcgtgttcatgctgccccgcgggcgttgagtttcttctctacttcctccgtcaccaacgacccatgcatatctatctgatctccacgacgcgcctaagcaatccatctccatct

SEQ ID NO: 7884 - DNA, 1467 bp, Oryza sativa
gctcctggtctcttcttgcaagaataccaccatgtacacttgggtgcaatgttttaactctaccatcaagctgaatttaccaaatgtgaaccattggataaaatgaaatttatttgcagtcagtgcaaacatatctaattaagggacaaaactgagtaaccaacaatgataaacgatgctaggaagcaacatatatttcaagaaatgtaggagtaaaataaaaattaggttataccatttcaggaaaatttgtaatttgttcaacttttgtaacattaactccagctgcttccaggcttgatgctgtgccaccagtcgaaataatagaaaacctacagtagcaaaatgtccataagatgatcatatactagattgaaaaagaatcaacagtagaaatctaatcatggttcatcctttataaaatcatgtttcgttatcctgatccaaattgtcagccttaaaattatgcagctggggaagataaactgcaagaagcttattatggcgaataaagcctaactttacaaaagggcaaatatgataatttactactggtctactgcttgatataggaatttgatatacaacaaatagttccatggtgatgatgagagaagctttaaagcacaaaattcaaatattctaaagtgaacttgacagcaaaaccacaactgttaaatataaaaccgaaaaggggagcatcccacaagatgaaaggtttaccccaaggcttgaaggccattcccaagataggccaagtctgttttatccgacaatgatatcagtgcttgtttgactcctgctgtgttaggaacttattattagctcacacattgaaatatatctttatgtcaagaatgagaaaacacaaaaatcaatgggcgtatagaaatcaacaggagtacagggccaaaattgatttgttcaaaataaatctaatcatggttcaaaataaactataataagaagcttattacagagaataaagcctaactttgccaaacagcaaatgataagttcactgttcgatataggaacttgttattagctcacacattgaaatacatctttgagcatgctgcatgaatctactctttgagagaacatagaaaataatgggaatagaaaaaacaacggcaccaaatttatctgttcaaaacattcaaccaatataaacagcgcaacaaatcaaacatatctacatggatttctggatggaactaaaataaaccagtacaaaaggatctcaacggaacatagtcatcaactagaatatggcgtgcaaagtgctaaattttaaaattcacacgtatgaattttatatcgaatggtattatacaagaatataggcattgaaacaccaaagccaactaactgttgttaagcatgctgcatgcatttaagcatttagaacacacatatttgccccccttaaaaaaattatactccctccgtttcaaaatgttt

SEQ ID NO: 7885 - DNA, 2363 bp, Oryza sativa
gcctccttttctcgggggcggattttgttttgtcgcgtatctctctccctctgctctgtgagtgcgtgcgtgggagataaaaagggtcgcgatgcggtttgatgggctttcttttcgtagatgggccaaacacatggtcccaagatggaccgggccgatttatgagcgcacaaaggaataagtccactttgactcccttaaaagtgacccgaatctaatccgtgactctcaaccgtaaaaccggataggacgactccccgaattattgaaaccagtacaatttgactccctcagcggttttggagtgtggttttgctgatgtggcgctgacgtggcgatattgacctagtctacgtctcacgtagcgcttacgtggcaatagaataaaaaaaatctatgggactcatatgatattcacacataaaaaatattatgggtcccactgattatgtgggacccacatgttatcctctatgttcctcttcctcctccctctctcccttctctctttctctctcttgggcaatctgtgggcaggggcggcgacgtcggcgggcgagggctggagcagcgtcgggctgcggctcatgctactaggtacgaaactggtcagattttagcgtcgcaacgaaccagcgttccaattagcaagggagtagctatatttatggcgccatatttttcataaaaaatagtcggcatgcatttacattgtaagtccctaaattacatatgtaattttagtgtatttacaatgtaagttctaaaattacatatgtaagttataaaattacatatgtagttttagtgtatttaccatgtgaattgcaaattacatatgtaagtagatataaatagaagagatgctagtgcaaattcaatgggaaactaatgtataacaggagcaacatgttcgtagtacagagagatcaaataactacagacttagcaaatcaaacgttcgttaagtcaatcattaacagtgcaacatgaatctacatgatatccaagggtcagattaaccgactgtgatcaagctaattttatgtcgccataaatatagcatgtccgaattagcaatcatttgatttgattggtcaggaggtgctactccatttttctacattaacatcgagacggtgatcatcaccaacatgaactactacccggttggctgttgccagctaccacttcgacctgagcggcacggcgttcggcgccatggccaagccggggctcaacgacaagctccgccactccggcattatcgacatccactttaggcgtgtgccgtgcaactacccggggctcaagataaactttcacatttaggaggggtccaacccggtgtacttcgccgtgctcgtcaagtacgaggacctcgacggcgacgtcgtgcaggtcgacctcatggagtccaaatcggcgtacgggggcgccatcggagtgtggacaccgatgagggagtcatggggctccgcattggcagtgacatcggcaagaccctttgtcaccaacaacgtcatcccagccatctggtctcgaatcgcgccatcactgcctccgtcaccccttccgggccgacctcgttccgcgctcgcccactgccgcgcctctcccgcctcggtctctccctctgcccgcgcctccccgacgccaccctcgccgcgctcaccgccgcaccgtccatctcgcagtcgacatctcctgctctcggggattcctgctgctgcgcttgtcgttgcatgcccgaatctgaatgatctcgacttctccaatgaccactatggctcgacctcaggaatgcggcggcggcggaggtggccaaggtgcgtcgcctgcagagggagagaccgaggatgacatgtgggcccccacatgtcagtaggacccacaatatttttttcgtgaataatagatgggtcatacagatttttttttttaattctaatgcaacgtaagcgccacatgggacctggactaggtcaacgtcgccacgtcagcgccacatcagcaaaatcaccctccaaaaccgctgagggagtcaaattgcactggtttcaatagttcggggagtcgtcctatccggttttacggttaagggtcaaggattaaattcggatcacttttaagggagtcaatgtggacttgttccgctcacaaaatgctaaaaaattcacaaatatttatcccttcaaaaaccaaattggctgtgttcggctgggctagctgctgctacaattgttgtgacttgctggagcctgctaatggcctaagacccgctccattcccaatccacaccacaacagtcagatcaaatagttcaaaccaacccaacccgcaaatctcctttcagaacccaa

SEQ ID NO: 7886 - DNA, 10948 bp, Oryza sativa
cagcttgttaatcgaccaggaacatgcaccgtctgtcgccgtacttccgggcgaggcctgcgcgcggcggcatgaacgctcgtaagcgtgaagcgtgggtgtacgtcgccaccgtcgccgccaccaaagctgctggagtgggtcgtccacgactatgagacctgatctagtctgtttagttgaaaccattcacaatccatgggttcaatctatggactgaatccatgttgtactcagaaaatcgtaaccatcaccaaaccaccccaaacctcttttctggtggatccaaaccaatcttcagtccaaccaaagcacacccagatacaaaaccaatccattcaacccattacttgctgcagttggctgccggtttgaacagccgcagccgcagctagtgcctccgaacaagtccattataagcaaaattaatttttcacattttcatgcaactttcctcgaatctctgccatgatttgcatgattttcacgtcgactagaaaaacaaaataatgagcccatacactcaagggttcacctttctgattgagcgtaggatctttgatccaagcgatatgataattttcgtcaaacttcaagaaacttctactctctccgtccgtgaatataagagattttgatattttgtttgcaccgtttgaccattcatcttttttttggaggttattcaaaaatttttgaaattattatttattttatttgtaacttactttattatccaaagtaatttaagcataatttttcattttttatatttatacaaatttttttaataagacaagtggtcaaacgttatattagaatagtgaatatcccttatactcacggatggagggagtatataatctatgtcgaatttgttatttcaaaattatattctcgaaaaccattcgaaatttccctccgaatcttctcccgttccaggtcgaaacctctaaattcgatccaattttgttaaaattttcacggtttcgaatcggttctcgcccaaacaaaaaccttcacatccacatccgcatccactcccagcctggccgaggaggcactgcgcggtgggccccacatggcagcgacgcccccctgaccccactccggaagacacgcgtccgctccacgagtcataggcgaggtctcctccctttttccgccgcgcgtcggccttttcctccttcctaacctagggctccgatttcgccaggtgttgcccatcgtgaccgtgccaccgccgccgacgtcgccaccgacaccgccgccgccaccgccaccggcacctggcggtaagcgagcggcgccaccctaaccctgaccccgtcgtccgtccggggtcgtcgggttcgttgttgattctattttatttatttttttatctcttctcttgcagttgtgtggggttttgggggggttttggcgatggagatggtgatcggtgcggttttgctttcctcgtgggggagggtttttttctttttttttattctgtggtttgcgatggattggtggtgatgttgatgttggaaggacgattttttgctcgttgatcgcgattccccgcgcactttgtgtttggatcaaacagaggcgggtctttgccctcgtactgttcgttcaccattcgctcgatcgacagaagaagaaaaaaagaagtgcagaaagcgatggatggaggaggggacaaggcagagacagagatagttctcatgtttcacttttaaaaaaaaagtattttcttttcctctagtggtgggaatccaattaatttcaatttcgatcgaaagtacacaaggatgatatgatcggtctttgtcaatcactaatcctgaacttagtcgtaaaagtatctgtttcgagaaatagaaaaaaaaagggactttctttcgtttgttcgttcaaaaataagatttcctttttcctggattaccgttcgtaaattcacatcgcttttgctttattcgaacaccaaactttcttaggttgaacagttattccatcaccttctctgcatatattgtagtgttaagaactcaagaggcatatgtgcaggttattaaatatgcctgttgaattacaattgcacagaacaaagcatatctgataaatctgttaaccagaatgagactatgagtgattttgtcacgtaggctaatgcaaaggtcatggattgtgcatggttctcatagtagctagtcaatccactagtttgttggaccagataatttatttatatcatgatgtggtgccctgtgcccacaccacatggctacatgtgattctgcacttcttcatgctccacaatgctgtatgagcacctgaatagctctgctctgcgccgctgcacgccatctgggaggcctacttttcatgcttttcactccgcaaaaactggcagatatgagtgatatgctgaattggtcttgggctgtacactttctctgacagtacaggtagagtttcatttgtttgtggattgcttgatgataaccaatggagggctcctgttgatccatggcagctgctatctttctttcattgatttctgccggataggactgagccttttctctgtgtgcattactgtagtattagtgtggcatagactgttattttacttatttggaaaaaaatggaggatggaacaatgaaatatattcagaaatatcactatttttgtataccgtacatttaatgctgtagcatcgttctgccttcatattatatatcgtagtttttgctcatttggtttcttgacttcatttatcactatatatcgaattatcactatcctgttgctctcgtagctggaagttgtaagcttggagtagttttatatagtaattcatgcaatacattgttggttagtctgtttacacattttccctcaatttctggaggtgcaacatttttcattctggatttgtgaagaaactggactttagtcgttttcactcacctgttatcatccttactgtattgtagttctaatgtttaaatttggacattgctgtattgttgaactgactagtttgttttccttctgtaaatgacagatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggagacgctgcagaggagcgacgtcgagccggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatgagataaatcacattctgtgattacttattgtcgtagtgtggtttggttagcttgagtttggttggaaaaactttttttttccgtagactgtttttatgtttgttttgctgccttctggtagcgataggagggcgatccggtctgaaactgttggtagcattcatgatgaatttctcagtggttataatttatgaatcttagtaacagctgttgcaagaacaaatatttcctctggttagaattgttttttaatttccttttcttctttggtccggattaactgtatcgacgaaccattgaattatcatcggcgatatcttcctaataacgctggtttcgtttaattccgattaatggtttaggaaaaacaacagaaaagattaatggtttaagaaaaacaacaaaaacaatagtgctgaccaggttcaaaaacggggacagcattcgttttcgatttatcaagacagcgtttgctttgctttaaaaatgttggtttgcatacataggattcaacacaatatcaaaataaccaaagcatcaaggtcaatcggcaccatatcagaagcattctactatttgaaacccaacagtttacaagttcatactgataggttaagctgacagaggacatggattctacagcatcatttcagtatgaacttgaaataagcatttgaattatgcagtccttttctcttctcctttactggttaggctgacagaggacatggcatctacagcatcatttcatactgacaggggaaaaaaatgatgaatgaaccttactctagaactgatcatttacaagttcatctaggcctacacacagcagaatgtcacacctgctcactctcttgtcacacctgctcactctctgaatcagaaaccaaagaacaaaaaatgttcatatatagtatatctggcctacattgagaagactttcatggggaacattgaatatcacactgttctccctgcagatcttcctgaggaatgcaaacacataattcacagcaaccttcttgatgatccctgaatcagggcgcgcgtgaaccacagtgttccccaagatgtgcacgacaccagcgtccttgcaccggttcaggaactccaggttcaagaactccagttcatcgccgaacgtctggctcgagtaccttgtcaggctgttccctcttatgggtgacttggctggaacaatggagtcctgtgatgagtagctcaggtcaccagtggagcacattgtgttgctcccagcctttccagttagcagcagcgcattgcttgatccctgggtcttctcctccatcatggtgaagtcttcggagtccgaatagtcatccatcatgctctccagcctgacgaagagcaagagcctgtcaaggagcatcttctcgaagtcgtcatctctcttgtggatgtccttgtacccgtacctcgcgacacaacggaacatgtggaagttctttggcccgatcctcttcacgatgaacctttcttcggttgggactgtatatactgggaggtacttgacacaaacgaagacgacgaccgagtggatggcagggaggttggtgatgaaatgggagaagatatgaggcactccacttgccagctcggtgtacacgaagcctatcccaggcaccctgacgaggccgaggcttggtccgagtcctaaaatccaggccatggaaaccttgctgtgcatctcaaattcataccgcttcacggtgcagaaatgccacacatacatgatgatgaagcaggtagttgcaacaacaagtggaacccaaccaccttggtcaaccttgttaatgcaggctgtgaagtatgggagctccaccatcaacgagagcacgataaaaatgacaacaaggatccagtggcttttccatactaacagcattattgggaccatgagaaatgtcgtgaccagcataactatcaccactgcagttcctgttcaacgacatcataagaaaacaattagggtgacatctatggaatgcaaaatgcaacattaatgttcggtttgcagttatattttgagaacatcagttgtcaatttgcagtgtcctaaaaaaattgcatcgcgctgttttgataatgttctctatcagataatgctgacccactttacttcttatagaaagataagctcatttaaaacctgaagcatcatgcagtgtggtaagaaagtttatttaggatttaattattatccagctatcagttctcaattatattgcttcttttgtaccatagcaccagtcttttagaacctagacttggtagctgacaacacaccgcgcacatatcgtgacataaagctagaaaatacttatggaacaatgccaattttgttcggcttaaaatgaaaactatctgaagctatcccctattcagcagcagcgtaaaaaactgttgattgtctactttaagtgcattgaaagtatcagttacatgtttggagatggaaaagaaaagcttaccatatgcatttcctatctgactttggtttttgaatccagctgttactgcaatgcaaagaatcataagtacccagttgatgtcagggatgtaaatctgcccgagaaatttctttgaggtgtggacgacactgactcgaggaaaacagcccagtgcgagagcttgctttattatcgagtatgtagcagatatagtggcttgacttgcaactattgctgcaagagttgcaatgatgaatactggccagtatatggtatctgcagcaatcaggcatcacaccatgagtacataaatacatatagtgcatacagcactggtaaacaataagaatggtgggatatgcactttgccaagttgcacatgggatgcatttgcattttactttatgacagccaaatttgttagttcagaggggcagggacctggaatggagcgataaaaggcatcaactacatggtccttgttgctaataatgtacgcagcctgtccggtgtatgctaggagaaggcaagggaacaccactaacgtgaaagcaatctgcacagacattattagtttaccgacacaatttatcatgactgatttgtttgaagtgtttatacctgaatggccaagacagggaaatgacataagtcagcatataatgcttcagtccctgaagagagaaaatatataagtaattctgctgtatcttgtgatttatgaataatgcaattaatcaatgaaaggtacatgagaattgtgagtaacctgtgatgctaagcatgattcctccaagggaggtccagctctcagacttccctcgtcggaaataccgatagatatagactggattatatgcttttaggactgaactgttgtacttgtgtatgttcagtgccccaatagtcccaattaggataaaccaaaggagcactataggtgcaaagagccatccaactttatctgtaccatagtgttgcatgctgaataagccaattagtatgatcacagcaacgactacaaccacatctgccaggtattgaagcaataaacatcaaatgattttacaacaatgggagataacactacatagggaagaaagcttctcagtaaatcaaaggaagtgaacaatgcaacatagtggcccaagatcacaatatttgcgcacacaatatttaagataccgttgctggtttctttcattcactttggttaagttcacatccctgtatactagttacactatgttaagttcagttaagaattgaccagatttggccgtgtacatccttttgggtgtagaggccagattttaatccattttttttaaaaaaagagataattgaccagatttgacaacaccaatataaaaatacaaagagcagaattacctgtactcatcttctgattctgaactcttattccacctgatgcagagagaactgcagagcaaacaagtgtcacaatccaagttccaatcggttttaccaatgaaactactatgctgaatacctgatatagcaggagtaaggatcccatctccaatggctgtgcaggtaccaatgagaactagaataagaagacagttctttttatacacatgtccctctagccatctctttatttttgctgcaagtgaattctcttcataagtttgccgactatatgttgttaattcttcatctgtcttatgttggttgggaatagtgctgacctttgcatgccggcaaagtaaagaatagagagcgaatgtgccacctgtgaaaaaagtctaaaatttattatctaaaaaaatgtgcaaaatgcaaacaaactactcctatgtcaatttattgccaagtgactgtcagtaactgttctctgagcacaaaacggaatgaactcaggacatcaccttctacagatttcatgactagttcagtgctatctaccaatcattctggcatcactacgacaatgttctgttatttatgtgccaacctatcgaaatggtaaaattgcataatatttctatattctcatctcataccaaaatcttgttatatttgactaacatgagatatttcctaactgcatttttctattttttttcagatgataagtaaataaagaagcagcatatttggttaaacattggcagaatgtgatatctcaccttggccattatcatttgcccgcaagacaacaaaaacatacttcatcagaggaatgagggtgagggtgtaaatgatcaaggaaagagccccaataacatcctcatcatcatcgaccccatgagggaatatattgtagaagacatataatggagatgtacctaagtcaccgaagacaacaccaaggctctgaaacgcgagccgtaataacaaaatcgacgagaacttctgcatgaacaaaaacaaagcacattttagctccccatgagctaagaatatgatatttacgcattgccaaaatgacatagggagtacattatctttccacaccaacatcacttatgctgccagtgcctaacaatttgaggtgaaacgaataaagatactataaaatccgtatacagttcctgcatttggaaacctacagtaacagcacatccatcatacagtttcaaatcctttttatattgaaatggtccccaaaaccatgaggtcatacagaatcatccatgtcaaagaaacaatgtttttttttcttgttccaaatacaagcagacactaagctggaagcacgattgttacccagaaaaatatctagaaaaaaaatatccccatgagcaaggatcaatctctgaccttctctgtgtacatgttcttgagccggctagcctcctcatccatgggctgatcaaggttctgatccaaatcccatatgctcccatggttcgtcgtctcgctatccgaaatagacgccatgggtgggtctccttcaacctcgaatcctcacacgagggaactctccaagtggctgaaagcgacctttgctcgaaccagaaatggaagcttccagcttcccaaatggaactccagagcttctccaccgaagcaaagatcaaccacaactcgtagaactctctctcaccggaaaattccaacccgaatcctcaaatccaccaccaaaacctcttgtcactttggtctacgcaaaggctaatcttcgaagagataatccaagaacatgagcttgcataatccaaatcagaatgccacttcgaatcttgacacttaaactctttccaagatcgaactccctccctctttgatccccacaagaaccaaaaacgggagctttggtacaggagcgaagaaccaataatcacagctaaagaaaaataatctccaaatcagagcccagaaaatcggatttgggactgattgggcgagctacccggaaatatcaaccaagaaaacctcctctagaaccaagaaaaccaaccaaaatctcaatctttcctccccaaagcctccccaagatcaagctttgatgccacagtcgccaccaacagcacagccgccgaggtgggccgccgtccaattggcaaaagcgcagaaatcttgacagaagagagtgggaggatggggaaaaaaatgagaaatgatttatggtgcggagagagagagagagagagagagagagaggggggaagagaaggcaatatgcagagtcataaaagaagttgcaggaagagcatatgcctggactggatggtagtaggtggaggagcacacaaattggaattggaattgaaattaggccatctgaattgaaaattcaaacaaaaaaaagagtacctttttccaaccgaatttcttctgaaatcaaaagcggcagtcaagttttggtgctatggaaatgagaagtaaacgtttctctttggattcttgcccatgagtgtgtactgtctttcctcagctggcaagtccctggtcctgccactgctactattgtactagtaggagtaatcattttattatgttggtgattgtactgttgctaaatttgtttattccttcatctcagaagaaaaatgcctttgtttattgatgagatctagattttgttcttgactttgtttaagttattctgtttgttccccacagaactatctaggagtagtccctaacagtagtactaaggtttagagcagcatatgtgctatattatggccctgtttagttctaaagttttttttccaaacttccaactttccatcatatcaaatctttcatacacacacaacttttctatcacatcgtaccaatttcaaccaaacttccaaacttcagtgtgaactaaacacaaccaatatcatttccttacagataaaaatgttcagtaaaaattagatacgagatcatatcggtaataaaaggacaataggagtaagaatttatacattagagattttatctcaaatcatattggataattaaaactagatgctggaggccaagagttgattttccccattattaggctataatctttaactcaagattcctaacctctactcccttgttaccaatgcacacgttatagaaaagttattgtaaaagatcatattaatctatttttaaaatttttctaatctaatacttaattaatcatgtatgaatccgttgctccgttttacgtg

SEQ ID NO: 7887 - DNA, 10680 bp, Oryza sativa
aattatctcgttgcaaatattgactagatacaaaccaatacgcaagcatgcaacctatgcaaaaccgtcttcttggcacaaatggtaagccgattttgtctttgggtgcatacaagaaaaagtaaagtacaaaacagaaatgaagcattcatttgctcaactacaaaattcaagccagggggtacacaacctcaagacacgtacggttgagaacttgagacaaaggcagaacaaccacctcattggcatcatcgatgatcgatcgatagcgtgcgacacaaactcatgaaatgcagaaatgtgtgtgttgtattgttagaaaatgacatctccaccatcgattttaatttattagaaagatatacacgccatatactcttattaagtggttttacgagtgccgatattaactacaacagtatatatatagatcacaagactcatgaaaagcatcataaaatagggttaatatgtttttctgaaattaacacttatatatagcaattgataactcgggcatccgttgttatatcggagttttccttaatttacatgagaattaaaccgcttctaatttattaatattaattataaagatgcatataaataatttgttaatcgcgaatttgaagatgattctggcgttgttcgcggcgcctgtgtaccacgcagccgtcgtgtcacagccagctgcttctttacgcaaatgtgacagccgcagcagctgcctagtgcagccaaacggccaaacacatgccgtatgtgcaattttattttacttgatcaatcagaggcatgcaaagcatgtgtggtatatatatttgagtaaattaaccagctaacaaagaaattttcttaccgtatagtcattatcctcctctgatatattgttaactctagctataggtttctaggcttctagctaaacttgtcatattctttgtttcttgctagtaatggatatgctatttagatcctgtccacaatgcttgctgctgacttgttgagagttgattatggaactatatatatataatcttataccacactacattactactaacatttagtaacatatttaactgagtgacaacttttgatgatagtcaaatcgcattagaagaagaaagagatgccataaattaattgccactactgtagacaaggtacagcgtctctatccaagctgccaattaattttaagagaaaaccgaacgcatgcaggtgtgtgatcacgttttactcgatcggatttataattttctattctattactttaaccctctacatatggattggttaaccaaccgaagatctcgattaattaatagcatccataaagacaaaatctaaatagtatacataagcactatttaatcttaacgggtgcacactttgctacgtaagaaagtgccacttattatacaagtacatcaagataaatactctctccgaccgtttaacgagtgcacattgttctaatttatgatccgattacaccattatattcgttgtaataaaacatttataataagatctcacataattatgttctaatgagaaaatatatatgctataaattatttttatcatatatataaattactcttagatttgattaaattacttctgagatagttatgaaagtaacttcaataaaacctaaaagtaatctacataaatcataaaagtaactcaatacataataaaagtaagctgtcacgtcactaaaagtaaatccattgtggaggaaaaacacaagtctatcaaaaaactaaatttaatcatcatagattatagagctaactaaaacaacaataaaagtaaaaactcacaatattatgaatatctaaggagtaatttaattaaatctaaaagtaatttatatatatgataaaagtaatatatatatatatatatatatatataatatgtaatttattataaatacttaattacaataaataaaatggtataatcgggttgtagatccgataaataatttaaattaaaattgtatatgaagcttatagttattaggaatcttttctagtctttactattatatggatactttcacataggaaagtgatgcatgttatattttggtaactaattaagactaactagtgtacatgcacttcttagtggcgtccatctataaagctgtatggaaaggaggataaaattggagatgaaaaaagggggcaaatagtacttaaactgaaaggtattgtcttttttttcccctaaaaatactatttttagcttcactattcagtatcatagctaggaagatagtctttttaagaatgaagataatacaagctagacagcgaaatgtaaaaaaataagttccaacctaattcggcaacatatggacttagaatatatatatatatatatatatatatatatatatatatatatatataacgagtttaatgctctaagcatgatgctaattaaggtagcaacttagttcaatccgatccgggtaactttacattcaataaatgtgtagtgtgtagatatttatcttgctccccaacatataatctttattattgtgttgttacttttgtatggatatattagttgtttaataacacattgatgtttgaatcctattgtatctgtcactgctgatgtgcgtgtttcggataaaatgtaatgccaagtcatcaacggcgacatgttgcggaaaaaggttaacttgtttgactaaactaagataaagtgagagctcatatgaagcactatagacaaaaaagaagtttcaacatcttgtggatatttgcatgattgagcgaaaaaaatttcttaaaaatcatggtgtagtcttgaggctgtatcttgggaagttcatgaagacatgcaaccagaagtaaaatcaggggggcaaggatatgtatataatattgcaacgagaaaaacaataatataaacatgattaattaaaaatgagaagttatgcaggggagtgcctatctcaccttaaggaagtggctcttcgaccatccaataaacctttttttttggttctcaaaaaaaaataaaacccttttttttttttttgctatgggtagaaatcaaatttgtgggggcgttttgagatttataatagcacagcttgcagataaactccaagaaacagcaagtccatgaagagttgttctgatgcatatctcatgaaatatatatagctacttctgcgtgcaatttattcacctattttttatttcaatcaattacaaccttcgttcatttaattttaccccgctagctactccctcattcccaaaataagtactctctccatttcaatttataagacgttttgactttggttaaagtcaaactacttcgagtttgactaagtttgtagaagaaaataataatattttcaacccaatataaatttattatgaaaatatattcaattactgatttaatgaaatgaatttggcattataaatattactatatttgtctataaacttagtcaaacttgaagtagtttgactttgacctcaaaacgtcttatgacctgaaacggagggaatatttctagaaactcaaattttgtatacatttataagcatttcttagacattaatttaaatgcatattcctaatttctatttcctcgttttctgtgcgcacgctcctcaaatcgctaaatggtacattttttaaaaaaaatacataggaaaggtgctttaaaaatcatattaatcttttttaagtttgtcaaggttacggataaggtataccctctatccttggatatacggtgggtaccgatacagtatacccgcgcgtgtacgaatagtttccgtatacattaaagaaatctatcccgtgatagaaacggaatctacggatggaaggactcctactcggacgagactgggtctttaccatatcgtgaggagtccgatatctccaagtcctacttggagatcaactgacccgcggtataaaagggaccccctgggtaggacctaagacatcgaatctcaccgccaacacacccactacagcctgcgaagtcggagcttacaggagccaagtcgccgggagatctagtcggaccaactcgactatggtctcgtcggtattatcgagttcttctattccctttgtaatatgtggtttccatcatataatcacatatcaactggattagggctattacctgttaaggggcctgaaccagtataatccttgtcttttgtctgtttgatgtcgtactacgtaaatcctcgtatcaacggaccccagtaccctctatatccggtctacgggtatccaccgtcgacaaagtttttatagctaataattaattaattatgcactaataatccatcccgttttgcatgcatgggagagaagttcgcaactttctctggtaaacaaacccttaaatcttttttagggaaattaagaagcctaattcttgtactatgtattagacaaaaaaaaactttattccactatctaattaagaagtcagcggtcttgtgcccatgtatagaataaatttcacaaaatatctatattttggccaattaattagaaaattacaaatttaagtcacaccataataaaactacaaaatcaacactaaatttatcataaacttcattttagttaatgaatgtatcctaaaactacttattttaagtttagcattcgaggataaatcttagaaaaaaataattatggcaatacattaccaatcttggttaactaggatgattaaccaaaataaatctaaaaaatattgttatgacattcgaatgcatgattaactgtagaaaaactgttgcataggcagttaatcaactagaattcttattattacgaccatcaatttgactagaactatgtaatagtccgtacataatcatggcagacacataaatatatccgtgaaagatttgttggtagacgaaacatcatcaatggaatacccttcaaattagcacaggtattgtgatataaagtttaaaatttgtagtttagcaataatctatagttttgcgatacactgcttcactatgttgttttgagatattttctatgtttaatctgttcttttttgcaatttagtgacttaaatttacagttttatgatcattgtcaaaaggccgtatttagttccccctctaatttttttttcgtatacggacacacatttcaagtattaagcgtagactaataacaaaataaattacagattccgcctgcaaactgcgagacgaatttattaagcctaattaatccgtcgttagcaaatgtgtttactgtaacatcacattgtcaaatcatagcgtaattaggctcaaaagattcgtctcgcaatttacatgcaaaatgtgcaattggttttttcatctatatttaatacttaatgcatgtgtctaaatatttaatgtgacggaatttttgaaagtttgaagggaactaaacacaaccaaaatctctatgcaattgctatcaagtagttgggaactaaacacaaccaaaatctctatgcaattgctatcaagtagttggggtgtaaaggacggtcctgtctctgaaaatttgcttcctgacaataagacagttgggccctccccccacccccacacatccccactaacatattcttatagtttgttatttcgtaaagaaaaattgatgatagacaaaccagtctttctctgccctcattgactgctaaaccaacaaggatgacaggatatggaagtactccctagcatcccagaaaattgtaaaccctagtatcccaagaaaattttaaagagagaaacaaaataccacaatacctttaattaatgtgaaagttgtgtattgatgggtagatgagaggtattgaagtaatgaagttcctcattttatgaattggtggtagataagaatatagaagttgatttattttggaacaaattttaaactctagaagttggtttattttggcacggagggagtaattttgtaagggatggtgaagagatagggtacacatgatttccttcagtcgggtgtactctatctgtctcagaatttgtacgtgaatttggatattacctatagcctatgtttagattcatatatgaagttgatttcttctgagacagatggagtatatcatatatagagtaataaaaaacaagaatttttaaaacatatacctgcacaataatattggacccggctaaccttgttgccttgttggtccatctctgcggtgtttcaattatcttcttggtctggaccaggatttggccagtatgacgatgatatttaaataaaagtttaatatatcctagatacggtagcgctaaatcatatacaacagcacgctacgatatatcacgcgccctagacaaaaaatatgtgtagccatcgtattataaaaattcgtactgcagtaagcaatgagattttcagaagactagcttggttaattgagaaatttatcaatcttttcaccaggtatctatattgtctacttatttatcattgagaccagatcgagggtggatatgccaccggtgcatcactactttgctcctatcataattcatgcatgcttcaaacattattgaaatgagatcatcaatagttttttttaagttaatgcttaactaatcatgtgctaatccataattttgttttgcgggttgaaggaagggttcctaagggtgtgttcgggaggaggacctctcctctccggcacatattagcgtatgattaattaataattagcttaaagactttaaaaacatattaaaatgattttaaaaataatttctatatatatttttttgtgaaaagtacatcgttttagcagtttaaaatacgtacacgtgaaaaacgagagagttgaagttgggaacacaacctccccccaaacggacccagggtacaattagtctggctattagggcctcgaatgcatggtacaattagtcgctctcccattgttttattttctttagcaaatatttgttgagccgtgttatatttatttatcactaccatttttttttaatttttccttttcattgtaactcaacaactttattttttgtcttgtatgggaggatcggatggccacattttttttaaaaaaaagaaagaaagaaagaaagagccaaagaggtgtgtaccatatgcaggatcaagtagtgcatattggtcattgtctataataagtacgcaattagagttgttgcttacatataataattaagaaacaaagcagttgttgcttacatacgattagtagatcactccatttgaattagagtatgtgcaatttggtatgcaagagtataccccacaacaatctttgactagctagctaatagtacaacacaaaacatcaatcgttgatcccggcatatgtaaaacaaaacgatgaacaggtgttgatcaattatgcaaaaatcatgattaatttgagcaacaatcctttctcaaaataagataaacaaatgtatgcttatgctacgaatctgtccggatatttttgaccgacaactgatgccacaagactccaaaatgtgtacaaaaataaaaagatatgatgtatagtataaatatatcaaatgaagcaagagtgagagctgggagaatgataatcagaattacacacccatatatgggtcccaatattcagatggccttttgttttccttgtctggacagtaggcaccagtttgctttgcagtagcatccttgtactgtatacctactatttccgttttaatgtaataagcttgtgcacaaatttttttaagatgttttatttttggtcttgaagactaattgatttttatttcggtgtagtgcatgggtggacgaggttgtccaatttgtcggtattcctctgcatattctttcggttacaaccttgactatctatttaacatgtgagaatggtgtgaagctatcatgcatcttccccagtccccacgtttaatttcttttttttttcttttgcgatagggctgattatcaagttaaggctcctctgaaatgcagacctgagaaaatagaaaaatcataggattttaatataaatattagtgcagaatagatgattaatttctaaaacagaagaaaaaatataaaatataggaataaccgtttgattagactataaaaaatgcatgaaattgagaattgataaatacttaaagcaaactttccatagggttggatctcatgttaaattttctccaaaacttacatggattgagacattccataggaattttatatgatttaatagtgtccaatcctttgtttcaaaggtccatatttcaggggaattattatgtttttcattcaaatcaaagtgggccttaacatcaacattctatttttgggctcatttggaacacactagacactacttttgtacggacctttttttttttaacagaagttcatcgagaattaatctgtttatacacgatcaggtcttagtattgtaacagagctctcttgtatttggtgcatgcatcaggttagtcacttgtcatttcctatggattctagtttattttcagttccgttcttatacataatcctcctatgtattcgtgagaaaagctatgtaacatagatgagaattgtcacacgaaattaccatcttggtgaattttgttatttgttctctggaggcaggttcctatgttcctgcttttcagtcccctgcttcccagaatttgctaaaatgctaaatgcatgagccatgaaactcgattcgcatttcgccagcacagttcttgtggtgaagtctgatcctacttaacacgcattcgaccatgctcattataaaattataaataagtaactcaagatttataggatgcaacaaagaaactactgtcgatatcaatggtaggtcttagctactctcattccaaaatgttggaggaacctgagcaaatattggatacaggtaaaagcgatcacttctttttcaacttgaaatgattaaaagaagtgtatgtcctgatacggattctacccattttaactctcctagtggtacggattctacccatttttactctcctagtggaaatcgtagtagaagtaatcgtaattgtttttaactctcctagtgggaatcatagtagaagtaatcgtaattgtttgtgttttcagataaacaatgtgttggtacaacaaaggattgttcttcaatatgctggtcctccaggactgctttaagagcataatgaactaaggttgtcatcgtgaggatattccttatttagtacagactgtctatattagtcctatcaatttaattaagagatgtttgaggaactgaataacacgtattacttaccataatatggtgataacaagatgaaggaagattttagagaaagtaggagcatatggtagataacgatctagagatcgatcaagcaaacttgccggtccaacagttttgaacggataagtgtaagtataacattaatattgaacactactctatatacacacacacagagactctatgacttctgggatgtttttttttctcttacgatgaagcatatgaaacatatttagaaaaggataaaaaaaatcatggatctactagatatattgaatgcttacgcattgttgcagttgctccgcgtaacaaaaaggcacacaattaccacatgttaaaatatattgaacacattcaaagaaatcctctgatggctttgatacaggaaacttgttttacaaaattgcaaaaatatatccttttaattggcggctatcaaatagatcagaaaatgttacgagatttagattaattgaatttagtataagttcaaggcatattagagctctaactaatattgctgtgattggtttaataggtgttttcttttacggttcatattctggattgggttcatctctatagtaattggagggaccagattgtacatatgaaaaaatatgaacttagcgggtccttaccccttttatcggattagagcggaaaggacccgcggaattcttactcttataaccctatgaatctttttttttgaccggacctatgaatcttttttcttcctattaacattgatttgggattggacggtttagaaaacaaactatgttttgatacaggaaatcttgtttttacagtagaacattgatttgggattggacggtttggaaaacaaactatgtacgcagcattttccagctatgtatagttgattaattgggtgaggtggttaaatccaccttcacaagttttactcaattgtataaattttctcggctattaccatcctcacaaacaattatcaattcaagtagcatccattttggaatggtgtgcacaaataatgtttagaatttttaatggcatatcaaaataatatgcagggccacaaattgtatacataaattaagttgctcttttgcagtttgttacatgttgggagcaccaaccgtagttcacggcatggttaccatgattaattccaggactattataaaaaaattctctaagatacaaagtggccagcaagctttataaaatgagaaattctcagatgatgtgaatgtaatctacaggtttgtatacaaaagttaaatggaacattttttgggttttggtatctc

SEQ ID NO: 7888 - DNA, 12439 bp, Oryza sativa
  unsure (1)..(12439): unsure at all n locations
taagtgtagcatcaccctgcccctactccacgaggtcgtgccttcgcgcctcgagcgacgatgtaggcagcgacactagttgggacagcagcagcaaggaacgagggtctcgagccgagagaaagggagaagagaagaggagaggaggcgctggtgcggtttgctggtgagctaagcggcgggtgcctcccatcctcacaacaaacttgatactacttgatatctagtaggtaccacgtttggtatctataggtactaggtttgatatctaagtattatttatgataccatagctaccagccatagaatctacgggtaccacctacagatgatatatggtgcagtgtacctacacaccccagcaaggaacatgattgctctagatccaaaagatccattggccgcacccctctagcaccatcgacacaaaacctacacaaatattttaattaagtagttgaattaaacctccctaaccgtatatgtattggagcagtgtattactagaaatgcaaaatggtgttcactattataaatttcagaggtctatgtgacttggctaaatttagatttatttcggagacttcgaaagagcaaaagctacactttatcgctcttttggaaacaggcaaaaataatttttcaaacgcgtgtttaaaaaacttatgtggaggaggtgaattcttttaggagtgaatttgaaggttcttgacatttcgagtattgttgagggagagttctatgttaagtttcatgtctggaacaagtcagatggcttccaatggattcttgtggcagtctatgcggctgctcaagaggaattcaaggaagcttttcttgttgggttggtgaatgcttgtagcaagatgtcattacctattcttattggaagggattttaatataataagaaaccctaatgagaagaacaatgataggtataatgacaagtggcccttcttgtttaatgctgtcatagataacttaaacttgagagaaattgaactttctgggcataagttcacttggcaaatgggttaccagtaccgacttacgagaagttggatagaattttgatgagcaagaattgggaacagaaatatcctttggttacagcaagagctctgaacagagaattgtctgaccatacaccgttattactagattcgggtactaaggcccaaaataagcaacctctattcaagttcgagcttggatggatgctaagagacggtttttatgatctagtagcggaagtttggaaaaaagaagatagagggttgactagtattgtgaggtggcaaaacaaaatccgtagggtacgtcagtttttgagaggttgggcaaaaatgagagtggcaagtataaaaaaaaaaaagctaggctgtaaaaagggtggaggcacttgataagaaaccagaagtgcaggtgctctcaagtcaggagttagacattaagaattatgtgaaaaataggctggcaaccttgctaagagaagaggaaatcaagtggtatcaaagagcaaaaactaaacggatcgtggaaggagatagaaatacaaagtactaccacatgattgctaatggaaagcatagaaaaacaaaaattttccaattggaacaagaagaaggaataattaagggtgatgagcagttaaaacagtatatcgctaattattataggaagctctttggaccatctgaggaaaataatttctccctcagtgagtcctagattgaggatattcctgaagtcacgctcttggaaaatgaagtcctgaccaaggatttcttcgaggaggaagtgaaacaaagccctccttcagatggagcataacaaggctccagggccggatggtttcccggcagaattctttccaggtgttctgggaggttataaaaaatgatctaatggccatgtttagagacttccataaaggagaactaccgttacatagtctaaattttgatataatcacccttttacctaaacaaaatgaagcgcgaatgattcaacagtatagaccaatttgcttactaaatgtaagttttaaagtctttacaaaggtcatggccaacagagtagctctagtagctcaaaaggtcgtgaggccttcgcaatctgcgtttctaccagggaggaacattatggaaggaatagtaatcttgcatgaaacgctacatgaaatgcataggaaaaggatgagtggggccgtgctaaaactggatttcgaaaaggcatacgacaaagtagattggaagtttttgcaacaagctttaagaatgaaaggttttgcgcctcaatggtgtagctggattgatttgattgtgagaggaggaagtgtagcagttaaggtcaatgatgacgttgggaacttctttcaaacaaaaaaaggcttgagaaaggggacccgttgtcaccaattctttttaatttagtcgctgatatgctagccattttgattcagagatcaaatgaacaaggaaacttccatggagtaattccacatctaattgataatgggctctcaattttgcaatacgctgatgacacaatccttttcatggaacataatctagaagaagccaaaaacctgaaattagtgctaagtgccttcgaaaggttgtcaggtttgaagattaattttcataaaagtgagttgttctgttgaggcaaggcaaaagaggttgaaaaggaatattgtttgttatttggatgtgaaaccggagtatatcctttcaaatatctagggattcccatgcaccatagaaagatatccaataaggattggttgtttttagaggaaaaaatccagaagaagctaagtagttggaaagggaaacatctttcagttggagggagactggttttaatcaattccgttttaagtggcatagccatgttcctgttatcctttttcgagattcctaaaggtattctcaagaaattggactattatagatccagatttttctggcaatttgacgaacataagaaaaaatataggttggctaagtggaacatattatgcaaacctaaagagtgtggaggcttggggatacaaaatttggaattacaaaacaaatgtcttcttagtaaatggctttataggcttctaaatgaggatggggtttggcagaaacttttgagaaggaaatacttggcaaaaaaacattcactcaagtgtagaagcaacctggggattcccaatttttgtcagggctcatggtgtctaagaacgcctttgtgtcatgtggatctttaaaggttcataatgggacccaagtgacattttgggaggatcgttggtgtggaaacaattccttggcaaatgattctcctaggttgtataacctggtgagaaataaaaatgcttctgtggcaacagtcctggggaaaataccacttaatgtatcttttagaagggctatttgggggataacttaaaagcttgtttggaggtagtagcaagagtaataccggttaatctcacagaacaaaatgattcttttgtttgggaagtgcataaaaaaggtttttttctctgttagctcgatgtacaaggctattatatatcgtgacattgtgccaaggaaagaggcgttttggaagttaagagtaccgttgaagatcaaaatctttctatggtacctaagaaagggggtcattctaaccaaggataatttggctaagagaggatgggttggtaacactacgtgttgcttttgtaattctagtgaaacaatacaacatcttttctttgattgtcccctagctagatttgtgtggaatgcgttgtttataacttttggaatccagccgcctactaatgtcgctagttgttgggtaattggccttatggtgttcatcctaggcttagagctcactttccttttggtgttgcggctttatgttgggcaatgtggctttgcagaaatgatgtggtcttcaatggatccaaagctaactcttttgtgcaggtaattttcagggggactttctgggcgttggaatggtccttgcttcttaaagaggaagagggccaacatgtgaaagatgggtgcaaaaagctggaaacgacaatgttggacttcttttcaaagtttggttggaaccaaaggagaagattggaagcttgaggcattgctttgatctatttcgttccccgtgtttttgtcttgttgtttttgctctgagcaagttgaatttgggttgtttggaaatttggagtctaagtactcttttatttgaaccgttggtttttctctcgccgtgtgtaaggagatgaatgttgagtctaagaactcttgtaagtttggttggctgtgtacatccgtttggatgtagagcccggtttaatccattatctaaaaaaaattataaatttcaaaattgtgtttatttgattttttttaaaaaaatcatctaatatattttttctacgtaatgtttagtagtttttgaagcctatcgatattctagatcgataataataataaaaaataacatacgagatataaaagtgaatgagtaaggggataagagtttagataggttcaggccttctcgatgatatgtaattctctacttatttgagggatcgtatccgtcggatgttgtattgatataacaatcgagttgtgctttggatggtttcttgcccaccttatacaagttgtgggggcatgattacacagaggaaaacctagctatgcatgatatcagttttctaatccattacatgatagaatcaaaccaaaactatgggctatgccgtaggatacaaggtaacattatgcccaagtcctagtttattacataattacgtatctaggccacctccgatctctaattggatatgcaggccgagtgggtatggggtactcatgatttctaatcaactcgagaaataaatcgctgcaaaaacgataaacatacctttgctctcaacgatgaagccaccgacgcaaagatgagccacaaccaacgctcccaagcactgccgccgaaggttttggctctcccaagcaccaccgctgccctccctccttcggctagatctaggagggaaagggtgggagggaggagagggccacccatcttccgccgtcgtcatatccttccccctcctgtcggatctgggagggagagagataggaggggagaagctagcggtcgtggaggggaggtgcagtcagggaggagctgacctgccgcctcccctcctcatcgctaccgccgacaccctcccccaccgctgggctcgtgtgctctgagaggagagggagacgggtgctctgaggagaggggtggggggggggagggagaggataagtattggagttgttgtggtagaattatacggggaagaatagacttggggacttagatttttttagtgagttgtttggctctttttcaggcagcgcttctagtggttcgcccgcgaaaatccaatttttgcaagtggacgacttaagagatatatccacttgcaaaaataagaacattatcgcaggtgatcgttttaagtcatccatctgtgaaaattgatcttcgcaggcggcctaaccgttaatcctccatccaacggctgcaagaggggggcggatgctgtaatcttgccacgtggaggggctatttgcatggaaatccacccaaatttcgatatttagagattgcacggagtacctatcgctgtcagattcattgatgcaactcgatacgcatgttcattttttgtgttcaaagatgaacggattaatcacttctgtagcttctgtgttgatgtgctaggactaattatgtggagatgatagggctgtaataattctgttttagtagtgatttagttggattgagaaattatgctatatatcacgaaggttcatttttcggctggtcagtttcttgttaattgcgagtataaacttccttttcagattgacctactcccactacgccagatcctcacacctttgacgacatatctgtgacgggcataagtgctggtcagtgatgaaggtcacctttgatgggtcctaccggatgccgtcatctggcccgtcacaggtgactagttacctatgacggatcacaaccggatggcccgtcagaggtgaggtttactcacctcaaacgggtttaagccctaacccgtttgaggtgagttgtgccactatatatacccgaagccaagccggatctgatatttcttctcccaggagataaggccggcttctccacttctctcgattcttctccacttctccattctctcttcctctctttctctccactaacatctctcgatactcctctccactaacttcactacagctgccggggaaggaggggaggcgcgacggcccggtggcatgctggtccggcaagggcggcggcggcctcgcctccttccgatacggcaggggcgggaggggaggcgtggcggtccaatggcggcgaggcgagtagagggcaggagggtagtccnccgcctccaaccgcgggccagccgccgcttttgccactgcccgcgggtcggccgccgcctacgcctccatctctgcccgcacctccgcctacaactccacgggcccaagcaagccgaaggcttctccaccacgagccgttcttctcgagggccggccttcgccatatccgttctggagcttgcaggcgccgttcggatctagagctcgtgggcggatccgagccccaaccgctggatctggcggtgatgaattccagatccactcgagctccgccgccagatcccttccccttcagatccattgcctcccgatggagtttatcctttctgttctctgcctagatgaatatgattgtgattatttttgtgattttttttgtgcccaaatgattgaaaatgtgaagtgattttgttctttggccacataaatgtgattgtgatgatttttgtgattctattttgtgtccaaatgattgtgaatgtgattatttttgtgatttgtgaatgcctaatgaaggcttgcgtctagctatgcttataatattttatttttttgacgcatttttttaggtttgtgacggatctcaattgagacccctcatagataaggatcaccatcaacgagttaatatttttacccgtcacaggtgaaggttaaatgtgacggattttacttgctgtccttcaaaggtatcttttaccattgacgggttaccccgtcacagatgactcaatatcatcagtgaccactgatatgtgaccagcgcttaatccgtcacaggtaagggtatgagcccatcagaggtgacctgattgagcgtagtgtctgataacacactagtaaatactagtacattgttatcaagtttgtgatcaaaacagatcaggttaaatgatgctctgcgtctgagtttgtgagttttgcatgatatcgcccaaggatctgaattctgaagggtgaaccgatctttactaatctcatcgcatctcatctcaataattaaattaaatgaacgataaatgtttattctttctcttattaagccacgtatatgctagatagattaggtgaaccgttagatttattgcctcatcagatggcaaatgctttggctgatcagccatttaagcaaaataagctaacttgcattgaagtttggctgaattggagatagctgtggctaatcagccaaagtatttggccaaccgatgaggctgttaataagaacggttggatatatgcagagaaaaatgcatattggaagattcaggagacttccttgagagaaggtctgggactgtgagtaaaaaaatatcatgagtaactttgatcagattaaaaggaaatggccagaagatgacccttaaacagtctcgatgttcatgaaagcgagaaaaagaaaaatggagcagatgtaaaaagagtaacattggcatagataccctaggtaaattagaataatccaaacaattctaataaataccatcattctcaaatggttcagaaatttacttttttaaaaaataggatgttcaaaacttaccacaaaagaaaatcaagcatgtttataaaatttgatcccaagtgagttagatttaaaacaaatcccactaacacaataaattctacatttttttctttaacatgctaatataagatttacaataaatttcacacgctaggcataattatggtcaattatttgttatcacagtaatattttccaatatatagctaaaaagattgtaactaaacttctggtcaaaattcgttcaacaaattgcttttagaatatttgtatactttacatatcataacatttaatagggagggatgtcattgtcgcgcgaaagcgcgaatctactggctagtattttgtgaagggagtaattccttctgtgattcacagtaaaattgtggagaaatattctttcccgtgcaatcacatatttcatctacatgtttgtttcatactttcagttaggatgcaacaagaattacatggctatgtggccaaatgcatgaatcatgaatccaattcacatctcattgtacagttgtcatgatcaactctaggactacatatcttatgaacaacacatcttagatcatacatagtaaccaagcttataaaatgcatgggtacatagatacatgcgtgtaggatatgtaacacactagttatgatatttagtaatttttattatatgttaatatttatatgatagctagttagtaatttttattatatgttaatatttatatgatgttagaggaaactgaacatgaactcctagaggatggttgattaactttacttgtatcaactcgaattattgagagcttacccaaattcatccatgcaaactagatacgttaggataggaggaggttttatattcatattgcggattagataaataatttatgaaataagattactcaaagttatacattaaggggtatttactagtagaagcatatgaaagagaattaaaaaaagaagcatatgaaagagaataaaaaaaaggagggtgtgatctgctttatatcagagtagtgcatgttgcatggagaagtcaaagtgagagggctttgcgctcgagcataacccaccgcgtatagctgcccgccgttggtcaccgatagaccagaaccagagggtggtggtgtcgttgccatcaacgtcgccggcaagtaaatcgatcgcgcggtcgatctaataattagttgctttctggtgggctccagtcaacggagttatataaaaattggtaaccgacgcggaacagttttctgttgagataacaaggtataaatattttcaagaaccgtcacttttaacgttgtagagatcccatcgcgtcaaaaaaaatgcaaaacagtacccgattttaccgttaattttgccgattattttgtgtgggctctggaggatttttttttttctttttgttacccaatccccaatggattaatccgatccaagcaaatatttagatctcgaatttgctatatatctatcgtgcgatttaaacaagggtataaatatttctagaactgtcacgtaagacgagggaacgtcttctcgtccctgaacgaaataacttaacaaatcaacccttattttcttattttccttcaaataggaaaatccggcgccccatcccctagcatgcatgtcactttccgatgtgcatacaacctcccccatcattttctctctcttactttatactcaattagcaagttataaactactttttgtcataaattatatgtctaattcgtaatctgattgcactattgaattcgtaacaattaaatctttacgaagagatctcacaagactatatttttttaaaaaaaataatgtattataactgaaacatttttatattatgtatgaaacattaagttataaccacttaaacattaagctataaccactgaaacatcacaaaataatcgatgaaacaacctagaacaccatatgcaacattccaaatgacctagtgaaacatcagttgaacatcataaatatacatgtcgaataacatcacgtgcaacaatccctagtacaacatcacaaaagacctactgaaacatcacaaattaagtacatggtaaaacatcaaaataataccatgtgcaacatttcaaaatgacctagtgaaacattagccgaaacatcacaaaatacctctaaaaaaacactcaacatttcaaaatgacctagtgtaacatcattaaatacctattgcaacaaaaaaaaactttctaaaaaagttaccaaaatatagtcaagtgacgccttgttacgatgatttaattgcgatacaatggcatattcagattacgaattagataaataattcaagtgggatcttgtttgaagttttacattaagagtataagcatgtactagtagaagcatatgagatagaataaagaatgagagtatgagctcctttatgtcagagcagcgcatgttgcatggagaagtttggccctgtatatatcacaccctaaaatttttcaccctgtcacatcacatcgaacatttgaacacctgcataaagtattaaatttatgctaaaaaaataactaattgcacagattgcaaataatttgtgagacgaatattttaagcctaattgctccatgatttgacaatgtggtgctacagcaaagatttgctaatgacggattaattaggcttaataaatttgttttgcggtttactaacggattctataattatattacacgcaaaaactttacattcctggatctaaacacccccttatgtgacggatactgtgattattcttagtagtaggataaaaaaaacagacattagacagtttgaagagaggcgtgtgaacatcttttttttccgtttgatcgggcgccctgataaaagcattttcgaatatataaaggtaaaaaaatactactttatccttaaggttagttttcatgcatactgaggttgcccttatatcaaggccgataacataattttcaaattttcatattaaatatatgtgcggcatatggtctcctcgtctttgatttttctcgtgtcgtgtcatcatatataccactaccactagtccactacggaatcattccaaataaaaagaaaaatgcaagtttcttttactatttaggagtaggacagaaaatgctacaatcactttgtctgtcgcatccggcatccctcgtcaccaacaataggttgatgttgtctgagtcatttcaggtctcctttgtttgtcgtgtcctcagacacgctgaggtggacatgctcagtggagtacatggatgataaaatgcttaagtccacacaatcgttgtaaccaaaaaaaattcgtgtaatctcttgagcaaaaaacaactaaagcatggagtggtatactcatcgatgataagtgcctttttcttggatatttatatagtcacaccaatttcatatgtagaacttcaaaagactgataaacaagtacctcaaaagacggtggagggttttttttttctgctttgcgttgaactcggtaaggaggagaatttaatttgttataagcttattttccttcttacaagaataaattagtatgtgttttttcaaaagatatacaccattctaaatggattatttgtagattattcatgtcacgcttctaaacatatgatgttttttccaaaaaaaattttctacatcacctataaacataaggcaattgttctaatttatttgttaggttcataaatataaaatatttaaggaaaaagtatgaattaccccctaaactatcgtggtcggtcgaattaccccctaaactcgaaagccagacattctatgccctcaactcttcaacgcggacaaattaccccctgaacactgttttggatggttttgggatagactggctaacggggcattacaacatgaaaaaaagtattttagaaaataatgggcccacctgtcactctccataactcctctctctcttcaccttagtccccctccaattcgctccatctctctttatccctaacttaaaagagaagaaatggtgacggaaaaagctagggtgacgatgaagagtgggtccccctggggcactggtgactgagcgcggtcggcgatgaaggcgaaaacttagtcgcccagggcacccaatggtggagcatggtcggccagagactgtccttgacggggggcgctgtgggcatacccgccggggtgtggctgcgcgatggtggaggagaaagaccattcgccacattaccgggcgccgtggaagggggatgcggcggcgacggcaacataagggggaagccaccgcctcgcctgacgctttgtgcgctaacccctccgtcctacttgaggtgcgaccctgttggatcgacgaccgcagcgtcagatcgaggagaggc

SEQ ID NO: 7889 - DNA, 8049 bp, Oryza sativa
gggcccactgatttttgtttttgtttttgctgattaggctgccacgtgtatggctgtatgccatgtaggctgaaaacctctccagattgagttagggggatgattcatccggattgaagagtttaggctgtctaatatccggtattggagtttagagggtaattcgaacgaccgtaacagttaaggagggtaattcgtactttttcaaatatttaattcatccctgtaaacagaatcatcatccatcaacctccgtccgcatttcatccgagaagattgagcattcttcttctgatgcaacaacattggagatataaacagtgctttgtagtcgtttctgcccccacaaatatcagtgtattcataatactccggtactccctttgaagatttcgttctaagttaaacgtatttgaatttgacttaatttatcaaaaaaatatttagccatattttctaataccaaacaaatatattataaaaaaattcgattgtagatttaattaaattagtttggtgttgtagatattgatatattctttatataaactaggaaggtagcccgcgcattcgcacgggcatgcttgttatttcttttcgaaaacaggtctaacaaaatgaatttaaattaaagttatgtatttcccttcttaattgaatgctcattgtttattttttcttaaaaaatcttaagaaactttaatttctcataaatatagttttctaccatcctgctgtctttaatttattgattttgtattgataccttagaagcttatacatgcaagttgtggaatttagtaaattcgtttaattatcagtgacattcatttattgatgtgtcaaagcgaaatatggcttgtatgtagagaagcataaaaaaattaaaaaagaataaaatatcgttaggacataaaatgagttttttcccctatagccaagggagtagattgattcaatactacctttgcggattaagtgcttcactaaaatagttctctctataaaagtttcaatgctatcttgtgggttaagtactccactaaaatagttgtgtaaaaacattacaaaagttgtttctaaaggtgacccatgagtctgagccaagctcgtcacataggagggtgcacatttgaggaacatgtgaaaagaatgcccatggagatcatttgtttatgagtgcgatgaatacaattgttcattcaattaaaaagttggataagtggcttaaagttgacattttacattgattgattatgaaagtaatggtacatacaaatctttgtgcccgtataactatttgccaacgatcaatagaacttgatagttactttcggtgttccttttagtatgtagcaaattggctacatattttacaacttactgtatctttggtgagatgcacctgctatttttttctatatgttggctagattgtttcattgttattaatcgataccttgggtgcatgtgacactatatatatttcaaacaaaaaagccttctcgggtctaaattgattttgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtgcattgggcatttagtgacaatatttatattgcataatcttaaatgtgaagcctaccatgcttaccctattttatcttttttgtttgaaagaattagccatttatacaatcatggtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgataaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacgttgataaaaatatatatgggtattttttcatattttttatatttatctaaatgacacatataaaagtcagaaattataaccaaaatgtgacttttttgaaagttgaaatataatgaatatgatctttaaccatatatttagtcataaattatctaacgatataaacagataaaaaatatcaatttagatttgtggtttctaaccaacattgcataaaaataggaataagagagggaacagataaagagaaaaagagggaccgcggataacataccgtacttacgactccatgcgcactaaaatttttaattacatgaaaagatatgtacttattatgagtattgtgcatatctaatgtgatgaaaagatatgttcgagagcgatgaattctagactaccaagagcgatgaattctaccaccatgcagaaagatgcggtgttttttttttctttttcatggagataattacaaataatccacaactttgcacgacaaaggcgcatgcacattattctggtgctcataacaatcatatgcgtatactgatagaatatgcaacaacagtagagctaattaagtcgttttaccggacagggagtcagcaatgcctttggcaacgcaatacgccacggactgtacggtgatcatggggttgatgcccactgcggtgggcagcacgctgtcattgcacacatacagctgctccgcctcccagctctcgccatgggcgtcgacggtgccgttgcccaccgtggtgcccatccggcagcaacccatgtggtgcatcgagcagaagaggccccacgtctcttttagagattgatctaatggttaaaaatattgggtccactggattaaatgaaattcaatagtttttgcctttttctaagagattttaagaatttctctaatttatcagagtgccacgtggtggcttaggagcatttatagggtatacgtggcagcttagaagcgtttctagaaagtttcatggacttttaatgtataatattatgtaccaaaacatggtcaatatggatcaaacaaaaaaaatcaaatatgttaaaaaatatttagccatctaattattgattttttttaactttttagctagaaaactgagagaggaagtgaggaaagcggagacttatcatctgttaggtcatatgcgtaattcatcaaaactacacttgtcatagatgatcttacttctttgatggattatccctacagacatatctcaaacattctacgttttgatccgttcattagtatgagagctatcataaatgatttgtcatggatggcttcgcttaagcgtgtcataaattgaatgtgtagattggcttaaaaaagtaattatttatttatgtcaccaagatcattcatatataaattaaagttccacgtaaaaatagatctaataatttttatagtaacaaattatggtgcataaccttaataaaaaaaataaaaaagaaagagaatactgagtgggaggagcagatgtggtggttcgtacgttttatacgtacctgtagctctaagataaaagggtgatcggatcggtggatttaatataatggttagtattaccgggtcaactgttttaacttaaaaataaacggttagatatttttctttttttctcagaaattattagagcgtcacgtggcggtttagaagcttttgtaggaatcccacgtggcggtttgagagtgtttgtagaaagtttaatcgacctttagtatataatatataataatatatttattttttggctagacgattcctcaaatttacattgcacgggctataatattgatactataggattcctcgacttatgagtgtttatagagtgccatgctaaatcatattggttgcttgcgttgtgaacaaaagttactcgatctaccttggtgcaagtgaacttaggggtcatccgatggcttagctgagcccttaattagttgatgtcgtttcatatcagaaacgaaacaacttggaagtttgaacgggatttttcttaaataaaaaacagcaaaagtagtttgcagatcaaagtttgaaccaaatcttaattgataaattgcaccggagcagtatatgtttggggactcaagagtttggatggatccacatcgatggactcatggcactcacggctgtttttgtggcgcagatcttctggtgcagggcgatcaccagtgaaagaggtcgacgtatatgtagtcgttgtttcgtcgcgcgtgcagaacgtaaggctcacgtagcacgttcttttttctatatataaatctaagcgattatcagggacaacagatcacggagggattactgtttctttttcataaatatgatccaacggtgtaaaataatgggtccaccagtttaagtgaaaaccgaaggctagatgttttgttttttattagaatttctagggatttctctaatttattagagcgccacttggcggtttaggagcgtttgtaggaagtttcatggacttttagtatataaagatttgacttaaaactaaaacatcttatattttcgactggatgaagtaacgctaaaaaattttcaggaaaattgatgcatcattgtactcgctaatccttgcaaccactgattcgttattcaatacaagcaactttatttctttagacaaggaatagctccaaaaatgaacccagccacgatcttgggtcacattcagcttgttcacatgcaccctgacgtttcctgcggggtgcacgtatcaatttgcccttcgttccccgcacaccggagccatcactttcaagaacggacggataatttccaccacgtcctcctctccacatccttttcatctcccacctcctcactcctcgtcagttcgtcacttgcttccaagaaccccgtgacaaggcgggaaggaatccgaatcgcagcgagatgatttgccgcagtctcctccttctcagatctaatgcggcctccaaggtgatgttgattaaattctgcatttcttggaggtttttactgcacctgcgtcactgcttgtaacaagaagtggaacggttttgatgtttccgtcttcttgttttttttgaatatttggaggtagtattgtatattttttgcactgtggaattgatttttgatccctataaaggctcaagaacaacagggtgttgctgttagtaagcactaagcagggttgggtgggtctgtttgattcgttttgcagccttagaaaggtgcagtcttttgttaatcgagaattggttaataattggagcagtcgtgtgtttgtgatttcatttattcttttttaatttgcctgctgcagatgttatgtttagtcagatttaagatgtttatgcttttttgagcaattatagagcaactctctaaaccctgctttcctgatcatttcgttgtgctgttatcagcaacttgccttcattctttgttttgtttaaaaaaaaaaccttgaatgtacagatttaagcagtaatggttttgctcaagattagagttttcttcaaaacagttgctctgagagtagctcgagtagtttgaagcgattttgaactcttaacattattctaaagtcagcatttcttacagctcatgtacctaaattctgcattcatctatttcctcacataggcaagcaacatagtaaaacatgtagctgccactggatgtttgccaaaatattcctcagaggcaccagccagatatttcagctctgaaccgtctcttcaggtcgactcgacagaagaaaatgggtatgttttatgtgcagaattatcacataattatgtgtatagacatatctagtctaaatttcttgttatctaccactgatgctgcaacattttttacctgtatcaggttcaaggggcatggcatgctggccccattcactgctggatggcagagcaccgatttgcatcctctggttattgacagatctgaggttctgcaatttggaattgtcttaaaatttttttccattgattctcagattatagcacaagatttagaacatgtagctttccatgttgacttctcttcataatgtggtggtttctagctttatcttatatcatattcaacgaattgcagggttcttacgtttatgatatcaatgggaagaagtacatagatgctcttgcaggattgtggtctacggcattgggtatgtgcaccagttcaagctgtattttcagatttttgtggtataccaaaaagttgttcctactttctagtaaaactcgtttcccgcatatgtaacaaatgtagtattgcatatatactaaactttgctattgtcctttgtatattgtcttgttttctttgcgtaattccctttgctttcaggtggtaatgagcctcgattgatcaaagctgcaactgatcaattgaacaaattacccttctaccactccttttggaaccgtactaccaaaccctcattggtaccttttttatctcactatctttacaggaatatagttaaaaccgtaggttgttgatgttatatttctaacagtgtgcttgttattttacttgataattcctagtttcaccatcttccaaataggaataaaatttgatgctacaattgattacatcacatttagtagttcccttgtttctgttaaaaattggtggtttctgaatcttgatgattatactgctaatttcaggatcttgctaatgaaattctcagcatgttcactgcaagggaaatgggaaaaatattctttacaaatagtggttcagaagcaaatgattctcaggtacaataattagtcaaaacaaataactatcattatttggagtttatactatacctgctctcattatgaacttttctgttcaagtttggttagtaaaaaattgcaaaaataaatgttgtgccacagaatataaaaacattgtggggttttatttactgaaaataaatagtgtatggtcccccagttgtgatattccacaaagtacaaaggtcagtcgtgatattcagaggattatggtggagtagaagtatggaagtattcagtattataacagtgttattctttacaggtaaagctagtttggtattataacaatgcattgggaagacctaacaagaagaaatttatcgcacgctcaaaatcgtacgattcattttactttacactttagccttttctcctaatgcaatagacgatttgttgatatgatttattttcatttatgattataattctcaattcattttgtcctgcatgtcagttgtatatttttacttgcagttctgtatataagtctttcacatgtcaataccagatgatggtgtcagtttatattatcatgctttttgtaatatttttgcgtcaaacttaacaacagatgaaatactctaagaattatttctaaatcaccgtccttgtatccaccagcattacctttcaatatcatttaagctccttaccttgattatttaagttctcgagccatttggatgttatacattcccagctattttatatttttacagatatcatggatcaacattagtgtcagccagtctatcagggtgagtaaatcatactccataacatcaatatttccttctgttagtccttaaatctatcaaataatattcatactagttacgaggtaattctataatcctaagtaatgctttcttctcttggtatatttagaataacttgctaattcctgcattgtttacagtcttcctgctcttcaccaaaagtttgatctgccagctccttttgttctgcacacagattgccctcctactgcgcttccatcttcctggtactcttgttg

SEQ ID NO: 7890 - DNA, 1297 bp, Oryza sativa
atttttccttctgccatcagaaaataccatatcctatattttgttgaatatttctctgatgcatttcatatcctttttattttcagattgctgctttcattgctgaacctgtgatgggtgctggcggtgttatccctcctccaaagacatactttgagaaggtaaccagaatcacatgttagccccacagtccatacaaccttgatgcattttctgaattcaagaaacgtttattgcatgttgattgttgaacatattacatccatcatatcctcagttcagtttgtagtatttgccagatttttagctgactactgaagagaagttatttattctatgtccttaggattatattatttcaattaaacttggatgtaaaacagagaccttctgtgtttatcatttcccggtcagcccatgcactgttctgggaatgcataaaaaatgcattgatatttagatagaattttgttactataccgtctctaagatttcttacattttaaacaacttccaacacttacgtaaaaaacaagttgcaacaagaaggtagccctgattttcttttatgtagcttcattattattttcatggtgctgatgccaattatttgttctttccacataaaatatttagattattgtgctgcctctaataattttctgtgggtttgttctctaccaacagattcaagcagtcctcaagaagtatgacatcttattaatagcagatgaggtactcgaaagtttctctattagaaagaaagtctgaatggtagaatatttactttatgggaaaattagtacatcatcatccatttgtaggtcattacagcatttggtagattgggaaccatgtttggatgtgatatgtatgacattaaaccagatcttgtctcaatagccaaggtgagttcaggcttcaataacagcagagtgcttatctgataagacaagaactctcctctctcttttatttgtttgatgaaactgatagagattcgtttttctcatttcttttctcccatcaggctctatcttctgcctacatgccaattggagctattcttgttagtccggaaataacagatgtaatttattcacagagcaacaagctcggtaaagacaattccatgggatgaatttattttttgtgttgcttctgaattgacaagcaaaatcctgtttgttacaggttcttttgctcatggatttacatactcggggcatccagtttcctgtgctgtcgccatagaagcattgaagatttataagtaaaacacacttttcataataac

SEQ ID NO: 7891 - DNA, 497 bp, Oryza sativa
ttcctgcagccctctctcctcctctcatgtctaatttaattcctttgatgtcttatttttttaactaattactaaaaatgatcaataagtagaaagcaaaatgattattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgatttggagaagatcaacctctgcccctagaggcgcccagaccccccttatatatgggaaggagtccgggttacaaaagataacctatatccctaacggaatacacagatacagattaaatacagtcgtgaccgactaagtttcaaggtgtttccttgatatacaagttaggaaacaaacccaggatacacataagatattctatctatattcggtatcctata

SEQ ID NO: 7892 - DNA, 921 bp, Oryza sativa
tggcaactatgccaaaatttttgtaatgccaaaatttggtaaggtttttttggcatcaaagtgaacaggccatttttcttgtcaccgctgcttccacgatcgggagcgtgggggggaaggcggtgtggacatcccgctgcgcgtcgtagatcttgtttggaagcttctaatggctataggttctcctataatcttcagctatcagaagtttcttctaacaatttagtttgtcgtacagattctaagaaatctaaaaaagtaaattaggccctgtttaatacagcttaggattattataatatggattattaggagtaagctgaaaaaccagatagcttattatgatatattattataatttataagccaagttactataatctggtaagccactctaaaggtgcttattttagattattgggtgactaacaactaacaaacagattataatctaacttatggtaatctagttctataatctagattacaataattttaaactgaaacaaacatggcccaagatagaggttgtataattattatttttttaagatttccacaaactgaacagaaccgtctcgtccgcgcctctcccggtcgtcggtgtgggactgcatcgtgagactagcacacgcgtgtgccggtgtgagcggcggcggtgatggatggaatgacttcctcgttgtcaacgagctgaggcaatgatcaacgtcagggcggcgtacagacgagattgacgagctgaatgcacggtgacatacaaatttaatttcacgataagctagctaatttctcatcaaataggccttggtttcttttctcttttttttttttgacaactgctcgatggggaattggggatcgtgtgcatttaccgggtacgcaatagctaccgtaccgatgcattccggaatgatttgg

SEQ ID NO: 7893 - DNA, 626 bp, Oryza sativa
aaaagaaaagttaaggtagccaagactcaaaaagaataatccgatgagttcccattacactggaaagtcttgcacacatcgatcggcgaaaaattctctcgtttgggcacacaaacgcagcgtgcacatcgcccacatccacatcggcgtgaccggcccggccggctctcccgcacgctgctccaaaaaccccgacgcgagatgacgacaaggaatcgagtggagaaggaaggcgccgtttgcccgttttgttacgttctcgcgcattggtggcagtggcagtgccggtggtgccgcacgcgcgcgccggtagcacacctacgcacggagagcccggacgaatccgccgcaaaggacgaggagagttacatcagattcgcacgtcgagacgtagagcgatctcgcgccgatgtgctgctattgctacaaggatgccgcaacgaaccgcggcaacagtgacgccgcacctgcagcctcccgactgcgagttcaattaaaggcctggacgctctgatgatgatgatgatgaagaagccctggacgctctgcttcacccgtttcacttctcattttcgctcccctcttatccggttttttatgtattggaatggttgaggtggcgaatg

SEQ ID NO: 7894 - DNA, 648 bp, Oryza sativa
acaaagtatatctcaaaagaattacaaaagattcattgccttgtacaattgtagagattcaccatgttaacaagtacaactcaatctaaacgtacgatctaacagcttgcaaggctccaaagcaatttggtattatttattccttttccacctgcatttgggaacatttattccttgttggttgttgcctgctttctacacagaaggttttcttgcttcaccccctcaaactacttttgtttcctactaacgagcactatcaaacctgtcaggagcatgcagcttccaccactagactttttgtgaccccactgcatggatctccaaagttattcgatgacactggaacactgcaattggtcattccaacacaggcctgcagagttcaacgagtaagaaaaacaccactggcattgaagcatgacaagtatggaagaggataagctcagattacctcttgaacaactgcaagagcctgagagctgctgcattcaccatggttgtagttcccacaggtgccactcggtgtcccaaagcttgcaaacttgatgttgctgatgacctgaccttctctagggcactccaggcgaagtgctggtccctgcgtctgagacgtctgttggggagagatccagctatcgatttggg

SEQ ID NO: 7895 - DNA, 785 bp, Oryza sativa
tgacgaatgcccgtgtcctgtaatccagcgttatttagtggtttttatccaatgatatttttttaccctaagttggtctcaactcccatttgtaattttttttaactcaggaagttaaatgtgtatacgatcgtattaaacacagtgccgtcattaagtgagtaataaaatatttattcaacaattaatgagttattaactataataatgcaaaaaggatgtaacaaaaatattattgttaacacacggaaactggtgtgaaaaatatacggggagtaatatcgagcccctaatttgtggggagtaaaattttaactaagtttaaatagaggggagtaaaattttaactaggtagatatacaggtctgattttgctatggaattttttactggaattaatactaccggatgtaagtgggaaaaagattaacaaaataattttattagtgagaatggaccaactgcagtaaatattttacttaacacaggctagcatctggagtgctgcatgcggaacggataagtcggaaggaggtgggaggaaaaaaaagaaaagaatagcggtactgcgaagggagttaaaaacgggaaaagcggaggaggagagggaggggggcgactggtactggcgttacgaaactcggtggcgcgtacgggcgctacgtagcgtcaccgtgtgtgtgtgtgtgtgtgtgtgtatatatatatatatatatatatatatatatatatatatatatatatatatatatatatatatatatatatatatatatatatatata

SEQ ID NO: 7896 - DNA, 700 bp, Oryza sativa
attggtgcaatcttcatcaatttcaggtgagctgacgtcacacgcagcttgttagcccactctcaatcgtcgtcatttgtcgtatagtcggaactagccaaccagacacaaaccgacgggatcgactttgacctcaccgaattcctagacatccactattcaaagtgctgccgctatgctccgccgcagcccctagggccgctggtgccgataggaaccgccgctgtcctggacgaccgcagcccctagggccaccggcgccgacgatagccgccgcagcccctagggctgctagcgccaatgggagacgccgctgtcctccgccgcaacctctaaggttgttggtgccgatgggagccaccagcacagcccctagggccgccaacgccatcgggagccacccccgtcctccatcgcaacctctagtccgccgccaccacctggaaccgccgtcgccacaacccctagggccgctagtgtcgacgagagccatcaccgtcctccgcagcagcccctaaggccgcctccgccgacgggagcagtcgggccgccgccaacctccgcagtcctctgccgcccccaccgccactactacaaaagtgtattttctgtacgaggccccttgatttttgcaaacggaccataactagtggcgtctgcaaaaatcgagggtcatttttgcatgcggcccctttagtgg

SEQ ID NO: 7897 - DNA, 889 bp, Oryza sativa
cgggccacttaaggaggcatatacaaaaataaaatttaaaaaatttgaaactagtgtatctcactcatatgcactccaaattagatgattcttttttctaaatgtttctaaaatcatcctctatcatgttattgtgttcttactgctattattttggccattttttcttgtgactttattttatcaattaaaactttgaatttcaaaacttcaaataatattttgaagcagtaattgatttcagctgaaaaagtcatcaacaacaaagttgtataacacatcaagatatataacttttattttggtcatttttttcatccgacaaagatttttgtaagattgatcacaaaatgtacatctctcttatagttttataaactatatagtattttaaaatgttgtttgaagttgttataattttaaattcaaattcaaattgttcaaacaaagtcatatagaaaaatgaccaaaacaaaagttatagatcttgataagttatacaactttgttgatcacaacttttcaatttgaaatcatttattgattcaaaatattatttgaatttcttatattttaaaattcaaattttatatagctcaatcaaacttggatggagaaatgaccaaaagaaaattggtagatctcaatgatctctacaactttgtttttgacaaccttttcacattagttcatttaataccacaaaattagatttaatgttcatttttatctagaagtctgatttgcctcctctccctctccaccacttcaaaatttcagcaaccttatctccaaccttatcttctcttatctcctctccaccattacttctcctcaactccctctccccctctctttctctccccctcacacacagcaagacgggcgg

SEQ ID NO: 7898 - DNA, 6481 bp, Oryza sativa
  unsure (1)..(6481): unsure at all n locations
gcgacggatccggagccggcgacgacggcgggcggtgggggagacggatctagtgccggcgacgatggcgggcggcgtgagcgatggatccggtgccggcgacgacggcgggcggcgggggcgatgaatccggcaccatgcggcggcgggctagggtttaggatattttggatttttattttttttgtttgctgaatttattttcgcatgcggctggtataagcagccgcatgcgaaaatgggattttcgcatgcggttgggccggccgcatgcgaaaagggtgatttttacagaccttctctcccatgcggttgccccaaccgcatgcaaagatgccttttgcccgtatggaaaaagcctttttgtactagcgcgccgtccgaagggactccgtcgccaacgcctttccacctcccctcctccgccgtcctagccactgggagctagagggggaagagacgagctggggctagcctcgccgcctgccaccgctcgaagaccacccccagcatagccgagacgtcgcgcctcctccggccgccatcgtcggggtcgcctagacccgatctggccgtggcgaggctagatccggcgtcgaggaaggtggattcgcaaccggcgtggcctaatccgccgcgccgaccgtccagccaccacctcctgtgacccgccaccgtggagaagcccccggtgttccccgccgctgggcatccttgtggggagaacgccccgccgccgccgccgtccttgtggccgtccggcattgccgacgagccgctcgggcggcggcaagacgaaggggaggaggagggagggggcggcggcggaggatttttcgtcgtccgggtcgcccctgggacgggagcgacacggaccaccggcaagttgccgaagagcccataacttgatcagtaagcacctctcattgatgataccatagcgtgaacacccttgtacaatttttccattatacttagtacagaaatatttttcttctactatactcaatgaaattggcaccctgcccgattcgttaaaaaaaattgataataaactacgttgcattagtaaacgtcgatttcaactgatgaaacggagacccattggcaaaaagtcaagactaattttgagtggatgaggcgtctttcggcgacagacaagagatgactaaagctcaacctgccggttgatgtgtccggcaaaagttacattacaccacggaaatcgattgatggagggtgatttcatgccatcggatagcctgttacagtcacatgtgtatagtgcatgatatgtttctgcattcatatgtccaaaatacactctgctcctgagtggttacattaccttgtttgttttctactcctacgtattttagctagcacagtgatgcgcagagattctcgacagtagacgactgcccaaatttccatccaatgcaacaattccaggaggctagaaattgaagcagattccttcctctgagatgtgtgattgctgccaaaaattgagggggggggggggggggggatctcaagcgtcaacaagtaaacttatgccaattgagattgtcaatccatcaacaatggtgtgacgttatcgtctgagagagtgccacgtgctggtgtcagcaatcaagttcacatagacgattgttctaagtttgatcaaacaacacgatgcataattttttgtagaagtaaatacaagcacctcaccttagaacaaaacgacggcgattccgatgaacatttttacaacttggcgcgccaaaattgcccacctattttgaccaaaccaaccgtactatctccatcccataaaaacccaattctagatttgaatctggacacacactgaattaggtattttataggacggaggaagtacatcacagaacttaacgccggcatagaagtttgggccatgaccctgagatctcaagccatttccagcacataggacttgttcagattgtagccaaaataaatcttatcaaatttgtatttaccaagatttggccacgaactaaacgtagatatttttttagcaactttgccaaaaaaatggtatggttgaaaatggcatcaaagtgaacaggcccataatcagttgataattaccctaaccattccgttttttttcattttttttatttttttctgactatctcgttgcttaacacgtcgccgccttgcgattaaggctccttgcgagcgtgtttgcgaccggaaaattaattcgtactccagctcactggccaccagttttgtgaatctttacatgtcaattcctctgttttcgttgaaacgcaacgttcctctccgtcatgatcgcgaggcagccgtgaaagcttccccaggtgccggactgtaaaagcggaaaacttgctgctccagcagcagcagcagcagccactgctgcaattgttattcatccaaagtgggagtagagcagccagatcctgccactgcaatttttgtcctccacgatggacgaatcatcaatgaggagaattactgtaggtaatgggtggagtactccccccacctcgaaagtactagtactagagtaagaattttagcagaaattaaggttaaagttaaaattcaatgaaatccttatattttgttacaggtgggatggagaaatagactgagaaataaaatgatactccccttgtttctaaatgctacacacatggcataatatacacgttcatgacataacaaaaggtataagaaagccgcatatttatttgttcctagtattttaggttctgaatttctaggcctgatgaataactccattaatataaccccccccccccccccctaaaaatagaagcggcgtgcggtcatgtcaaacattgtctctctaagtttaaacttactgtatatatgggcttgcctatgatgtggaagtagtattgcgtcggaccaagtcatagtgtagcctcacgccatccgcacttcagtgttccactgtttcagtcgttcgtcgatcggatgagtgagtcaaaatgtatagtaggattgttctaagtagtcgattgagatacatactacatggtatccgtggcacactttcaaaaatatgatttccttaagaacttgctacatcagcatagtttagataaccttttctaggttatactccctccgtcctataaaaacaaatctaatactggatgtgatatattctaatactataatatattctaataatacgagtctggacatgctcctgttgagggagtatgtatttaatccatctatatgttcaattttattttatccataatctatccatcattcagtttgaaagtgacctaactttttttttgaagtactgcatcaaattatcttgattctcccagccgtggatgattaatttcaagatattgagttgatggacccggttgtcttcatacttccaaattgctaaagctatatttagtgcaaatgctttctatatatatatattttaaataaacaaaactgttttgaaaatttataacaattataccaccgtctcacccaaaatgggatggaaggagtagtacttaactaatcagctgctaacattctactccttcgtctcataaaaaaaactaatctaatatcagatgtaacacatcttaataccataaatttaaacaaaagattcgcagtattataatgtgttataatattggttactatgttggtttttatgtgatggtaggagtaaagtactgaactcagccgtactcacgccaactcctctctaaggctgtgtttagatctaaagtttggatccaaattcagtccttttccatcatatcaacctgtcatacacacacaacttttcgatcacatcatctccaatttcaaccaaaatacaaattttacgctgaactaaacacagcctaactccacctctcctgcgtcgaccgtacacaggactgtcccccgtgaacgtacggtcatctagcggatggccacatgaccacctgggcagcttcgcatttgctgcgtagtagtgcgtgtacgagggcgataaacagaacgcgacgcccaagtaccagtactaccactgcacgtactagtacgctgtaccacactggtcacatgtactgatccaaccagtgcagtgcagtgcagcagctgggctagctgcccccagctatggcgatccaccgaccatgtctctccctggcattcagccatgcatgccaaaacaccatccagtcctttgcatccctttccccagcgagagcgtctctgatctggctgccctgcccgccccagtgcgtgcgtgcgtgcaacgacgaccccgacgccgacgcggcagtgggctcgatcgctttcaaatctttccatgcctgcctagcgatcgcctctccttttgttcgccgatgtacatatttccggcgatacatacgtggtacgaacgtactacgcaggccacggccttatcctttgctgccgaaagctgtgcaagaattgaagggcggcagctagcacgcagcaaacctaagtgacaaggagtagtacgtgaaggtacatatggtagtgatagctttgtcagagtttcctgctttggccggcgatgaaacggcacgctgcaaaagcggctgatgctccgttgtttcgctggcatggcacggcagtatgtcaacatgtactgcagcatagagaaaccataacccatgcgcgtaaaatctccccccagcaattttaaggcaaaggctcaaatagcaattgaatctagcaaagtggatatgtaaaggtcgagctgcattgtgacaccgtgctacgcgggtggcacgactggatgaaacagcgcaagacatgcatcaagagaacagagatgaacacaaacgataggagcagcaatttactttctagttgtgaataaaaggtgataataagttcagacaaattgttgctacagcttaagctacttgcaaacatcttttttcacagcacgacagacagcaaaattaaatactaggactaactcttccctcacttaatacagataacagtgagacatataagcaacaaatgaactgctgttaagcttgtctttttattccgtccgttcatcgactaccccttggaaccagctctacggaagggaagctgtaagagtgaagtgcatcgtctgcataataaaagaggggtcaggctgaaaaaggtgaggtttggatatcagctaatgtcaaccaaaatgtgtgcatcctcaactaaagaaaaggagaacatatattattcttcatgcgtgcaaaaacacttctcaggaatccagtagatatttttgtggtaaattaatcaaactaatcatggagtggtaaatttatcacactaatcattgcaagtgatgcattatgattgttctatatatcatgtctcaacagagcagcgaatatgtgacttttgttgcttttgttaactttgtaagaaggcccggtgaattaacttgtaagaaggataccttggttagtgaatttgtaccgtgcaagtacaaaaaatgtaacacttcaaactcctcatcattatctttctggttgatcagaacttgatgctccattaggaggtgtggacaaagcgctggttgatccattctctgctggtggaggatttccccattttctctcagattccaagggttccaatacataaacaccaccatcagtcaggcctagagcaaactgatttgcttccgaaggatgtgccgccacaacgacaggataaacatttgagctaggaaacaaggaacatataatggttaataacttgtctgttaaaaataagtttgaacaaaagaaacattggctgagcaaacaaagataatatgcacttttcctccaaaaacttctttttcagttcagcagtcccattggacatgtattaatgcactcaataaatatattagccaatcaaatgtgaaaaataagccaaaaaaattgaaagataattacgacatctctcatcccctaggattggttgacacaactatttattgtaaagatctggttgcttaaggtaaatttcatcaaagtccaattagtcttagtgatttattgcagctattctgtctatgtgtgttcgtagttgataccccaagtactgttttcaattacctcgactctatattttcttagtttcttagcataatatgctagtgcactgactaaactaatgagattgattgagaacagcaagacaaaatgttttcagaagcaagagtaccaatttaatccagtaagttagaatatataaaggatatattgtgtcctgttgagtttttgtagaatacctgatattctgaggaagataggatgctggaagaattcgacattggagtctcaaactcgatgcattaaatatgcaaacagtggcatccagaaagcttgcataaatcaattgactatcgnnnnnnnnnnnnnnnnnnnnnnnnnnnnnnnnnnnnnnnnnnnnnnnnnnnnnnnnn

SEQ ID NO: 7899 - DNA, 2175 bp, Oryza sativa
tcagcagtcccattggacatgtattaatgcactcaataaatatattagccaatcaaatgtgaaaaataagccaaaaaaattgaaagataattacgacatctctcatcccctaggattggttgacacaactatttattgtaaagatctggttgcttaaggtaaatttcatcaaagtccaattagtcttagtgatttattgcagctattctgtctatgtgtgttcgtagttgataccccaagtactgttttcaattacctcgactctatattttcttagtttcttagcataatatgctagtgcactgactaaactaatgagattgattgagaacagcaagacaaaatgttttcagaagcaagagtaccaatttaatccagtaagttagaatatataaaggatatattgtgtcctgttgagtttttgtagaatacctgatattctgaggaagataggatgctggaagaattcgacattggagtctcaaactcgatgcattaaatatgcaaacagtggcatccagaaagcttgcataaatcaattgactatcgcaggagaacatggcatgcgttattggagaagagttctcccggacaggccactgaaagtaaagttaaggtgagtaatgaaatagcctttgtagttaacttgaactgcacgtgaagagagaatttacctgcttcacgggttctaattttgtagtttcatatatggcaatctgggtctcatgcacaacaagaaagtgcaattgatcctgatggaactgaacacgtgtgtctaagattatagatgatggacgacttgatggtatctgtaacattctgctctttaatttatcccacccatctgtgctccacacacatatctacaaggaggaaaagtataaacagtaaagacaaacagaagtggcttgctctatggtgtgagttgatagttcagtaaataacctgcgcatcagctccagaagagactaacacatttaatacatttgaaaaagcaagtccagtaattttcttagagtgccctcgaagtttgcttttgacctgtgcaaagaatcaaaaaaaaaattgattgaatcttgttccattttttataagaataacgcagagcaatgccattagatgtgctaatacctcatcaattcgaacattgtagatttggatggttgagtcatccattccaattgctataatgttgttatcttgaggatggaaagcaagaaacgttgccgccggcggcggaggcataaaagttgtcatcgtctgcagtcaccatatgattaaagttcaatttctacataagagacaaacaatagaaataaacttgtaactaaccttaaaagtcatcatgttgaacagagatattttccctccagatgcagacatgacatatgaatcattctttgacaaagcaaagcaatggacagcttcttcagggttgtcagttatgtcattagtcatgaggatgccgcttggaggttgccataattgaggagaaacacttgcagtagcctagaagagtcaatagcaaacataaaaagttagtaacaatcatatgcacaaattgcttgcccctggacctggtatacagagcaggtaggtaaaactgagcatatttatgtgcgtaaataatccagatttaacctttccacttgagtttcggtcattgcgaggccatttccagagcagatgaacagcatttgaagctaaagccaagatagcgacaccagaatttgtgtaaataagtcttgaaatctgcagttcaaaacaaataagatctatggaaacccttacagataaaaaccagcagttggtacttggatgtggatcagaagaatctcaagaatgctagtcaaaatatgaggtgacaaaacatttcattctattgggcaagcatcattcacggaaacagtcagtggctttagttcaattaacaatcatactctgcaataggggtgggcactcggtttttcggtttaatagggtcggtcttttaggttttttatataactcggtttatgtaaaatactaaccgacggtagctatggaaaaataaaaactgagctttccaaaactgattaatgtcatttcgggtttatcagctttcggtttttacccaagaatggcgcgctaaacgaggacctacgcacacgcaagcatggaactcgcttgatgatg

SEQ ID NO: 7900 - DNA, 5769 bp, Oryza sativa
  unsure (1)..(5769): unsure at all n locations
nnnnnnnnnnnnnnnnnnnnnnnnnnnnnnnnnnnnnnnnnnnnnnnnnnnnncagttgcccttggatgtggatcagaagaatctcaaaaatgctagtcaaaatatgaggtgacaaaacatttcattctattgggcaagcatcattcacggaaacagtcagtggctttagttcaattaacaatcatactctgcaataggggtgggcactcggtttttcggtttaatagggtcggtcttttaggttttttatataactcggtttatgtaaaatactaaccgacggtagctatggaaaaataaaaactgagctttccaaaactgattaatgtcagttcgggtttatcagctttcggtttttaccgaagaatgccgcgctcaacgaggacctacgcacacgcagccatggagctcgctcgatgatgacgacatgcctctgatcttccaccgtccaaccactaatcaccaaagctgcttaatcgtccagcacaagctccaggagcgctagtcgccaacccctgctgcactcggccgcgacggcgagcagcacgaccacacgaatcccacacgaccccacgcacaaattagggatatggggaaaagttaatgggccttgtgtagttgggccaggagggagacacacacagatcggttttctcggtagttcggtttatggcagatgaagactgaagaaaaaaccgcacaccaaatgatgtaaaaaatcaaaccgagcaagcaagcagccgaagaccgaagaaaccaccaattcggctcggttcggttcggtctacggttttcggtgtttttatgcccacccctactctgcaataaatcaaataatattagctatggaaacttgtcaaaacatatggtgtttgttctatacacactaaggctgtgttcggcagacacagttgggaactaatccttggtgcacgcaaaacaaagcagctcattagcgtatgattaattaagtattagctttttaaaaaaaatggattaatatgattttttgaagcaactttcctattgaaaacttttgtaaaaaaaatgcaccgtttaatagtttgaaaagcgtgtgcacggaaaaagagggagatgagttgggaaaggagaggaaagaactcagcctaaaaaattacttaataatgtactacaaagtattaattttatagaaccactgagacagttatactgcagattgcaacaagagggataaaatatcaccttgcttgtcctcatattatctgttaatttcaatgatctgcactgacttgactcggttatctccataagtttccagacttttgatttatccaatggctcatcagctattctaggctttacatcaaccaagcttcggctatccccattctgtagaatttttccaagaatgtacaagttagttgggtcactatagaaggttttctgatagaaagagaaagatcaatagaaaaggaattgtgaatatggtcaaaccagtgcagttattgccggtggagcagcatttcctgaactagtcccggcagcagcagctgacgccgccgcagcagcagcagcagtcaatggattcattaggggctgcaccaagatggatctattgggtcaagcttgcaaaaatatttagttgtaattttaaatggtcacaagaacttacctttgttacagtctcagacgcactccgagaagcatcaaatgaacgattttccaatgtgcgcagcaaccgtactccatcagcatttgctaagatcttgataccattttcatgggtagaaacagccagcagagtaccttccttgttgaatcggacccgtggacttgcctaataattgcatgctaggttagattaagatggaaatttccttactcatttcatttgaaccaatcaccatttaccaaagtatctacagataaaggaaaacactcacaggaagaccaccatcggcatcaatggtagtcagaagacttgtgttgtccatgtcccatatcttaatcaagaattcatctccagcagccaaaaacctgttccgtgtggtatcaaattggacaacacccatcgatcgcttgcgaaatccctggtaagttctcttgacagctccttcactttcattccattccactagatgtgattcgccatccttgctagtcccacaagaaaataacctactcacaagggcaaaaagaatcagtgaaaacaaagacaaaaacccagttacccacatgaatcatgctaacaaagaaataattatgaaccttgaaccatctgcactatatgccattgttgtgcaccaatgtcctggcgcatcatagtcaactctggatcccaaattatcatatagccaagcctttatctttccatccaaagcagttgagaagatgaactgcacgaagaaaaataacaacaggtaaggaaaagtagcctccaatagttaatattgatcgttatagcataaaaactgcaggtgcacctgaatattttccttataatgtggacaaacagagtaaacaggagcttcatgaccttcaaatgtaaattgctttgctccactagtggcctcccagacctagaatatggtgcccataaaacttagcacttctgggttaaacaaagagactttcagtcccagaactcatgcaatcacagaaactcaccttaattgtcttgtcatctccgcaggttattatacatagctgcttatttggatgggcaaatgcaatgtcatttacaccaccgacatgcgcatcaatctagttaagaaaggagggattaatcaaattcaggaatcagattagacgattatacaataagaaactaataccaattaggaaggaagaacttcctgtcaaaacaaaaaaggaaagaagaacaacgaatatgcattcatacctccaagtgctgcctgatatcatcaccgccatggtatgaatagatctgtacaatatgccttgaataagcaacacctgttaaaaagagacattagaaactgtgggtagaggatagaaaaggcacaagtccacatcatcttaccaaacaaggttccatcaggactccatattatgcggttaactgagacagtagggtctttgacaagtgatgcctattgaagaatttacaattttacatggtcatagttagattgaggctaataaagagcaacaaaaactcaaataacatagtataacggacaaacctggagggccattgagcattttgtaagatcccaaaccttgaagtttcttaaaacaagtcgttccttggtaccgacatcccataatccaatgtcaccaacattggtaccaactaaaatataagcagtgtatatgagaagctatggaaggggcaaaatttgatttatcatgagaaagcaacaagaatttaagaactgaccaagaaggagagtttgctgaactggatggaagtccatgctcattggagttgatccttggctcaatgtccgtgcaacatttttatgaaaatcatcttgcgggtaactatgactctgtggatatgtcacaggtaacatattcactggaagattcacctgcaaaattagatcattatagttacaatcaagtatatatgtcaataatgattaggcaaaatgcaatggtattataaagtgtcagcgtacactagaaatagcaaaatgtatttcaaagagatgtgacaaatacctcctcagacatcccaactggtctcgttctcttggagacgtgatcagaatctcctgatggataatccatagaaggattggcagttgttggtgttctaggatgttttaatatagcagctacaagatttaaaagaagaatgccatgaatcaacagactatgtgtgctgtttccaatttagaccacttaataatagtttgtaacagtaattagaacaggtaccaggatttgtaggagtaccaaatccaatagctccaccagacacagcaggatgtgttactgctggagggtttgacatccagccagccagaggtgggacaggtgtaggtgcaggttgaaatggctgaaaaagggaatggaaccgatttcaaaacaaccgtgtccttcacataaacatgaagcatccaaatatgctaaaaggacttaccgcgtgagcacccaatggggggaaacctccaggttttggtatagatccaagtaatggattgtttgctggcgatggagcacgagcaccatttggttgtccacaagaatgatcaacaaacagagtcttgatatcagggttaggtctaggatttttgcaaagctggtgctgccagtttaagctgcaacatattataaaaaagtcaaaggtccatgcattatccctcctccacattaaaaattttaaacatatgataaatcaaaagtatacagcatggtgctgtgaagttatccctagaacttagaatcagcaagcactaattctgagttctgacaacctaccaagtagacagccaaatcttacagataataaatagtgataagtaattcgcaacatataaagaaaacagtacagataaaccacacaatggtgtgtgacgtgagtaaatcattagataattttccgttttcaacttcaagctctatatgtctatccaatatcccagaaaatgaataatgcaacagaagatttaaaacttggtatttataccacatatgtcataaaaagaaatcttcattaggatgagtgtcataaatgagccgtattgctcatttagttcaagctaaatatagcaggttatctttgctaaacaagaagcagtgatttaaataaacttgagaaaaaaattgtgggtcctgtggaacaaagtagttggcttataaactataacattatcactggaactgtcaggagctgacatgagttaaagtcctctcatgagatgtacttatgtaaccagctgtattgcaagaaacaaaattccagatgattgaatgtaaggggaagccgtgtttctccatcatgtgctacctctggtttataagtgtccgcaatctggagctcttcagatttggaaactgaagcttgtcacggaacaagggattagcttcaatcagcttctttagttcaacaagcattattgctctggcagattttgtatcaccgtatttggagagttgctcattttccctatcaagacaaaataaaaaaccatagactgagcaaccaagtaatagttacagccacaaaattaatggccatgctctaatgtacataaataaagtgtcagaccaccattttggtacattacattcatacctaaagttttccaacgtcaaaagctgtgtgatctccttaaacaactcctcgttaaaggacgcgaagaccttcaggtccttgaccaagatttcaaccgccttcgaacgatcatgcctgcagagcagcaaacaaacccagttagcaacgctttccactccagcacctaaaattcctgtagggacatgttccctcccatacttacttatcaagggcctcaagatacttctgtttgcggatctcaaagaatatcttcatcgagtagcggttgtcatcaaccttggtaaagccaccgaggtagcgctcaacctcatcccaattcccattgatcacctcgtcttcgaagtacttcatgttgaagtagaacccagactcctgctcaagcctgaacaacagcgccggaaccccaactgagttaaacaaacgctaaacagacatgtgataatttcaccctttttttcagcctagattgaaacactcacttgtgaacagtctccttgaacttctcctcatcgaggaa

SEQ ID NO: 7901 - DNA, 5507 bp, Oryza sativa
ctagtaacaataaaattactaattataatattttttcaaataagacgaacagtcaaacgttggacatgaacagtgataaaactgcatttattttggaactgagggagtacgtaaactaccttgctacttatgcgatactcttgaaaacgtaaaaattacatctctcagtaggaagggcctaattgccgtattttttatgccaacgcttgaggttttctccataatctttcttgactctctgatcaacctgggatagataggcttgacatgtaaaacctccatctcatgattgatggatgctctccacttggcttttgtaatgaagtttcatgaatacgtcttcagtgatacaggaggcagtctctttcataaatggagatttttattgctcaaaataacctgatgtaagcacagattgtccatatcacaaaacacgcatgaacgcatttctatcttcatgctcactgtataacggattccttgggtacaataactcgagatataaactaggatacaggctttgtggcaaaactgcgaaccccttagaaaacccagaaatatgatagatgataaacaagctgggggggggggagggggcattatgatagatctggtgcaaatgcaggtacgctgctggcagagccaactggttcttgtagagcaaggttcagtggaaacatctcacattgagcaatgtgcgccatcagctggtccatgaggactaatgcggccatggactccaccatcggcacagctacaagagttaattgattgagaaaatgtcagattatactatcatgagtgagtggttaagggaaggaaaatttaggtactccctccgttccagaataagttaatctagtacgggatgtaacatatcctactacgaatctggataggtgtttgaccaaattcgttatactggatatatcacatcccgtactatattaacttattctaggacggaggtagtagagccgtagatccattaccgcgagggacaacacatgggtcgtggcggccccttgctaaaagttcaacatcctcatgctcccttgaaacagtatgttgtttcttctggaaaagcgaaatccaatatctcaaataagtagcaatatagccttttaagaaatagaaatcctcaaatgttacatatgaatatatgatacaccgtaaaagacacaaaatgtactatgagaaaacactggttttagctgcatccacaagactacaacaccatagtgcttgccatttaaaaaacatgacatagcactatttctaaggatagatttttttttaatatactgatgaaaaaatgagttacttgaaccggaatatctcaccccaatagtcgcggttggcttgaaagctactttgaagtatataatttcaccatttgatatccctccctgcatggacatacacattataaatactaagacaacggtgttatactatttactagtatttttttaatctagaatgcagctagatgtagcgaaaacaataaataatataactgtaaaacaacaggggactaggataaaacctgcacaccgcctgaacgattagttcttgttctcacatttccagcctcatccatatagaactcatcattatgctcacttccagtgtagtcagtacctgggcacaagttattagttagtattgaggccagtagcaaagtagttggcatgcacagctatttgcaaaaaataaatcaactaattatgtgcagattaattcaattacctgcaaatccactgccgatctcaaaccccttgcttgcaggaagagaaagcatagctttcgccaattcagcctcaagtttgtcaaatacaggagagccaatcccctacaaattgtcgttgctctatcatatcagtagctcaacagagaaaaaatatttttctaatgaatgatcaagcttcaatgttcaaacagattttgtgcaaattccaaagcagggcggtcataagcagagagtgcaaacgatgagcttatttagtttattttagctggaggacatatatcaaaataaacataactgcagggtttaaatacttacacgaggaacatttcttgcaatgcatgtgaccacaccaccaatcgaatcacctctaactcgtactttatcgattgcatcaatcatcttctgtgcatattctggatcaggacatctaacaatgttgctttctatctggaaaataaaataaatataatattcagcaaatgccttcagagactgtccagaagtgttaaacttgaaaatggtgggaaccacagacctgttccattgttacagtgtcataatcaacggcatcttctggtagtacaacttgatgcaccttggacacaaacgccaagatctgcaattgaaaatattttgctgctatgagacattggacagaatttgttgcatggcttcagcatatttaggatgtatattcgaatgctgattcatttttcttcagcgtccaattgttcatggataagtaaacatgtcaattgcgatgcttgatacaaatcttgatcagttaagagtaaaaggttgccaagtaggatcacacctctactccagatttgagcttaagaattttctttgcaagagctcctgcagccacccttccaatggtctctcttgctgatgatcttccacctccctatcattcggttgatagaagatgttggttaggcattcaagtaagagaagtttaggtaccacagttttagacattcaaataagagaagtttaggtactacagttgatggttcaatgaatggctatattacacattataaaacatgaaaaaaagtacctgcactgctctaacaccgtatttgaagtcataagttgcatctgcatgtgaaggtctgtaggccttagccatttcactgtaatcctgtgggaatgaatatggttatttccagctttaatatgttactccctctgtcccaaaatataagcatttttagctatgaatctgggcaattgtgtgtccagattcgtagccaaaagttgttatattttgggacggaggtagtatttcaatacattaatgcgaaaaaacttaggtacttacaccccctctctgatctgtgttcgggacaaaaacatgaattggtgtcccagtggtcattcctgcagaaaacccatcaatgctatcgtgaatatgagacaagctaatactctaaattcaaaaatattttttccaagtttatcccatgtcctgaaagacaccataccttcatgtgtccctgaaagaattttgcaagtgtcagtctcctttcttggggtggttattctgctctggcctggccgtctgtgataatcaaaattttatgtcagttaacattatggtgtaatgtaacataacaatcatattctgcaagaggttagcaggattgcatttgcataatcctgtttttgacagaagccagctgtcagcacagaaataatggatttttcaagagacaaacctccggtcgagttctacttgcatatctgcttcagtaagtgggattctgggtgggcatccactgattacgcaaccaacaccgcctccatgagactctccataagttgcaacctggaagtagttcccaaatacatttgcagacgccttcacctctgttttcaaatttcaggagcaacggatttaattaagtcctttcgccatccttctaatagaacaaaagtaatgcaaagtagcagatttaaatactctatttctaactaagatacgtgatcagtatccacgatgacactcaaaatccaaacacggcaacattaaagctagttgtcatcctaatccccaagatctaaattctcaatgatactaaacaaactcttgatgctaggatagaacgaagcagccgtttttctctcctttcaaattaccctatacaatagacacaatcatggcataaaaaaatgctaaaaaatggtaagattctttcttagccagacaacgagtggcaaccctcttcacccacgagtagatgaccagacaaaactcaaagccgagagaggccagccaagcaattcccagctgccccgtagccgcgcaggaagcaaactctacccgaattccaccgaacggacccagacaagggggggcgaaacgattccaataggcggacctaggcgagcggcgcggcggcggccgacggagaagcggagggaagccggggcggactccgggaaggcgcggaacccgccgccgccgccgcgggggaggacgcgcgccaccggctgcgacgacgttggcgcggccatcggagcgaggttgttggtttggttggtgagagccgaagcgaggcgaggacgcgaggtggggaggggaggaggaaggaagccgccggtttaatacgcgacgggggtgtcgcctcgccacctacccctctccccactccggccgcccggctcttcacctacgaccaccggtccggtcagtccgaccggaatgggattctttttcaataaaaaaaccgcccggttcaccagccgaactagcttgaaccgcccggccgattcactgatccggtgtttgaaccggacagacgttgtcagattttgacttgtaatctgacctcgccattctgatggagtgatcgaatctggtaacacctaccaaccgaggacgccatcggccattctaaagtggtcgcctattccaactcccagcagcagccaggtaaccaaaggtttgggatcacacgtttactttgattttaccactagcaaaaaagaacaaagtttgaagcgtgatcccaacggcaacggcagcttgaccattgcaattagctatctggccatgttgcaagtttatttccatgcaaaaggtaagagcaatcagagcagaacatatatggtgtcatctcatctcatcaaggcaaaaatataatgagaatcatgaggaaattttgtacaaatctggagtccatctgctgtaactctttttactcctgatggagggaaatcccattaagtatgagatgttctccacttcttcaggttagggcaatagtacacgcatgaatccatgtgatgtgtatatggtacacccactccactcctcttggcatctaagaccttcacccacacaggtcaggtcaggaagccacattagccagaagcttacatgctaacatacactggaaggtacacatctgttacatctcctccccatgctcaaggcgagagcgcagagcgcgatacggggaaggtcggaaggccccaatctaggatcatatatcatgatcatatgcgcccgacattgtcgcagctacacctcttccctgtgtgggattggcagcgattgggatggctgctgctgatgctcttcggctttgctgttgactttgatcggtgaatcgggtgacggctgctgctgctcttcagctttgttgttgactttgatctcaagtagccgctcaacgggctgtcggcagatcgggcaccgggtcgtctggtacctcaggaccttggcacactcgctgcacat

SEQ ID NO: 7902 - DNA, 946 bp, Oryza sativa
cctgtgtgatctgtgagtttggagttttcatcttttgatcttctccttccaacttttgatcaacaggcatggttgtttcagctttaactgcaagtggatatacatccatgtccccctgcttcaataactcggaatcctcaaacacggagaagttgattccagtgccagaaggctgtctgaacttctgaccaagaccctctttgaagcttacagtaacaggcttaatcaggtcttctttcaccgccgttagattgcagttgagctcttcttttgcaaagaagtaaacagtcatgctgtccaaagaagtaaacaacaagaattgtttaaacactttgtttgttcgtattaaaaataaagatttactttgtttgtagtaagatattcacaatgcttgacacatacaacatgaatagtaatgatgacacaagccataagagcaggtacaatagcatactattagccagctataaacatattttaatgagataaaagatgagagagaagagcaacgggctacagatctgtagccagctgcagcacggactccaagacgtaatgtgtgtatgacaggtgggaccatatattaatagtatattaagtaactattgtatgaattggctattagattggctatagatgaagtggagctagtagtaggctatactattaaacttgctctaattaacaataacacggctttagtacaaaacagtaggaattctctataagaatatcagtaccacattccgaggaaggatgagccaaattgtgctgggtaatgtgattcccactaccacggacaattcaatggagaaaaattctaacacattcaaatatttaacaccctatcgcatttcaaactatttgtgagaaaactgtagcaagaagcaggatataacagaacgttattacagcttctggaacataaatgcttgataagggaaaa

SEQ ID NO: 7903 - DNA, 622 bp, Oryza sativa
cgaagacgagacgttttcttttttgttttccttttttaccgccgttttgccaattcgcttgggtaaacagaggcgctctgcgattctaacactggttttttgttggcttgcagtaccacggggggaccaacttcggacgaagcacgggagggccattcatcgccacgagctacgactacgatgctcctattgatgagtatggtgagtgtactgtcagcagctagctgtacttatttactgccacatgtatgcctgtcaatggcagctatgttaaattgaagtatgtttgccgtctgggaatactagtattgactagtcacagttaaaaaaagaacatgaatatccatgaggaaccgtgtgtcttttataagaaagatatgaaccaaaaaaattgagcccaaacggctcccctatgtgttgggggtgtaccggtacaaccacacatctcactaaccgaatcactatcttttgcaatattgtggttcagggatggtcaggcagccaaagtggggccacttaagggatgtgcacaaagcaataaagctgtgcgaaccagcactcatagcagctggaccatcatatagttctttgggtcaaaatactgaggtatgtgatcctctct

SEQ ID NO: 7904 - DNA, 817 bp, Oryza sativa
taccccacatgaatcatgctaacaaagaaataattatgaaccttgaaccatctgcactatatgccattgttgtgcaccaatgtcctggcgcatcatagtcaactctggatcccaaattatcatatagccaagcctttatctttccatccaaagcagttgagaagatgaactgcacgaagaaaaataacaacaggtaaggaaaagtagcctccaatagttaatattgatcgttatagcataaaaactgcaggtgcacctgaatattttccttataatgtggacaaacagagtaaacaggagcttcatgaccttcaaatgtaaattgctttgctccactagtggcctcccagacctagaatatggtgcccataaaacttagcacttctgggttaaacaaagagactttcagtcccagaactcatgcaatcacagaaactcaccttaattgtcttgtcatctccgcaggttattatacatagctgcttatttggatgggcaaatgcaatgtcatttacaccaccgacatgcgcatcaatctagttaagaaaggagggattaatcaaattcaggaatcagattagacgattatacaataagaaactaataccaattaggaaggaagaacttcctgtcaaaacaaaaaaggaaagaagaacaacgaatatgcattcatacctccaagtgctgcctgatatcatcaccgccatggtatgaatagatctgtacaatatgccttgaataagcaacacctgttaaaaagagacattagaaactgtgggtagaggatagaaaaggcacaagtccacatcatcttacc

SEQ ID NO: 7905 - DNA, 766 bp, Oryza sativa
accagcaccagctctcacaggttttggcccctgctgcatcatcacccatagatgcctacaaaatccatgaggctttattaggttaatccccccaaaaaagatagtattgaggaagaataattttacatacaatagacatgaaataaatcctcttaattcttttatgagagaaattaaccgaacaagatgcgacggggcggtcacatgtgtccttgccccttcacgatcctgttactccgtgtgtataggataaaaacactaatgtcaaactagctacaattggccatcagtttatcacagtgctttaagtcgagctggatgcttttttaacgtttttatcgagcgcgacagtgcaaacatatcgtcgtcgtcggttggttgattatactcacaaacttgtcgttaagagaaaggagaagcgacatggctagacgtgaccggcccatcatcgatctgatcgatcagatggttggttagctttacgtcgttgttttctagtctctccctctgatcgatccatgtatcgtcggtgcaaacggccatatggaggagtacctatggtaacgggtggcttatcatgtatataatgtggctcttatcctgtaaaatggctagtggcactgtgttagaaatagattgagatccaatgcagttgctattgccactgcacacaatttgagccttttatttcttgatccaatggttcaaattgcttgccccagtgaattctgaaatatatagggtaccgagctcgaattcgcctata

SEQ ID NO: 7906 - DNA, 3330 bp, Oryza sativa
  unsure (1)..(3330): unsure at all n locations
nnnnnnnnnnnnnnnnnnnnnnnnnnnnnnnnnnnnnnnnnnnnnnnnnnnnnnnnnnnnnnncacctaaccacatttattgcggtttggctgagcgtgtcacgccgcatgtaacgcagtgcagtgcactagtttatccggtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaagggggggcctgcgcggtctcccggtgaggagccccacgctccgtcatctggcgcgccaggtagggggctctgcgagtgatcttctgagctctcgcactcttgcgtgtgcgccaagcttttcctgttcagcccaatggccgaacaagcaaaggcgcacaacctctctccgagcgttagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggacggcgagacggggagcgtcgcctcctcgtctacggcgacggcagcacgccccagggtgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgatagggtcatggcgaatttctttcccatggccctgaagggacaggtacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctacacatgcggtgatctacgcgttcagggggggtgtgcggcacaaccgcatgctcgaaaagatcgcctccaaagagccccagactaccgcggagctttttcagctcgtggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgataactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcagctaaaatcgccaaacggggcccagaaccgagccgtgccccgggacgtggtgaactccgggggggagggaatcggcaaaaacccacaatcgggtcacccataaccctcggtcaccacgctcccggcttggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactattgggtaccgagctcgaattcgccctatagtag

SEQ ID NO: 7907 - DNA, 3174 bp, Oryza sativa
gtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgtcaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccgtcactgtcatacgcacattcacccatatgaaaatacgtgtgtataacctacccttattagcatctcccaaagactgggccggcgtatcttcatatttacgaagtcaacattagatgcatcaatgtcgatgggtacgtcaactaccattaaaagaactagcaaggtggcccgcacagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaattatatatattcttatatggactctagactcgtcttttaatattcctttcttttttaattccgaattttctgtaaattgtatttctatatagacactatgctcttcttccaatattatttatttttatttctgaattttcatattatattttatatacgtgttagttattaattatttttaatatcaaattttagttatttgtaaattatatatattcctttatggactttagactcgtcttttaatatttcttttttttaattccgaattttctgtaaactgtatttctatatagactctatgctcttcttctaatattatttatttttatttctaaatttttattatttctaattttatttctatgtggactctaaacttatttttcaatattctttaatttttaatttcgaatttcagttacttctaaattgtattcctatatttgtattcatatattgaccttaaactcttcttcccatgtttttcttaatttataattttagttatttgtaaattgtatttttatacggactctaaactctacttttaattttattatgtttattatttcaaattttagttagttttaaattcctatatggactctatactatacttctaatattccttatttttaattccaaatttttattatttcctaattgtatttctatatggactctatactccaattctaatattccttatttttaatttcgaatttcagttatttcctaattgcatttctatatggactctagtctcctcttctaatattctttatttttaatttagaatttcagttatttcctaattgcatttctatatggactctattctcctcttctaatattccttattttttaattccgaattttagttatttcctaattgtatttctatatggactctattctcctcttctaatattccttatttttaattccgaatttcagttatttcctaattgtatttctatatggactctagtctcctcttctaatattccttattttttaattccgaatttcaactatttctaaattgtatttatatatggactctagtctcctcttctaatattccttattttttaattccgaattttagctatttctaaattgtatttctatatggactctgctttttctttttctctgattaatgtgagaatttctaggccatgagagcgaacatagaggctcctttttctattcatttaataatataatagataataatttagccgtaaatatgagtacccaactacccatgttaagtctagcacctgagtccaggtgggatggttacaccataggaacataatcagttgagctacgcttacttctacgtagctatattctacaacgaagataatacatgaaattaattcaaagaatgttacaaatggttacgaagataaaatatatagatcgcaaaattaaataggagaatattttgtttggttaagaagagaatattgatagagaaaatgcctgatttttaaacaaattttgattacttctatattttagatcaaattaatgtggtactttttcatatgtggtcggctcatctcataagcatatggtacgcactatttatatatgttccctttgtggcaaaataaattaacttatagagtttaaactttatttcaaaataaaaggttagctaccatgtgattctagacgatgctccagttgctatccgtgcgtctgctttcttaaatattttgaaatagagatgttgtgtaaatatctgtattaaacctcaaatttgacgtccaaaataaaaaaggaaacacggctaaagtttgaaaaagattcagggtgtgttgcgtgagtgaagctgatctaacagtcggcttaggaccggttcgaccgacggcagatggctggtcgaaccaataacatttgaccggtagagtcgactctgagtttaatttgccggttctcatactttcttgcttgggtttgagttctctcgagtcataattggtttattgtc

SEQ ID NO: 7908 - DNA, 2750 bp, Oryza sativa
  unsure (1)..(2750): unsure at all n locations
nnnnnnnnnnnnnnnnnnnnnnnnnnnnnnnnnnnnnnntcggctcatctcataagcatatggtacgcactatttatatatgttccctttgtggcaaaataaattaacttatagagtttaaactttatttcaaaataaaaggttagctaccatgtgattctagacgatgctccagttgctatccgtgcgtctgctttcttaaatattttgaaatagagatgttgtgtaaatatctgtattaaacctcaaatttgacgtccaaaataaaaaaggaaacacggctaaagtttgaaaaagattcagggtgtgttgcgtgagtgaagctgatctaacagtcggcttaggaccggttcgaccgacggcagatggctggtcgaaccaataacatttgaccggtagagtcgactctgagtttaatttgccggttctcatactttcttgcttgggtttgagttctctcgagtcataattggtttattgtcctagtaagacatggagatggatcaatgaaaggcaagaccaacccttttataacgttcatggctagtttaattaagagataagctgcactcaacgcattagctaattgagaatcattcaatcagttttgtatatactttttatgtaattcgttcatcttcacctgtttgcgttgtaagacatccatcctccatgtgagagtgcgaatcctctttaaacatttgtcttgtgaatcttccgttacatctataagacgggagtttgtctcaatttatgtaaatgagctccgctacctgaatttgatcttctaaacttgacttgaggatttttctcaagattaggattgttagtgactcgccgtaaatttttgggtaatttggaaccatgtcattataattttgcaaagtttgagatatgtcatcggtatctcaatgacttgtaaggatgtcatatatcaaattttgtaaaattataatggcatggtttcaatttttcctaaattttttaggtgaatccgaatcgtgttggcgacatgatcaaaattagacgcgaattgagcaatatgcatgctggagaactcctcttatagtcttattcccttttttttttgtcgccaagatgattagaggtgtagttaattacttaattatctttgttggttgctctacttttatcaccgtctactcccatcattccttcgccatataataggatgcaatcacttggcaagcttgtcaggtaggacaatgttcttataccagattccatatgaaccgggaaatcgggaacttccgtttggctctgttcagcaataacaggaagaaattagtactagcagcagtggtgtctcttgcaggtgcagtgtatcgataaggttttttttttttttttgttaatgtgatctggcccttgatactgtagttgtttatgtaaagttggtctcgtgttgttctctaacttctatgtgctgaggagcagctgttccttttcttgtctgcttatcttgtttcttaatttaaagacgcacaggttctttttttttaattccaatgatagttaaacgaaattgagttaatctatacgtaaacgtgcgtggatcaacaccttaacacgtttggtgatacataaccatacaaaaactgcacgagctgcagtattttccaatagggccacctaagcttcagactattaataacagcacctaagcttcagactattaataacagcacttacaataatgcaatactcttgaataagtcacagttgtgtgtatacgccttttgtaatcagaaggaaacaactctcacctaagtcgcccagggtcgtaaattaacacccgatagacctagacgattacataataagcatatcaattctgcaacccgtataataacagttattttggtaaaatagaagtatacttacttccttcgtcctataataaatttattttagctcatttcatttgtcccaaaatatttagagtggtcattgtattcgagtttatgaaagtagaaaatagttgtgtttgaagtagataaaatgaggaatggttatatattgggatttgataaagcagagatattttaggtttttagttttgtattggtatgtattaaatggatgacaaatgaatttactttagaacggaggtagtaaaaaagatgaacaatacttgatttgagtaccaccaccatgcacccaatgtagtatactctcctacttgtagctgttttcctgcgatcaggatcctctacaattgactgcaccatgcatttatcactgacatctctctatccgtctccccgtacctccacggttactctcactcatagtatcaggcaacttcgacatcaagcaagacatgaaccacatagtacaaaacattaattatagcaaaccaaatcattccggaatgcatcggtacggtagctattgcgtaccccgtaaatgcacacgatccccaattccccatcgagcagttgtcaaaaaaaaaaaagagaaaagaaaccaaggcctatttgatgagaaattagctagcttatcgtgaaattaaatttgtatgtcaccgtgcattcagctcgtcaatctcgtctgtacgccgccctgacgttgatcattgcctcagctcgttgacaacgaggaagtcattccatccatcaccgccgccgctcacaccggcacacgcgtgtgctagtctcacgatgcagtcccacaccgacgaccgggagaggcgcggacgagacggttctgttcagtttgtggggatc

SEQ ID NO: 7909 - DNA, 1781 bp, Oryza sativa
  unsure (1)..(1781): unsure at all n locations
nnnnnnnnnnnnnnnnnnnnnnnnnnnnnnnnnnnnnnnnnnnnnnnnnnnnnnnnttccaaacaagatctacgacgcgcagcgggatgtccacaccgccttcccccccacgctcccgatcgtggaagcagcggtgacaagaaaaatggcctgttcactttgatgccaaaaaaaccttaccaaattttggcattacaaaaattttggcatagttgccaaaattttagcaggattttctatatagctaccaaaatttggcagcaatctaaatatagccacttttttagcaactttaccaaaatttgataagtttgaaaatagcatcaaactaaataggccaaaagaatagcgtgcggccggctgcctgccctcgtgccaccaacggggacaggggatcggatcgtacgtgccgcctccccctctccagcctccgcgaccggccgcggcgccttcgctgccgtgcacgcaccgtgccgtgcttgccttgcctgcttggtcggcgcggcgcggccatatcccccgcgccgcccgcacgcacgcccgggccgcgcgactccaccgccgctcgcgtttgaccgtaaccgaaagcgccgcgcgcgagtcgtggacccggcggatcgggccaaagaggcttttctgggctcacggaccgccgctgcgccgatacactacacacactgtttgacccgaccccatatcctcctcttgtctccgccgcgaaaccgcctgccccgggggtggacgtggaccgagccttcggtacaccacagcagcaaaacggatcgtacgcgacacggggacacgcaggcgcaggtccgtctaatcctacctgaggttgcagccttcggctaaaaagctctactgtttccacaccaacaaagcagagcctacacgctgacatgtccattgcttctgctcccgacagatcatcctcgcggcttagctgtggaccgggtgcatgcaaggtaggtaccccgctccccagctgatgaactggcgtccacgtcgtcacctcacccagccaacggcagccatcattattaactcgccacttacgctgcctccgagatgattttcacttgaccacgcatctttaatccggattaatcacctccttccttcgcttttaattactttttgtatgtttaatcaccccgccgaaccccaggtgacgaccgcgcgcgcggcggccgcggctactcgtggacctggtgcacggcgcgggggtctacccgcggatctcgaggcagcggcggacggaggagattcctccacgtctcccgacctggtgcggagcgtccacgcgctggaggacaagcgggagcatttcttccatcggttacggcgcagcagcaagacacgatcaaaggagagagagagagagagaggaagacgacgacgacctttgttgttgtttccttctttctcttctcttctcctcatcctcctctttagcttcctctcgcgctcgccgtctctctctctctctctctatcgggcgcgcgcctttctgtgttggtcgtctctttcctcgcgtgctctgccgctgcgcaagaatcaaaaggcgccggccactagagagagtgtgtgtttgtgtgtgtgtggcttgagttgagagttgagagaccaatcgaccatcggctgtgatctcaaaagagagagaggggcaaagcgaagtgggcagacttgggcggcaatccttgcgaatcatcaagggattctgtcttttctttggtgcgattcgattgtttctttgtagggggaagggagaaaggaggggg

SEQ ID NO: 7910 - DNA, 4187 bp, Oryza sativa
  unsure (1)..(4187): unsure at all n locations
cgcaatcacgcacgtgcttcacaacaagcacgagttcccgttcgtgcgcggcgtcgaggacctcctcgtgctctccatcgggggatgctccgccggtggcacgggggccgcggccgacgccgacctccgacgcttgcgccgctggggtcccaaggattgggcgcgccccatcgcgcgcatcgccgccgacggcgccgccgacctcgtcgaccacgccgtggcgcgcgccttcgggcagtgccgctcgtccaactacctgcgcattcaggtgagcaaattctcccactgcattgcgcatttcgaacgaacgttccctcggattaaccctggtacaaattctccgccatgatcaggcgaaacgggagagcatgccgccgtgcgggccggacggggagtacgacccaaccccggcgaacgtgcacgcgctgctcgcggcggcggacgagatgctgaagcaccggaacgtggagtcggtgctgttcgaagggaggcgtgtcggcgagcagacgaacgcggagaggctggactgcttcgccgccgagctcgtcgccgagcatcgcagcaggggctcccgtattggccccaccgtggcgttcaagcaggcgccgcggaagcagccgccggcggcggcggtggcggcgatgggctgagccggtggccgcgtgcactgtggagtaaggacatgtaggccctctctttcttcttgctttcgctggaatcctgctgcattttttacgtggcagagtggcattgctccaagaagcattttgccaatgggaaattcgacttggagaaaatatgaaagaacatctgtgatatataatttcagcttcatttcaatttagcatagaattgtactagtatcatctttcttcagaatcatatgcttctttgttttctcttcacatactttgatgttggtgttcagtattaatcttctttggtaagtggatgcaacggcgatatctgatggtgatcttcagaagatcaattttcatgggtctacctaccaagtggtcagtggtgtggtgtactgaatatctgaatgcatttccagttcaaagtacttctcatttccagtactgaatatctgaatatctttgtcatttccactacctttgcttgatgactagatgacccatcaaccatgtcaactcttgcttctgctacttgcatatacttccatttgagcattcatcagttcctacagacatctggatgaacctacctaatacctgcaattatgtctgggaacctcttcttcttgttcatgaaaaaactaaacacggtcatgaacattaacgttcagcatttcagccatgttgctgcactgtattttcttcagaagcaaccctatgcaaacaaaaaagggaagacatatttcagatctttgtctgcgataagaaaaaggagagaactgtacatgcatgtcccatcgccatcctgatcctgatcacaacgtacaccgtgttgtttaaagcgtctaaagattcctccaagtacactaaatcaagtaacctttgtttttacagcaacaaacacacacaactcttcactcttcagctcttctcaaaccgtcggcagccacatagaaacaattaagcaaacctttcatgacaataatgagctttgtcactttgagctgtttcttcggcttagctcagttgcatagtcgcgctactgtttgtgcaacgccccattagctgacacgcgtggtcgctgtcactaagctctcgcagcacttgttgattgcaacgcccatgatctgattggaggccacatctcggctgttcttggatgttgtaatcatctttcttgtcgaagcaggtttggttctggttttggttttggttttgggtttggtttggtttggttttggtttggagatgaacacgtcgtgtttggagaccgtgatgggaatcgggcggtggctgccccatgattgctggttgttgggtttgggagtttgcagcatatttcgctgtccgaagagaggatcacatcaaacgccaagatgccggaatagggcgcccgtccgtaactttgtcaaccgacagagatcattagtgccactcggttgttagttgttacagcaccctgctactaaccctgaacctttgcccctccttttttttcagtcttcttatctcctcgttctgaattcatgtcaaaaacagataaaagaagagtgattcatcacagccgttaatacttaataggtatatatactcctactagaatttgcgttcgacgtactgtctggaatgcaaggattggtcgtcaaaaactgcaacccggaaacgtcgtaccggtgcagatttgaggttgtggagacggaacagtggaggtttagtggtacaccgatcagtggcagtagtaattgaggttttgcacggtgtttggtgcaccgcctttgttggatcaggtcgtattttttggtgttatcgcccggaggcggcagcgggaggagcacggcatgcaacgcacggagctactaccgctcgcgaccgagcggggcatggcatcgctgttgctgtcgctgaacaccacgtcgcgatcacatctcctccctccgttgctcgtcccgaggggcggatctaacatgaagacgaaaaggctcaaaccctcattaccgcggaattatgaaaacagactctcctttaaaattctttttgccaaactaaaaggggttaaagttctactatttctttctgtatgcgtcagtgctcaccatcactttcgcgtcggcgtcaaggtgttacagcttgggtgaaatgcccgacacaacacaaccaacaaccacttcatgatccttcactatatagcgtctctgttattagctggatctgaaaaaatgctgaacttttttcggtttcgataacttttatttttaagaactagggctgggaagcaggtttcgataacttttgtcatattatatcattcttgttatgaaatgagggtttttattaggtgcgtttagttagtagcagccacatttttatcacggttgattcggacatcattcaccttttgagcttgtttagttccaaattttgattcggacatcattcaccttttgagcttgtttagttccaaatttttttttcaaacttttaactttttcatcacatcaaaactttactatacacataaattttcaacttttccatcacatcgttttaatttcaatcaaattttcaattttggcgtgaactaagggtgtgtttagttggggaaaatgaaattttttgtgtcacatcggacgtttgaccggatgtcggaaggggttttcagacacgaatgaaaaaactaatttcagaactcgcctgaaaaccgcgagactaatcttttgagactaattaagccgtcattagcacatgtgggttactgtagcacttatggctaatcacggactaattaggcttaaaagattcgtctcgcgatttcccccataactatgcaattagtttttctttttatctatatttaatgcttcatgcatgtgtctaaagatttgatgtgatgtttttgggaaaaaaatttggggaactaaacgggccctaaacacacccttcggctgtgtttagttcctgaaaaaagttagaagtttgaaaaaagttgaaagtttatatgtgtagaaaagttttagatgtgatgtaatgtgatgaaaagttggaagttgggggtagttagggtgaattaaacacggtctttgtagacttgtttgactgtacctctgtggctaaactttgaaatgatctgcagagttgtaccgatacggatatagtactagttttttttttcctactaaatataggcctgattctactccatatccaaatgccatagagtagcagtttagcacgttgtgccgcgtgggttccatttcgctatgctccatatatccataatatggttgtgtttggatccaaacttcagttcttttctatcacattaatctgttatacacacaactttgcagtcacatcatatccaatttcaaccaaaatttaaactttacgctgaactaaacgcagcctatatccacagaggcattctctccctcacggttaaacatgaactccaccgggtaaattcacctttgcttgagatttgacaggtcaaagtgcacgtttcagaaccgannnnnnnnnnnnnnnnnnnnnnnnnnnnnnnnnnnnnnn

SEQ ID NO: 7911 - DNA, 144 bp, Oryza sativa
  unsure (1)..(144): unsure at all n locations
annnnnnnnnnnnnnnnnnnnnnnnnnnnnnnnnnnnnnnnnnnnnnnnnnnnnnnnnaacctctctccgagcgttagcggtgacgatgggtaagtcaaacccacgccgtcgagctcgtactccatcgcccccttcacgccaaa

SEQ ID NO: 7912 - DNA, 713 bp, Oryza sativa
  unsure (1)..(713): unsure at all n locations
nnnnnnnnnnnnnnnnnnnnnnnnnnnnnnnnnnnnnnctcactgttatctgtatgtaagggagggaagagttagtcctagtatttaattttgctgtctgtcgtgctgtgaaaaaagatgtttgcaagtagcttaagctgtagcaacaatttgtctgaacttattatcaccttttattcacaactagaaagtaaattgctgctcctatcgtttgtgttcatctctgttctcttgatgcatgtcttgcgctgtttcatccagtcgtgccacccgcgtagcacggtgtcacaatgcagctcgacctttacatatccactttgctagattcaattgctatttgagcctttgccttaaaattgctggggggagattttacgcgcatgggttatggtttctctatgctgcagtacatgttgacatactgccgtgccatgccagcgaaacaacggagcatcagccgcttttgcagcgtgccgtttcatcgccggccaaagcaggaaactctgacaaagctatcactaccatatgtaccttcacgtactactccttgtcacttaggtttgctgcgtgctagctgccgcccttcaattcttgcacagctttcggcagcaaaggataaggccgtggcctgcgtagtacgttcgtaccacgtatgtatcgccggaaatatgtacatcggcgaacaaaaggagaggcgatcgctagcaagcatg

SEQ ID NO: 7913 - DNA, 676 bp, Oryza sativa
gcctgggacctcgagtcagtccaaaaaaaattcttcacatgagtttcctgatcaaaatcccagtagtggataaagtttggcttcttgcgctgcatcgcctcaataaacttcttcagtgcaataaggtcatcatccccaaaccgctgcacaaaactgtcgcttctactaaacctgaacccaccaacagaggctccaccaccaacactccgtttgggccgagttgggaacttcctggtctcagcaatctcgctcagcgatttctccaccctatcatccatctcatcaaaaatcttggccttcttcttagctgagtcaggcatttccctgtaagccttcaagaacctcaccatgtcaggtgtacacggatggttatgctccaactcaacgaactccaccttccacttatcatccgcccgcctgtcacggatgatcaacattcgctttgattcttgttttctaacccgcaccgagacaagccctttttctcctgggcgttggccgcacccttgctgctgcggagtgggtagcgggcgcctgaaccatcaaacgggctggcgtcagcccgggccttgccaccatgagtgcaggtaaaggtagagcggtagcggagcccctcgtagttgtggcaggtccggcgcaccgcgtggaagcctgtgcggtaggcgtaggtcttgta

SEQ ID NO: 7914 - DNA, 1709 bp, Oryza sativa
gctgttgactttgatcggtgaatcgggtgacggctgctgctgctcttcagctttgttgttgactttgatctcaagtagccgctcaacgggctgtcggcagatcgggcaccgggtcgtctggtacctcaggaccttggcacactcgctgcacatacactgtaccagagtatacaaatgtcagggtttactggagatgctaaaaatgcatggaaatggctgacagtcagcaaaacagcaccgatttgtttgaaatagttttcagaatacgaaatgtgaaccaggtaagccataagcataaaaagtatggttttagaaacagaataactttgtagctttatttaacttgatcatggacccctaatgctgcacatgaactagtcaatacacaaatcggatacttaccatatgcctacatgggagaacggtagtatcccttggctccgagaggcaaataacacattctttcccaggatcattggcatcagcatcgccttccaccgagtttcctattccatatatttcctgcaactcatacctagttccattgacccaaaggatctggctagcaactcgaacttgataatcaccgctttctttcttttcaaacagagcctgtgtgatctgtgagtttggagttttcatcttttgatcttctccttccaacttttgatcaacaggcatggttgtttcagctttaactgcaagtggatatacatccatgtccccctgcttcaataactcggaatcctcaaacacggagaagttgattccagtgccagaaggctgtctgaacttctgaccaagaccctctttgaagcttacagtaacaggcttaatcaggtcttctttcaccgccgttagattgcagttgagctcttcttttgcaaagaagtaaacagtcatgctgtccaaagaagtagaacaacaagaattgtttaaacactttgtttgttcgtattaaaaataaagatttactttgtttgtagtaagatattcacaatgcttgacacatacaacatgaatagtaatgatgacacaagccataagagcaggtacaatagcatactattagccagctataaacatattttaatgagataaaagatgagagagaagagcaacgggctacagatctgtagccagctgcagcacggactccaagacgtaatgtgtgtatgacaggtgggaccatatattaatagtatattaagtaactattgtatgaattggctattagattggctatagatgaagtggagctagtagtaggctatactattaaacttgctctaattaacaataacacggctttagtacaaaacagtaggaattctctataaaaatatcagtaccacattccgaggaaggatgagccaaattgtgatgcttctcggagtgcgtctgagactgtaacaaaggtaagtccttgtgaccattttaaaattacaactaaataattttgcaagcttgaccaatagattccatcttggtgcagccccctattgaatccattgactgctgctgctgctgcggcagcgtcagctgctgctgccgggactattcaaggaaatgctgttccaccggcaataactgcactggtttgaccatattcacaatccctttcttatggatcttctctttctatcaaaaaaacttctatagtgacccaactaactggtacattcttggaaaaattctaccaaatgggg

SEQ ID NO: 7915 - DNA, 1840 bp, Oryza sativa
aagcaggcctgccaaagttggacaaacatacttatcaaagcctcaaaggtcgttcaaagtgtgggctcaaaccacacacactaacttaatttgccgtaatcaacgtcttgtgataacatatagacttctaacctaaaattgtaagagttgtaaagatggtgatgaaatagtcaacaaggttaaatgaagagtgattataaactaaaatatagacttccaagaacaacatgttgatataaggtataaaataaactatcgatcgtacagtaacaaatattatacgaattaacactagagatcaagtatattgtagtgaagtatataactgatgcgaacaatatggtaataggaatagcaataaaaaaaatggttcaaatgggtgttgtggatgcgccacattaatgagggactttccaatcaatcaagttactaaggcaatgatgtggccacgaaggagaagaatgaggtttggacaatagagaaaatatatatctatcacctacaatgtacaaagagcctctagtaaagcccttgcaattttcatgaacattgtactttcatcaggtccagtgttcactgttctgcctccggacaggcagctgtttaggttaaaccactaccaaggggagaccattggaattcatcaagaaggttctcaatgaaccattggctcattgcagtgtcatcagtcatagttaatttgcaaagggcccaagaacaatgagtacacaagaacaaaacaatagctggctttcaactaaatttggcaaccaataaattaaagctactaaagaagcataaattgcaaggagccaaggatgacagaaaggtagcaactagcaaggatactgcaaaagactatcgaaatacaaggtcaaaccaggtcctattagtagcttcaatgttcacaaaacaaattagcttgtaggaggagtgcctctacattccttttctttatattcttctactatatacaatctagagaggaaattatcagctgataaacaaacataaatcaaagatcattgaaatgaaaattgccacttaaagcacacgaaggcgtcagtcacaagatgccaattccatattagcatcaaacttcagtgaatcaagccactcgatacaaaccaaaccaattctcagtgaaatcttaagtatgcaactaaacagcaaaattctttcggcacataaatgaaatatagcacataagtttgattgtacaaaagaacaaaagattcaccttccagcaagggtggcgtcaaaggtgaaggcgacgaggaagcggcccgggcactcctcatcaggctcaatccgaagagtctccttcttgaggttgacgtcgttgcggattgtgatagctttctggtgctcgacgtacggcgtcggcatggccggctgcaatccgcaggggtgcggccgcccagagaccccaggccaccccgggtagtgttgcgggtgcgccgacggcgggaactcccctccggcgggcacccccgcgccgccgcccctgtggtggtggtcgtacggcgccgggaggggcacctgcagggacggcggcggcgggtagtagttcccgtactgagggtagtaccgcggcaggttggggttggtgtactgcggcggagggtacggcgtggcggcggcgaacacgtagtggctcggggacgactccggcggcggaggcgggggaggcgaggacggctggtggtggtggccgtggacctgatggtggccgtggccctgggcggcggagcctcgtcggcggtgaccaggggaaccccctccgccgttgctaccggcgttgcccatctcccttccgcggggcagagatcaacacgga

SEQ ID NO: 7916 - DNA, 2010 bp, Oryza sativa
gagaatcacaaaccaagagtgataatgatctacaacaccgcaacagagctcgatcccctccctcacgaatcgaatatggttgaggagacccacaagctcaaatgattcgatcggcgaaggataggagacacaaggggggaggcgataaggggatgcttgcacacaaattctctgctttttttttggggggggctggatttttggggctataatggaagggtgcgcgtaaagcaccactactgtcctgtgctttttcggggggttaagcgttggcgctcgcaaatacccatatttatcaccaggtcctcatgttcttggtttttgccgcatgtgattctcgtttttttttatgcttgcgaaacaggaggtgaaaaatctttgaatagaaaggagtatatgcggtcgttgatccatggcgttctatcctggaatcgcccactgtctatttttaacgaggttggagaaccacgttggttagcctacccatgattttgcggctagtaaagcgtgcacttgttttttttaatctccaaaaatgttgtatcgatgcatgcttttcaacttcatatttgcatatttcactccgaaaaacattgtgagacggacacaaaggtttcgaatatgtgatgagttccatcaaacgctcatatgcaaattgactatactggtaagatggctttatctttatagatcttcagtgatatgtagggcctattcattttgatgacattttcaaccttatcaaattttgataaagttgccaagtggctacatttagtttgctgccaaattttggtaactatataaaaaatcctcccaaaattttggcaagttaccaaaattttgacaactatgccaaaatttgttaaggttttttttggcatcaaagtgaacaggcccgtaattgtcttatggtttcttcactatctacctgtgatattttttttcttccttatgttctcattttgtcccttcaatttaatgtttttatttagtagccatgattgctggaaataactcatgggatctattgtttgcactcgtaaataaactagaagttactcctactcctcagcctagatccttgaacaatatacggtaatgtgacatataagtaacatattatagaattgcctgtgttttgaaacttgtagtttcaaagaggcgaatgaaaaattatgcgattgtgatgttttattgtacacacttaggtcgatagacaaatggcctagtgtctattgtttgtgatgattgtcgcttgttttggctttaactctaccatattgatttctatataattttcttaccaaccgacgattggtgtattgaaatagttaggtttaaaatacaaaataaaacaatacaggagctgaagaaaggtgaaatgcatcctgtaaaaaatatatttttactaaaagatggtaagtttgtctcttcattttatgcacaatatctttggcactaccaagaacactggaaagtggaaactactagcactacgaagtttagaacactctgatcaagctccaaaatgcacatctaaaatgaccatatggttccatcagcctgcactgatcccttttgtaggtattgctatttgctaaccctgaaacctggaggggctatttgctaactggccacgttttcattttttttttcttcctttctcagctttttggaaaaagaggggttttgtagtgggaagtggttcgagaggagctcaaccagaggcgtccttattcagcttttgcctagtggaattcagattaagaattaagccaattcaccatctttggtctggaggactagaacaaagcacagacacaagtgcacaaattgcagtagaggtgccaataattggacggaatcgaggacactgttgccatactgcataggtctgcgaggtgatggatgggatgggagatttaacctgaaactgtggatgctcaaatttatgcacctttgatgtggcaggaagcaggatcaacaattttgtggatgtactatggg

SEQ ID NO: 7917 - DNA, 2727 bp, Oryza sativa
acaccctctatagctggctggctggctcggtcatcatccaaaatcgatttatggctctacttgactagataaacactatcctgattcccgagtctttgacgagcaatggctttacaacgagtccctagatcttgaagcgatcaatcaggacagaacccgaagaaatagctgagctaattcatgcagcatctttgataaagtttgagctccacttgatacgctcgcggttttagttcgcccgatcttttgttgagttgataataactaaaatttagaagaaatgttcaatcatacaagacgctgctatgttacgccttagtgattgatacatctctctgtgggttgttcatcttgtcggtgcaatatcaacattttttttgcaagtataaatcgaagaaacaagtacggacaaaataaaagcaatatgaattaaagctcacgataaggtggagttccgaagacgagtaaggctatgttcggaaccatgggttcccaacaagcacagtgtgcacgaaaaacagagcagtccattagcgcgtgattaattaagtaggagtattaggtattttttttcaaaaatggatcaatatgatttttaaagcaactttcctatagaattttttttttgcaaaaaacgcaccatttagcagtttgaaaagcgtgcacatggaaaatgaggcggaggagctaggaaccagcagttctgaagacaacctaattaggcggtctagccgacacgtgtaaatacaagggctaaactttaatctaaacaaaacctgaaaaactctgaaggggtacctatttattaatggaggtgggaggataaccaaggggtcactagggtcgtgctccactagattgggacgcaccccacatgagctcaacttgggtcgaggtctgaaacgaagttacaagcccgaaggtcattataggtgacgcaacacattgtttcttgaattgtggccgactgagatggagtttggagatgagcctggatctgttggaagagaacttccatagctttccatcaagtactcatggatataaaacggaggtcgtgcacatctggcatccgtttcaagtcaacgctgctgcaaatggccgaacttgtctccagaacttgtgcgacttgtctcctgattgagctataatgtaagtaatggttgtatcaatagcagctacggccacatcacatctctccgtctcctatattgtctctggaaaaaggatcagatgcagccgtttttcggagcatgaggacgattggatatataaactgtggttttctcaagctacaacactaaccgatctctgggagtagtataatttaataaaaatctcttaggctaacatggcctaattctctctgaagccatggatatttttattaatgccttctgccttttatttagaaaaccttccaatgcttttatgccttaaaagaggttgttatctttaccaagtaacttgatcatataaataaaaagttcaaatcttgggacataccgcaataaaagaaacagtgatgtcatctaccggacccatcgttttgcttattcgcggcatatttacaaacaaaaagtaatttgtgaataaaacttttatatacttgttttagcgatctaaaagtaaaaaccgaaaaataaactttgatgagaaaacctcaaaataagctccaaattaaaaattaaaaatttaaattttggctgataagtataagtataaataaaaatatgagtccaaataagttttcaaggaggggggattcttttgcgctgtactgtaaaatggtaccgtgttcgagctgtaatctttcgtttgagtgttttgagatagtgatactcaagatcatacttacatatgattagtacgagtgctgtggttatctcatctattaagcttcaaaataaccaaatttcaacctcaccaattgttcgtaagtgtcatggagcatttatcttttaataaagttgctccatatattttctcatattcacacttcgagtagtgctaatcctaagtaagggtgtgagatatatatgcttgtacgcgtttgtaccagcgctaaacaccaaccctacctcactgttactgttaaacccaatatgttcatccagtatgttatatggccattgtgaacttaagtgacaaaacacatctattatatttgcatggattatgtaagagaaaatacatctactatattttgtatgagttatggaagagaatatttattttgtatgagttatgtaaaaaagataagggtactaaatatagtaatacccgagattttaaatgttcccgcctttttatgcacttacatgcacgtgggttttacgaataaaatacaccactgcataccataatatccaaattttaggccttattttgaatgcaagcaactttccctatttccataaaaattggacatgttattacgaaatcattatgtttttaattaaagccatgtgcacgaacaataagtaaaaaaactgtatcaaaaacaccaagagttgcttgaaaagataactacattaacccctatacaaatatgaaaaattcatattctttttcttcaacaaatacctagaaaatcaagacacatttaataccctcaaaaatactaaagatgtcaacctgatcctaagagactaaaattcttggtaatttcttgcaaaatcaataactcacaaaaaatatacgttttcgatcatattctaaaaaaaa

SEQ ID NO: 7918 - DNA, 1348 bp, Oryza sativa
  unsure (1)..(1348): unsure at all n locations
nnnnnnnnnnnnnnnnnnnnnnnnnnnnnnnnnnnnnnnactcagccccgaagaaggccaagatttctgatgagatggatgatagggtggagaaatcgctgagcgagattgctgagaccaggaagttcccaactcggcccaagcggagtgttggtggtggagcctctgttggtgggttcaggtttagtagaagcgacagttttgtgcagcggtttggggatgatgaccttattgcactgaagaagtttattgaggcgatgcagcgcaagaagccaaactttatccactactgggatcttgatcaggaaactcatgtgaagaattttttctggactgactcgaggtcccaggcacaataccgttattttggtgacgtcattacacttgacgtgatgtatttacagcattcgcgtgctagccttccattggccacaatccttggggtgaacaaccatggtcaccttgttctgcttggttgtggtctgctttgcagtgacaagaaggaaaactatgtttggctgttgaagaggtggttgggctgtatgaatggcaagccaccagaggcgatcacaaccacctattcagatgccgttgcagaagctgtggctgaggtgttgccaaatgcgaggcaccgtttctgtttttggcatatcttgaaaaaactccaagagaatgtcggacgcacaaatgagaaagaggcaatttccttgagattcaaggaggttgtttatgacacagtcacacttacagactttgagagagagtgggggcccatggttgagcagtacaagctcaaagacaatgactggttctctgctttgtacagctgccggaaacaatgggcacctggttatgtcaaccattcattttgggctggcacttctgctattaggaaggtcgagaaaccagatccatactttgatggcgtggtgacaactaaaactaccctaccagttttccttgagcaatacgagactactctgagagggaagctggaaagggaggcatatgatgatttgcgctcctattactctaggctcacttcgctgtcgggattaccctttgaggaacaactcatggagctctacacagtacctatgttccaagcattccaagacgagatcaaacaattaatacacgtgatttgtaaagaggtagacaggagtggaaattcaattacctacatggctagtgagttgatacagggaaagaaggtcaactatacagttgtctacaacagtgctgacaaggatgtctggtgcatttgtcgctcctttccgtcacgaggcatcctnnnnnnnnnnnnnnnnnnnnnnnnnnnnnnnnnnnnnnnnnnnnnnnnnnnnnn

SEQ ID NO: 7919 - DNA, 11037 bp, Oryza sativa
  unsure (1)..(11037): unsure at all n locations
nnnnnnnnnnnnnnnnnnnnnnnnnnnnnnnnnnnnnnttgacagttatgaaggaagcgaaggacaaactagttaggcctgaccatattcatcaagctgatcagcgggttgatgtaaatatgtcagtgactggccaagtgtccgcagatagaggagtagatgtgaacatttcatcaaatagcacatccctgattcagggagacagaagggttgatacaaatgtgacctcaaacaccacagccatggttcatggtcatggggattccatgacatcaaacaccacagctatgattcgtggggatagaagagttgagatgaagatcccaacgccccaccttattcatggagacggaagaattgacatgaacatggcatcccctctcttgatgcagagggacagaagagttgacatgaacatggcctccccacacatgatacagggggacagaagagttgatatgaacttggcatcaccacactttatacaaagcgacagaagggttgatatgaacctggcatcttcgcatctgatacaaggggacagaagagttgatatgaatatgacatcccctcacttgatacaaggtgacaccagagtggatatgaatatggtatctactgctcagaatggaatgcactcttttgatttggtgaatgtgaacctagaaagtggtcctttgccaatggctgcaactgatttcatgcaaatgcatcagcacccacccgtttaccatccaaaacaactcctcaatatgagagatcaggtgatggacacaaataagaggcccaatatggaaacaaacacatactttatgggaggtggaatgcatgtgggatagtttcttgtctagagacccactatgtaatcttttctgtttggaaaggagatgcctttccttattttatattgatatgtatgttcctacagcaggcagcaactaatcaattaggttgtagtaattgcagattaatcttgcagtgctggtagctttgttgttgtatccttctctgttcggcagctgtagcaattacttgctattgtcttgtacataagatagtagaatgcaacaaccttttcttgtcacccggtacatcaaaagtgtgatatctctagcttcacaggttagctgatgcatgttcatgagtgttgactgatgtttggtttacacctgtcgtacatctttgtgtcttgtcatatggtttagatgcactagtactttagtgtgaagggcgctttttttagcggctcacttattggtaggtcaaatgccgtttcatgtttaaaactcattttgatgatgacgcaacttggtcatatgtgtttgcaaggtagaagtatattataagttagcagaggcaccttgcttttgttcggtcaacaaagggtattggttgtaggactcctagctgatgctaaagggaacaagttaatttattgtttatagacaatgttagatgtatcttttttgtagatatatgcttcacatcctcacctttcagtgaacacaggtcttgttattgcttgtgcagttgtgctggctgctagcttcctattttacacatgcctaaaagctaacattgcagatcaatggtcattgaacactaacgttatccttggcttctccgtagctactattattagcaacttctgtgtccaaaccaaccagttcttagaacattgcaatctggaaagtgatgaaagatggatcattctggtcctgcagggaaccaaagaaagtcacctttacaggctgaagcaagtgtttcacaataaacaataatgctgcaaacatcacggggtacgaaagttttcgactttcagcaaagtgcattcttcagctgttcacacaaggggtcaaggggtatatctattcaatgagtaaaaacttttgcattttgttatttatgcagcaacagaacagcaatcttatggacttccttaaggtggcgctgcgtgcaagatacctctgttcagacttcaagagtttcagatgcttttcttcacacaagtgcatcagagtttcaggtgcatttctagatagcaaacttacaattcaacagatgaaggtgtgctttatatttgattgaaatacaaagtatatctcaaaagaattacaaaagattcattgccttgtacaattgtagagattcaccatgttaacaagtacaactcaatctaaacgtacgatctaacagcttgcaaggctccaaagcaatttggtattatttattccttttccacctgcatttgggaacatttattccttgttggttgttgcctgctttctacacagaaggttttcttgcttcaccccctcaaactacttttgtttcctactaacgagcactatcaaacctgtcaggagcatgcagcttccaccactagactttttgtgaccccactgcatggatctccaaagttattcgatgacactggaacactgcaattggtcattccaacacaggcctgcagagttcaacgagtaagaaaaacaccactggcattgaagcatgacaagtatggaagaggataagctcagattacctcttgaacaactgcaagagcctgagagctgctgcattcaccatggttgtagttcccacaggtgccactcggtgtcccaaagcttgcaaacttgatgttgctgatgacctgaccttctctagggcactccaggcgaagtgctggtccctgcgtctgagacgtctgttggggagagatccagctatcgatttgggctggatgcatctctgaaacatgtgcacatatactacttgtctgccttgttgtgaaggatatcatgcttggatcaccaccaaactgctcaaagaggactagatcattgctaccaggttggagaaatgacctgggcacgtggtacctgtttaacaaggtaaggcattcaatcagtcagcataatggatttcatggtgaccatagatacaattttgagagtgtgccttcatattttgtagtatattaaatacatcaatgcttagtaagtgctgaaatataagtgaattttcatgcacagctaaatgatattatcactaaaaagttttcatattggaacatgagaataaattggagctggctctgcattaggaaacagattgtagatatgaaaaaaaactgaagatcatattctcgtgccactgagctttagcagaactcttacagagtttgtgatggctgcccacatttctttaggcacttgttcgaactataagctcctctgtagttgcatgagtttacacagccactttgtggagccaaatttgttggccagtagcgaccaatgctctggccattcacccatgcctcccctttccccattcctgtgaagtctatggcaacagggtcatcacctgcaggagccgtaaacttggtctgcaattggagcatttcatttagcaactttgcacattatcccaaggtaataattgaacaaaaaggattgatcaaacaatggagtgtatagatatagcttattgagcccaaagccattttacatgtacacaaacgtcaaacacagcttaattactgggtcagaggatcatactgaccttgtaccatatcaatggttggttggtcgggtatgcgttgtctgaaacccattctggtgaggcttctgaaggattatacagatgcaagtcttctcctctgagtccaatctgaagcggtgaaaattatgatgagggaaaacaaaccatgttatgtttacggttgacctactgtaccgaaggcattctcaaaacagcattagccaatagtttccttacaaaaaaaatctgaaacagtatatgaatagatagtagaatacctggtatgtccaatctgtagaagatagattaagggcaccatttggtccactcaactttactggaccagtgactccagcgccaaccaggtcaaagaatgcaccataattctgatgttacagaatacatagttgtttattaaatagaaagaagtaaaataggatattagttttggtgcatctcttctagagtaagtgaagaataaattaccgatagcccaactgttgtgctcagaagatctattttgttcttcccaggtacaagtgtaactggtgtctgcaatgagatgagcgagctgctagcactgcccttagcacttcctggcatgtgtcaacaattacatttcagcacacaaatactacttgtgcgtgtaagaccaatgttcataattaacatcacaattcgaatgtcatttgaaaggtctttgcattgtgacctcaagctttacctgctagtttgccattgatgtagatctgaagaacatgtccaagtgagttgacaagcagattggactggctgccgtttagatatggttcatcacctttgacaacgatgctgcagaaagcacgattaattgaaactggtgagtaaccttgtgactgccagttttcttatatatatatataggagtatatggacaattacacctgaggcgtgtgagtgcgaaccctgtaccttgttgagtaccacaggaaatcactggcatcggctgtggtgtttatctgctccatcagtccaggtttcgtcaaggcgttctcctttgtaataccaacaggctctatggcataactccagccagctgtagcaagttccggtgtgattaatgaatcatcagtatcttggatacttgatcccaggcttctcatttctgaagttgttacctgagaattgatctgcaagggggcaaccacatccacatgcatcagaatcagttctcaccaatgttctttctcaaatgcagatcattgtctagcaaagtgagggcaaggaatgcacatacctgggctgtgttcaataccacatttttgcagtcaggaaggatgcttacagaccaggcagggagcttatacgtgtttccgttgaatttgacagttttatcagactgagcatccacgttggcaaggaatgctgcgcatattgaattgtcagcagtctgatatacggttgcctgaagccagaagagtacaaacacccatcatcatgtgtaccggaacagatcatcaaggtaaacaaatattttatctctgaacaagattagctatacatctctagctgctccagcaattttgattgactcatctttctttttcgttaattaatacacgggttagtcacttttcgaaagagaggatcacatacctcagtattttgacccaaagaactatatgatggctcagctgctatgagtgctggttcgcacagctttattgccttgtgcacatcccttaagtggccccactttggctgcctgaccatccctgaaccacaatattgcaaaagatagtgattcggttagtgagatgtgtggttgtaccggtacacccccaacacataggggagccgtttgggctcaatttttttggttcatatctttcttataaaagacacacggttcctcatggatattcatgttctttttttaactgtgactagtcaatactagtattcccagacggcaaacatacttcaatttaacatagctgccattgacaggcatacatgtggcagtaaataagtacagctagctgctgacagtacactcaccatactcatcaataggagcatcgtagtcgtagctcgtggcgatgaatggccctcccgtgcttcgtccgaagttggtccccccgtggtactgcaagccaacaaaaaaccagtgttagaatcgcagagcgcctctgtttacccaagcgaattggcaaaacggcggtaaaaaaggaaaacaaaaaagaaaacgtctcgtcttcgcgcgcgagctgcttaccatgtaatagttctggaacgtgccgccgcgctggtagaatcgcgcgacggcgaaggcgaggtcctcggccggccggtacggcacggcgccgccgaaggagaggaaccacccgctccagttctccgtccacatcttgggcttgctcttggagttcggcgtgaactggtcgcagtagaacccgttgcacgtgttgatctgcatgcgcaagcacggagaaacggtgccacgtcacttcagtgtcgccgtgtcggtggttcgttcacggcaccggtgatcgatggcgattggcgaagcagggggaagaaagacttacgagggggtcgggggcgtcggactgctggcacatgacccacggcacgccggtgtcgagggagacggccatcccggcggcccaccgcatgtaggccttcccggcggcgccgtacgccgagtcgatgttgccgtactcgttctcgatctgcgacaggatgatcggcccgccctgcgacgcgtacagccccgcgcccttcatcgtgtccaccaccttctccgtgaaccgctgcatctccgccttgaacgcctcgttgtccgtccggaacttgatccccggcacgaagtgcagccataccggaaaccctctgcagtaatacttgcgtttcttaccaatctatcgatcaattcgcccagcgatagccagtgcgagagcatgagagagatgtgaatgcgaacccgtagttccactcggcgcagacgtacggcccgatcctgaggtgcacgtagaggccggcgtcggcgacggccttcacgaacctgacgaggtccttcctgccctcgaagtcgtactgttctttttttttcgttgcaaattcatttgagtcagtcagttagttgatcgttaaacgtccgtgtagcagaagcggagtagtgtgataatgccgctttagaatttccagataatgatattactaatactagtagcagtagcagttcacggggagaaaatggggagaaaattgtaatattgggattgcaaacatagaggcttcgctgttttgacactctgagtgaatgacaaatgggtccatctgtatctataaaatgtggatccaatgtcattatagtaaaggttaatgtttacaccgttgtaattgtaaatcaccagttcacgggaggcagaaagcctagaagtgagtgagagaataaagcatagggtgcagaggaagcaaacaccgccctttgacacatgacggccaggagggagaggagatgatgacggaaaaaaaaaggagagaaaagatatacacaggtcattaatttgataatttcattgtggtacactattaatggagaatactactactactagtagtggtactaagtagcagttgagagaggagtacgtgcctgtccccggacggcctcgtgaatgtcccagaagacgtacgtctcgatgacgtccaggccgccgtccttggacttctggatcagccccggccacatctgcaaccggcgaccgccaccgccgccgccgccatggcaacataatgtcagcttttgtaactagcaatctgtctgctcatcaagaacagaggaggccgaacgagcggtgcatggggcaaaagagagaaaggcaagagacggcgacgtacgtcgggggtgctccgcgggtagtggatggacccggagacgagcacgcgtcgcacgccgtcgatgaccaccgcgcggtggtcgtacgtcacgttcgccgcccgcgacgcgccgacgaggaggcttaccaccaccaccacggggaggagcagcagccgcagcagcacacccaccgtggctgccgccattactgccgccgccgccccgttcggtgtcgttctattatcaccggcgctagtgcggacgatgacgaggagcagcaggaggaaggaagaacagagttgctcggtgggagaggcaaaagaaaagaagaagaagaagaagaagaagaagaagaagaagaagaggagttgctggttggagtggcgcggcgggacggaaataaatggcacgcactcagcggcagcgacgaggctcgctagcggagcagcgggagcgaaagcggctgtgtctctttcccgcggatgcgggtggtggtgcatctgctgtgctgtgctgcctccctccgcggctaataaaaaagcgctgatcgttcgcccgcgcggcgagcgatggggtgggtgggtgtggagttgagttcgcggctgcttgcaagcaacggcaaaagccccggcgccgtgcgtctagcggtaggatcgaattgatggatggatcgagcaaaacataattactgctcggcttggctagttaatggaggcgtactacgtgatggttcggtggcgcacacggcgtgggtggggggggggggggggtgagcaaacgccacggccacgccatgccgcatctgatctctctcccgtccacccttttgcttccgctgctgcatgtgcccttggcattggccgcacgggctcacagctaggacggaccagtaaacaaaaggtgccggtgtgaccgaccgacagacacggcatggcaggggtcgtgcccgacccgacccgccgttcattgccgctcgatttctttatcagtgatgctagtactactagcactgcgtctgctcgggccaagagctaagcggcccttgtcgcttccggtctcgctcgcctatagtacctccgtcccaaaataagtgcagctgtggatatctgtgttcaatgtttgaccgtccgtcttatttgaaaattttatgaaaaaaataaaaatatttagtcacacataaagtactattcatattttatcatctaatagcaatagaaatgctaatcataagaaaatttcaaataagaagaacggtcaaacgttaaacgtgaatagtgtaaaactacacttattttagtacggagggaatagctacttcgaccgtgatggcgtatgatatgctgcactagcacacggttgccactaccaatctagcagtagatagtggtagtgtcatggactgtactccctccatcctataaaaaagtaaaacctgagttttcgtttccaattttgactgtacgttttatatgaaatttttttataattcgtattttcattgttgttaattgataaaacatgattaatattttatgtgtgacttgtctttttaatttttttcataatttttttaaataagacggacggtcaaacgttggacacggaaaccaaggtttatctttttttttttgaacggagggagtacgtctgtactgctcgtcttctttttgtttgggggaggtttgaaaaaaacggtggcggtggtcagaccgtgaaaaaaaggctaagcatttctccctctttctttcatcctttggggcggtggaaaatgatggtgcgcggcgacgacaaaaatcgtgcgaaagcgggagagcgagttgtctctgcagtctgcactgacctgtggcgtcggttcatggggaggggaaaggggctcgggtcggactcgtccacaggggagcaagtgaaaggacatggaaaattgtatgcaaagctttactgctgatgcaagagagtgacttttatatattgtgtttgtttgccatttttcgtgttacaagcttacaaggcttgtactacgaaagcttacaagctttcgtgtttgccattttatcttatcaagattcaataaggtaggggtaacaaactaaacggcctccgtatccaaccaaaatttagcatggttaaatttgatatcaaaccaaactgctctacatatggaatttgtaccaaagcattacgctcaactctacaaaatctaccaaagatacacgcgccctttttgtttgaagaaaaagctaatagagctaaccaagtttttgtggcatgagaaccacgtgaggcaactgctacactcaagtacttggatttctaagaggtagatatttcttttttggctactgaagaaactgactgcataatctttctctggatgctcgaatataatgtagttcaatgtgaaatcgacatggcacacgccattgttaacctagttgggtgacccacctgattgcattcacagcatatttgcccgggctatgcaattagtactcttcacaagtcacaagcatatataaagacctatggtagtgcagaagcctattgtttggactgtcataagctgggatgtttggaacgctgtaaaattcccgtacgaagaacggttttctagtaaaaacttttgctgaagataagccaaattaactgaagataagcaagcagtcactagcttgatattgtagagtcaaacctcaccatttatcgatcagtggcgcgtctaattgccgtctatcacattgactagcgtctgaaattagaacacatagtaaccacaaaaccgagaatggcgatgccgaatcctgaacctaacccactacagaggctcctgaatcgaattgaacatctggttcttctccagagcaggtgctcggcttaggtgtggctcagctcaagtcaatcgtatttggtgctgatttgctacttacagtgggcaaaccacacatcttgcacgtcaatgtagaaggcgaccatttctcgattcacttttagtagtaacgaaattacctacgccaccttgacaatctttaaaccctttttttttgacacagatgtaccatagtgtcctgtcatctgttaacacaaggaaaatccagaagtgtcatccgaatgctgtgcaagaaaggaggcacatggattcaaaagaacaaatccatattttctgaaaattgttgactaccaaaaacaaaatcttgtgctgctccattcgccacctcaaccattccaatacataaaaaaccggataagaggggagcgaaaatgagaagtgaaacgggtgaagcagagcgtccagggcttcttcatcatcatcatcatcagagcgtccaggcctttaattgaactcgcagtcgggaggctgcaggtgcggcgtcactgttgccgcggttcgttgcggcatccttgtagcaggtactgactacactggaagtgagcataatgatgagttctatatggatgaggctggaaatgtgagaacaagaactaatcgttcaggcggtgtgcaggttttatcctagtcccctgttgttttacagttatattatttattgttttcgctacatctagctgcattctagattaaaaaaatactagtaaatagtataacaccgttgtcttagtatttataatgt

SEQ ID NO: 7920 - DNA, 2866 bp, Oryza sativa
  unsure (1)..(2866): unsure at all n locations
agatatatacttttcaaactataaaacggcgtggttcttaaaaaacaatttatataaaagtgcattaaaatattaaataaacctatttttcaaatttatattaattaaaaaaataattaatcacatgttaataactttttcgttttgcgtaccctaccttcgtcttcatcttcactatattctaagatgtttttttttaaatctatctggtatggggtttggggcgtacaaggtgagccaagtgatgccattgatgaggagagttttgcttggaagagtcagcaaagaactgggagagttcaccggcttgaagcctccattttctgcacggatgcgattgcagcgtagatgatgccgcggcaagcaaggagaaagatgagctcggcgagggggagagtgacacgctgacagggatactacggagcagataagatgcacggagcaccgctgccgtgcaacacggcagcgtcgtcgaagagcggcacggcacggcacgtctcaggatactactagtaataacttcgaggcagcgcgacaggagcagactacgtgaaacgatcgccagcgcagcttctggcacgagagagtttctcagcgagatcgacaaggacaatgatgaattaatcgatgaaatctaccgtacaacacaaggcaaaaaaatgggagaggcaggcagccaggcagggcctgatccaaggtgcactggcactaaaaatctgaaacatgttctggaaatggaatgccgaaaggcgaaagggccaaaggctattatcgctggatgtcgtaacattatcttgtcaagatccatctgataggagaatggtcatagcagcaaaggacggggccaaatcattgaacgcgacagctttgatgaccatgtaatgtagcagaagggatcagtacggtatctgaagccaaaagaaacggagagaaataaaggagaaaaaaggattagatctgacgtcctgcgttttgcacgttcacgtactagctccccttgcgcaattatgcaagttacctgcagttatggagtgcacacaaccgcgcttcagatgtacagctagtataataacatcaagcatcaccagagaatcaatcaacctgatacaggtgaacaataataatatcacgcggttgcaggataagatttgtgtaagatgctaatctgtcatcgacgaagtgatggagatttgagaggacaatggcggcaacccacctagcggcgagtcaacccagaacaaaggactaaaacagaaaggaaaaaggaaccaacaattttgctaatttcatggaaaataaattagccaatggtttaaaacaaggcagacgagagttgagagttgtccatactctttgtacttttctaattacataaagagttgttcatacaccctttttttttaagatagtgaatagaaatcccgtctctatatctatcaacggatagatatataaccaaatatgtatcacgtacttttgtgtccgttttaacacacgcttaaggttacacccaccaagatttaaacaccattaattacactgccacaccaaatatcctttccaatcctcttctcttcttttcttttggataccttagtttgaccataattagtgggtaggtgagaaaagttgctgataactgataagcgtagccactatgcattagctactctatcctctagggtgctctcaaaagatatgtgaaggtttgaggccatccttccgtgtcagttgacgccttgccaaatccaccacaaaaggctagtgcatcaacatcatcaccattcatcacatgaggacatactacacatgcaacaagcctgcccgacacaggaaccctttagattattagcaattgtgaagcaatgtggagatcggatcaagtgatttactaatctactagcaaggcccccccaccaacaggaatgtcactaacctatcaatgtgatgactgttcctctgaattcttcctgccaatgcattgctggcttttgggtcacggattcacagctctggagtctggagctgcaacagctgacgacgaaacgacaaagcaggcacaacaactcagagctgccaagatctgatcagagcaggcataacaacctaagatactccttcagttccggtcttgcaagctcaatcattactgttgagaagccgcactccaggaaaatgattgaaataaaatccaaaaagacgattactggattgaacttagtctcacattttaatccacataaatgttacttcctccgtttcatattataagattttctagcattgcccacattcatatatatgtaaatgaatctagacagcatttatatgaatgtgggtaatgctagaaagtcttataacatgaaacggaggtagtatctcatattatctatctcaaaaccaactgtatttaatacagcattgagaatatctagaggaggtatcaaactctctcaagggccagggcaaaaaaatgttctacacctcacactacaaccttatattaactattagcaacccagcaaaggactacatttccacttctgaaaaaaactctgaaaaaaggaagatgccgatggattgtacaagctattataagtgggaatcattttgattgttgaaagactagtggctaacaagaaaatgacaacatggagatttcctacttcaggaaggccgatgatacaaaaaggagtgcataagtaacacatgcagtgctcacttccaagtttcttggaccaggcagtataggcggaattacagaaaccatcaagaatgtggcaaggaaccaggaagcaaagaaggatnnnnnnnnnnnnnnnnnnnnnnnnnnnnnnnnnnnnnnnnnnnnnnnnnnnnnnnnnnn

SEQ ID NO: 7921 - DNA, 6633 bp, Oryza sativa
ccggtgcgataagtggcaggaggaagcgcagtgcagcggggttagcggtggcacgtttatgcaacatgttgtgatgtggagggggctgagagcaaaagtgttgcctacgtggcaatgccacgttggcggtcaaacgcagtcaaaggatgtttggaccggggtggtacattaaaccaaattcacggacctaaacatgcaattttcaagttcacggacctaaatgacaccaccacacaagtttagagaccggccatgtatttcactctattatttatttgataggttctcaaaacatttgatgagcacctggcactgaatagacagacactttgtattgtgaaggctgatgaatgagttcataactcgtggggtaaatcggatcatggatccaatgaaaaacaaaatttgaagaatattctggattaaggaaactggttgcattatcagttgacaatataaaatgatagtgatatattctattatatacatcaaatagtggaaacaggctcccaacattattttgataagaaagctggcctaattacagtagatatcataatatgacaagaatgatacattctattatgtatttcagaggcaaacccttttacttttaagtcctaaatatcaaaagctaccatagagtgcagaccggcagatattaaattgtcaagtgaaaaaagtagaaaatatttaggattcaaaaagcaatccaaaattgaatcccaagccaagtactacaatccagtccttgtattacgggcttgaagttctagaactgcccagtgcagcatgatctgcacaacataaaaaaagctcccagaatattttgaacgatgcagcacgaagtttacaacacgccaggtgtggaagacagagagaaataagatgtcctcgctttcatgaggtgagaacatgttcttgtgtgcattttacatatttgtcctcggaaactatgcagagttatgctttgagcagaggagtgatcatgtgctgtgtaaacactatagtgtatggaactaaccatagattactcggatataccattagctaaaggctaaaacacacaaaaaaactgcaaagaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatctcaaataaaacattagaggaacagattgtgagactaaatggcgtgattttgatataatgtccaatgctttggccatggtatagttaggtatttatacttttacaatttaatatcaagcatgccttacagcaaactacacaatttgttacagaggtataccaagtggttcctagtaaaccatactgctcgttactataattcaacatgacaaatttggttggtaaaagtacatatatgtacttactatgttacatttttttcttacatagccctaggaagttaaatacttacgagttgacgagtcagctgtgtcaccaaatgatgcagtagcaagcggtgtgattctggtgtttcgcggtgcataacagaaaggagtactatactttgtgtatctgcatgaaggatcgcaataagatttcccactgcataaactaaagaaatctttggcagagagttgatgaggccagaagaagcacaagatacaatacctatccacattgatgaaaagtttaacactttccttacgtcccctgctgaaggccaacgaagagacaagtcccaagggtgcactcgacgccctcgaagtaaccggacatcgagcagcccttgaaggattgattgctagactatgtgccaacatctcaaggaatagttgaacagcctaaattgaggcctttcccctcctaagcacaacaacagtaaattcatcaatcacctagaacaaatttagcaaaggaaaaccaatgccatgcacaaagatacacaaccgaacgctagcagattacccacacccattaattaaaaaaagtacaatcatcacaatatacaacttaggaacctggataagaaagcaattaattcagacaaggaggaacatatcgagcgattagcagccaaccgaccgtcaccctcagaaatcaaggggtgtgtagcctgaaaaattcacaccattcaccacacagtgccaccggaaccctacatgccattaccaaccctacaacccacggaccctgcacctgcatcagcatccatcccggcgtctaacctaacctgtcctaacctaaccatcggtgcaccggcgccgcaccggaatcgagcggggtcaagaaggcgaagacgaggagccttaccgtgggaggtgacccgcgcgtccggcggaccaagagcggcggcgctgggcggaggaggaggccgcctccgtggataagggggggcggggtggtgtcgcgtcggtgagggtacaggagaacgctgcgcagggtggtggtggtacttccgtaatttccttccgatttcctcctcgtcctagatggccctatactctcagggcctaattgggcccagcccaaccgcgatcccaaaaaaggagtgggccccacctgggaacggaatgcaaatgcaatggccacggtcaaggtcgtcccccttctcctgcaggtgggccctgctctcccacgtcagcatcactccaagtgtactttaatgtgtgtctgaggaggagaatgggattgagtagattgagaagatacgtaaaataagatgagccattagctcatgattaattaagtattaactattttaaatttcaaaaatgaattaatatgattttttaaaacaattttcctatttaatttattttaaaaaaacgcaccgtttagtaatttgaaaagcgtgcgcgcggaaaacaagactcaatctcccctatcaccgaacagagcctaagtttatccacttggacagtgggggtggatacacgcacgcacgcgatcctccgccgtccgcttcaccccgcgcgggcgatcctccgccgtccgctgggctccgcctcggagatccggcctcatccgcctcgtcgtctcctctcctcctcccccactcgcgtcgcgtctcctttctttaattgcttctctctcttctcccaattgcagtcctctcccccccactaatcccacccggtaatccctctcacgatgaacggccgcggcggcgattctccggcgacgaattgctgcaggggcggttcttcttcttcgtcttcgtcttggcgccggtcgatgtgggtctggtcgttgagtttgtatgcgatttgaccgctcccacgccctgtggcgtagttggttgcggtgcaactgttcgagctattgactgtttggctggctctctcctcggcgttattctgtggccgtttgggggattgggagtattggaatcctactcttccaggtacccatgataataagttcttccctccaaaagaattcttttcttgaccatttcatcttgccttttggagttttgttgacctgggctaaagttcacttctgtctttgcttaatatgcgtgtgggagtagagtgttctgcatgctataaatggaaggtttcttttttgtcatcgtgcatggacagggctaagcgctcgaacagttttggagtgtttgaccgttttatgtgtgtgagaagtggatccctggggattatatgtgttatttctaggcttgcagcggaataaggtttattgttggaaactttctttctaagatcttgttaatttcattgatgggactagtgcacattcaacaatagtaagttttagaaaaggaacaacaaaggtgcactttcaatatgactaggatgtttgctctgcactttagcccctatagtttcctggacacgctaaaaaaacgcccttcacacttatcttaccttatactaaagccattaaacttaagggattttttagacaatttcttgttttatctcctagagctcacaactaggtgctttaacctccgaccagtgcaccgttcatctccatttttagggattaatcagccactttttgtttaatcatccgactaatcgtccgcatattgcacttgattatcatttaaatatcttttatgaacttcatcttcaagatgtttaagaatattcacaccacagagtacttctcttgatgctcataaattagcagttccagtttgatattaaagtttttagtcaccatatacctttaacttcccaatctaactttgttaagatccttaaattatgtactttatggaaaatcaataaataattcaggtaaatacgatctgttttttgtttttgcattatccaaatagttgttccagataccttttcggtatccatatgtccatatttacttactgcctgagtaactgagtactttttctcggtaatttcatatgtttttgctaagctaaggttttgggcttataactgtcgagtcattacagttttcctttacaagatatgatgatttttcccccaatatggcaatatctaatcattaccttcggattttggaccagttctcctaagttcttcacaggaacaagtctgcaatcaggatggtttctgaagtctttgctaactttgagcttagtgacttgatgggtaattgattctcttgggtgttgttgcatttgtgctgtaacgtggataggagtcatggaaggtgtggtaaccagttcagttggtgaaccaaatcaagacaatgagccaagggattcttcaatagaacttcccagagtcattactgacatggagacttcagccatgcatgatcctgaagctcaaaagctaattggacatgaagctgatactgaattaacgccttatgaaggaatggaatttgagtctgaagatgctgcgagggatttctacagcaaatatgcaagacatgcaggttttagaattcgaatcagcaggtacactcgttctagacgtgataattcaataatttctcgtcgtattgtctgctcaaaagaggggtttcatgaaactcgtgattgtgaaaacctccatgtggaccagaaacagcaagcaagggtaggaactagagttggttgcaaggccatgttaatgattaaaaagtttgggcctgacaaatgggttgttaccaaattcataaaaatccataatcatggaccggttccaccaagaaaacctcatgctggagaacatcatgattgtgatctaatggaaaatccacattctattgaggtggaccctattgatgagccagtcgagggtatggaatttgaatctgaagaagctgctaaattattctatattaactatgcgagggttaatggtttccgtgcacgtattagcaggtactgccgttcaagacgtgataattcaatcatttcacgccagatcgtgtgttccaaggaaggcttccgtgaggttcgagccagaaaagatattacagatggaggcaaaacaacgaagcgccctagaatgataacaagagttggatgcaaagctatgattgtagtgaaaaggatgaactctggaaaatggatggtttctaaatttgagaaggagcataaccattctttgttatcttctagagcagtccctattacatcaaatgattcttctagagaagttattgattttgctgcaacgagtaatgatcctaatgaagtaaaggctgaaggatgtagcacaggaattcaatgtaattctacagattcactaactgtcctttacaaccatctatgtcaggaagccataaaatttgcaaaagaagggtcagttacagaagaaatttaccatgtggcaatgaatgccttgaaagaggctgcagagaaggtttctgaagtcaaaaggagtcacccgacaatgtcacagagtaaacatgaagttatgcaaatggaaactatgagtgcttcgcaatgttcaaatgatgacaaacagaaaacaatgacaccacagctcaagtttttgcaagagcccagtcccagtcttgtgctaataccaaccaaccttttgactcattcaagctcgaattgtgctgacaatattccactctcatgtgatttaactataaatggtaactatgttatgataatgataagctaatccattgctttgttagtgctttctccacaccgaatgatgttgggata

SEQ ID NO: 7922 - DNA, 5054 bp, Oryza sativa
cttcaccccttctggagctggagctcagccaaacagtttcggctccaccaaaactgggagtggagctgagtggagctctctcacaaaatgaactagagttgtggagctgggtttaggcagctccacaactccactccagactcaactcctggagttaaatttaggagttggagctataccaaacaggccctaatatacctagacgatttgtgtattctgtattggactagaaagatcttatgcgtagttctgaccgcggattccacttgtaatcaagccttacagggaaaggatgaaaggtttcatgtactttctaaagaaactacggttgctattcctgcgatacctctcacgctgtacatgcctataatgaagaatccaactggagattctgcaggtaatccatttccttctgctgtttacaggaaataagtgtaaaagtaatatttaaaattctagatagaaattacagatgcatcagtttagaaatctattagatatttatgcctgtcaattgttttcttcatcatatgtggcaagataagatagtaagtttacaacactaaaattttagaaatgacccaataattatatgtttagtaatgcctcttgacaccattttcttttgaaggaacaagaatattcgtgtgtggtctgttgtcctcatctgcaaaaatttaccaattgttttgcctactatagtagtttgcctgacaatttagttcgatagatcttgaaactcttcagtttggcatttctttgtttctttggaatgataggtggcttggagcattgtgtttatctgggttactttttttcttttttgcaatccaagaacataagtcatttaggatacttaataaagcttgtatagttgtgcaaatatggttataattcataccattgctggtagctttcaaaaagaggttatatcatttctagtgaatcactgtgagtatttactatcataaagcatttgcactgtacttgttaaaacatttactagtattatttgttttcaattccccagcgatcacatgagtgcttactcatcatcataaagcttttcatcatttagtcgatttccctacttgataactatctaccagtggatcttgattgattgctacctgccgttagaatgctctcctgacatcttcccattttcctggaatgcagatggccaatacaggttgttggccgctcctattgaagcagttccaatttcataccgtcctgcagaacccatccaacaaccacacggaagttttcctaattcagggccactacccggttttctacctaaactgtacaaacgaggaaaaggtccaaactcgctggtgcatgctactgctcttgcttgtggtgctcgtgtcgtgcctcctgaggaggctgcctcgctgatcaaggctattgagtccaagatcagatctggaggagccacaatagcaaaattgccttcaagcagcttgacacctctaattcctgaggtcgcctctatgtcatcttctagtgaagatgatgaggaaaatgaccacagtgagccactgatggcgagtgttgaacacaactgccatgatcagagctctgaggaaatgaagttggaggctgatccaccatcagagttggaaactgaagctgagaattgttctgcgcagccagaaaatgaaaacaacggtcctactcattgctgacaactgagaagtgagaactgaagtattgaagctttctgaaatcaaagccccacaaggtagtgattatatatatactgtaaattttgagcatttacataagattggatttaggattctaacagcttgtctcacttgaattatagattctaattgtgataactcaaataatttacttcaataaaggacttgtaaagagggtcgccttgctgttacaatatttgtggataatgtatacatgcacttttatagaaagaaaactaatgtcacagtatcttatattgaaattgggtccatatgtctggagaaaacatttagccatgttatatgaccacatttcacggtttaagaatttcacagacgaaggtccaattcgtgtgcaataattagggaaaaatcgcttgtttttttttgacaattcctaatatcacttttgctttcatttgaatggtctcaccaaaactcctgcaagctgaaatatagacaatagatatggttgcaaatggttccttccatgctaacatctccattcttgaaagctagaattttctcaaataaattttctcaatttttttctcaagctagtttagtttcttgaagctgaagctcaattttgatactgcaatataaagcgtgcgggatgatgtcgagcaccacaacgtttacctggtgtcgttcatttctttgaaaaacagcccccttcttcattactcttttatgcggttatgcctgaataatcctaatcaaagagaaaatgtcaggaagaagccatggtagtttgccactcgtgcacgatccggcactatgttgaaaaggttatcactcgtttaatcaacattatcgctgacctttcgacaacgaattggcagagcaaatattgcactaatccatggcgtcgccatgaaaaggaaatcacccctatgtcaaacggctgtcgtaccagagcagcagtgctgtaccagtgtacggtgggtgaacaagattctcgtttacttttttctcgggagagaggttcaaaagtcatagttctgactaacaacatttcttggaaatcttttaagtgattcccttaatgctgacacgatcaatttctctgggatatttgtatgccgtgcagttctgatcttctcagtttaacgaagggaacgaacctccttatcgtaagttgtacttgtattatcgtaaaaaaatatgtgtattccttttgtgttgaatgtgtgagaataatttttttgaaggtacaaacaaatgaataattattataaagttagaaaatgaatatagaacagtattgtaagaaattcatatgtaattagttttttttcctataaaaaatcatactgtataacagttcaagaagcatactcattaatccattcatcaaaatggaacaagcagggcagaatggaggtgtctgatggtatagtaacagaggagcaagcactggacatatgatcaaatcaagatgctttcaaattccaattcagaaaatagagatgtgtacaggggaagggggaatggagcatactgcatacacaccgtcaagctagacaaactgacagaacctaacagacacgcatgaaacttataggaagctagctaaactctaccggtagctgcacatcgatccaacattttcgtcatcatcattggcaaacacgcatagacccacttctttattgtaaccaactgactagcttcatcgcgttctttatctgcatattttttattcttcagtaactcaaaagtttggtccagcagcgaggatcttgtctgtcaggctgctgtctcccccgatcttgtagttggcgaacacctcgaagttcttcttgaacaggccagccagcttcaggagcgtctccttgtacgcgcccttgtccgtccactgcacagaggccacatttccgacgaagaacaactcagactctgcattttttacatgtatagcagaaatggcatgaactgatgcgtgatgctacggagcttacggtgttgatcgggtcgaggatttcagacgggatgccgtcgatttcagtggggatctccaggccaaacacctccgtcttcttgtagttggcggtgaggagctcaccggagtggatggcgtcgatgatcttcctggtatacggcagcctgatccgcttgccaactccgtacctgaacagtgaattcagagttagttcatgccacaggtaaatgtgcaatggtgtggacgctgttacagtggacagtagcagataccttccaccggaccaaccggtgttgacgagccacccggtggcgccatacttctgcatcttctcggcgagcatggcggcgtacttggtcgggtggagcatgatgaacgctgcaccgaagcaagcagagaacgtagcctgcggctccttgatgccatcctccgtgccggcaacctgttgaaatggcaatgcaataacgaagattcaggctaaattcctttgttgatcatcaaggtgataggaaggtaaggcaggtgactctgcttctgaacaaaaattgtttaccagagcagtgtagccactgatgaagtggtacatggtctgtggaaggtttagcttgctgacaggagggaggacgccgaaagcgtcgcatgccaggagaatgacgttcttcgggtgtggcccgacgcacggtatcttggcgttggggatgtactcgatagggtaagcagcgcgcgtgttctctgcagaaaagttcagagttgtgagatttccattttttgttttttgctgtaacttttgtgactgactgaaaccggattgcgctttggagataacttaccggtgacagatttgtcggtgtaatcaacttcacgggtgtgctcatcaaagacgacattctccaacactgcagacgccaaacattttcgatcaatgaaatggcaagcgggagaaactagaatgatcgactaaattaaactgaaggttcaggcaactaccggtcccaaacttgatggcattccaaatatcaggctctttctcctgtgacaagtctatgcacttggcatagcaaccaccctcgatgttggacacgccagtgtcactccagcagtgctcatcgtcgccgatcagcagcctgttgtggtcagttgacagagtagtctttccagtacctgccgattaaaataacacatacacaaaatcagccaaaaagatgacagtaaacaacaagggcactaacaacacaaattcttcagtgaaacaggcatcatgcacacagcaacaaagatctcaaacagatatgatgtattcagttattatatatatggtgatcaaggggaacgcgtcaaatgaaactgaacaagtgacggcaccaccggtggtttttcatttcatccaccgggag

SEQ ID NO: 7923 - DNA, 5491 bp, Oryza sativa
  unsure (1)..(5491): unsure at all n locations
nnnnnnnnnnnnnnnnnnnnnnnnnnnnnnnnnnnnnnnnnnnnnnnnnnnnnnnnnnnnnnnnnnccgattaaaataacacatacacaaaatcagccaaaaagatgacagtaaacaacaagggcactaacaacacaaattcttcagtgaaacaggcatcatgcacacagcaacaaagatctcaaacagatatgatgtattcagttattatatatatggtgatcaaggggaacgcgtcagatgagactgagcaggtgacggcaccacgggtgttttttcatttcatccaccgtggagagccatcttattacctgacagtccaaagaagagggcgacgtcgccctgcttgcccatgttgcagccggagtgcagggagaggatgcccctcctgggcatgaggtagtgcatcaccccgaagagccccttcttcatctccccggcgtactgcgtgccgaggatcaccatctccctcctagcgaggttgatgtctacgctcgtcgacgacgtcatgtagtgcgtgtaccggttgcaggggaactgcccggcgttgtatatggtgaagtccggcgtgccgaactcctccagctcctcctccgtcggccggatgcacctgccaagcccatttcccccacatatccattccggttactactgcaattctactacttagtacgccgctgatgtgagatgatcccccatgtcttggtaggcatgcaataggattccagcacacacacacaacatatagtcacatatatctcataatcatggagcagtatacgtcaaggtgaacttatctggtggcgacacgaacgagcgacctaaagatagtgcaaagtgacggcttcacttacatgttgtgcatgaagagcgagtggtacgccctggccgagatgatacggactttgatccggttctccgtgtcccagttcaggaactggtcgttcacaaacacctacagaaatacagaacaaaatatagtttgttatcaactgctgatgtaaaaattactgacacggtcactgaacttgagagtcgtatatcaccttgtcaagggagttgaggtagtcgacggccctctccctgttggtgaggaaagtgtgctcgtccatctcgatgttgggcgaacccctgcagtaggagagacacaggcaaaacagagtgatcagtcagctgcaaatcagcaagcagagcctgcagaaacagagctttgacatgcacaagtagagtaggcggtgaactcacttgccccaccaaagctcctgcgcggaggcctcatccttgacgatgcgcttgtccctcggcgaccggccggtcttggcgccggacagcgtcgccagcgcgccggtggacgtgatgaacgaccccttctcgtacttgatcgcctgctcgtacagctctgctcgcccacatcccaccagaaaacacgtcacttacacatgtcacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctcgccggatctcccctgacgaccttcggcccggtctcacgcgtcagcgacgccaacgacgcgctgcatcagacgtcatcgtgacagggatcgttccatcagttaattaccactttatcaggtcaaaataataataataagaacatccaaagaaaatcagcacttgctcagttgcttgctaccactgctaaacttactcctaaataaaagtaagaccatgtctcaatgaactcattgtgtctagttagtccgaatagaatactgtgtcgagcggcttgtgtagaacgatacgaggtttcctctaatttcttgggggaaattcaggcgcaagttacgcgacggcaacagctaccgacgccgccgcgtcaggctgatgaggagattatcgggtatccccgcggcgcaagttgccgccccaaattgcgctcgcgttcgttacgtctgagacaccgcatcggcggctggtgcgtgtcgtatcgtatcccccaacaagccctatcgcgataccgtcgacgttgccgatcgacacaaacggcagcgtgcatgacggaagcatgtattgctctcccaaaaatacagctaaaatcaacgcctctgttgtctctaccgcccaatcgaattctgtcacgccaaggttcttcgctcgctccccagcatgactgcgaaatcgtattgggatttttgggggtttgcgtggattcggtgcgatgcgagggggaatgcgaacttgtgcggtgcgtgcaagcgggtggatgttctgggcaattttgtgatgcggtgcggtgcggtgcacgggggatgtcacgtgaaaggctgcggcctgcgggcagcgggcgtgcatggcacggtgcggacatcttgtgatgattgtcctttctgctggaaaacgacctgggattgtaatccggacctacttttttttttgtccaactttttgtgcgtattagccgattaacccacggtaatcctagtcccaacattacttctttttttttttagaaacacattacttggtttggccccgtgagttacttttggtttatctttattcgtttcatttacgctctgaactctacgtgtctgttacgaatttaggttgctggatatggttgacacgcccgtcctccaatgtccacgtggcagaacaggtgcacaactaccattaccatggtccatcctttcgttctcttccatgtgggagtaaaattatccagcaacaacgtcattttatttttttttactttcgtcctatctaaaaggggattgttcgattcctcctcttcattttccatttccatttctcccggctaaaatttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagagccgaggagtcacctgatggactggagctgctggcgctggcgctcctcctcggagagggcggcggcgaagggcgaggaggcgccgtccttgatgggcgtggtgggcgccgaccgcttccgctgcagcgagtggagctcgtcgatggtctgcgcccgcaccggcgccgagctgtcgtcgtggcatatcccgttctcgtgcttcttcgtcttcgccccgtgcgtctcgatccgcgccagcccgttcggcgtgctcgccatggccgtctccggtcgcgcgaaaccttcaaaaaaaaaagtaaacagtcacgttaattagcaacgccaacataacagcgctagttacgatttacgacccggttctgccattgatgcttgcagcatccaaatgccggtgcaaaaaccacggagaaattaaaagagatgatgaacacgtacgaggcagtcgaggaggagatcagcaacgcgatagtgtacaagatgacaggacaggagtggagaggtgtggggcgtattgggcggagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaatagcaaatttggctcagtagattcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttattttgtcttttaggcaatatggttttttcatgtggcggatgaagatgtgcgagaagatgtagacgactatctgattttaatagattttgcagtattagtagagatacgtagaagcagaaagaaaaggaccatcactaatctcaattgcaaatagaacaatgtgattaacattattcatgtggttagcttttataaacggagcaggagatgacgagatgtagctgtaaattcattgataggaataggattaacacccgtagcagtgagaactggattgcctaagatatataagtaaacaaattggccaagtatgtggaaaaggcattagtactacaaagtagagtaatttacaaataggattattatgcatgcttatcatctgcaccgccaatcatccaggtagatcactggtgcgattatgcaagtcctttgtggtcgccattatcattcgcagataatctgaccatcctgggtcggcgcaggtcggccttcacctgttcatctatctagccgttatccaacctctcaagataaatccaacaaaaaataatctctcacaaagataatccaacaaaaaagggtgtgcacagctgagcagcccgacgtgccctctaaaaaatacgtaataagaacagagagcagtgttgacatttgatccagtcccaaccaggggcaacacagtacggtcattttacggttatcacgtatggtgatcttcttaatttttaaaaccacaataaatctcatgatgatttgtgtgataacagtcttatcattgtaaacttacctaaaatgatttggtgaacctgatcctaactcccaggctcccagctaatgtgtctgtgtgcgtcgcaaacatgcaattgcagatttgcannnnnnnnnnnnnnnnnnnnnnnnnnnnnnnnnnnnnnnnnnnnnnnnnnnnnnnnnt

SEQ ID NO: 7924 - DNA, 610 bp, Oryza sativa
atccgacttgctatagggcgaattcgagctcggtaccctaaacgaaaacaaacaactgagggaatacatccaaccactagctatctgagacttgacaccggtacactcacactgtcgcacacacatttacaacaacgacgacgacgacgacgatcaatggagatgaccgagaagagattcaaccgaagagcaacttcttgggcggctctcccttggcgcggtactttgctgcggcctcctcggccttcaccacctcctcccctcgccgcgcctccgtcgccgctcgcttctcctccgccgccctgtgcaccttcgccacgccgttcatcaacttctccacctgctccgccttcttcctctccaggtactcctgcatatatatgaaccgatcgatcaactcaatgattcacacacacataattgatctctccttgttctgcttgttgatgaacttagctgagctgaacttacttggtacttcttaatctcggcctcgatctcggccaccttggagttctcccatgaggcgatgtcggccaacttcttggccgccctgtgcgcgaaagtttcagttaaccgagggctcatttggaatgcaggaattttatat

SEQ ID NO: 7925 - DNA, 689 bp, Oryza sativa
ggcgaattcgagctcggtaccctgtaattcttttgagatatactttgtatttcaatcaaatataaagcacagcttcgtctgttgaattgtaagtttgctatctagaaatgcacctgaaactctgatgccttggggggaaaaaagcatcttgaacttttggaggtctgaccaaaggtttttggcccccaccgccaccttagggaagtccataaaatggctgttttgtggttgcataaataacaaatggcaaaagtttttactaatggattaaatttacccttggacccttggggtgacacagttgaaaaatgcactttgttgaaagtcaaaaactttcttaccccgtgatgttggcagcattatggtttatggtgaaacactggcttcagcctgtaaaggtgactttctttggttccttgcaggaccagaatgatccatctttcatcactttccaaattgcagtgttctaaaaactggttggtttgcacacagaagtggctaatattagtatctacggagaagccaaggataacgttagtgttcaatgaccattgatctgcattgttagcttttaggcttgtgtaaaataggaagctagcagccagcacacctgcacaagcaataccaggacctgtgtccactgaagggtgaggatgtgaagcatatatctacaaaaaagatcctctaac

SEQ ID NO: 7926 - DNA, 740 bp, Oryza sativa
ggcgaattcgagctcggtacccggggctgagcacaaaagtgttggctacgtggcatgccacgttggcggtcaaacgtggtcaaatgacaattggactaggtgtggtacattaaaccaagttcacggacctaaacatgtaattttcaagttcacggacctaagtgacaccaccccacaagtttaaggaccggccatgtatttcactctatgcctattcattcttctatcaatctcattgttcttattatgtgcaagtgcaacctaggcgccacctattatggcatgtcaatctcattgcttttttagaacttttcttcaatgggaatggtgcaaaatgtgtgaatcttgtttattctacaaaagttctatattttgaggcaactatcatgaattcgtgatggatcagagagtagttgttttgtgatggcatactgcagttgtgtgtaatagacatgtcaatactagtaacactttaaacttgctttcataggattcatttattaaggattggatgatttgaagtttatcatttaggtgactttaatgtgttgtcaacctttcatgtataatttgtgtaataggcaaaaggatatagtctctggctatgcataggtgtggtcaattcctgatgctaagtttgtctgatttttcaggttcggatctttcttgcttcctggttccttgccacattcttgatggtttctgtaattccgcctatactgcctggtccaagaaacttg

SEQ ID NO: 7927 - DNA, 1521 bp, Oryza sativa
  unsure (1)..(1521): unsure at all n locations
ccttttgaaggatcttgacttgaaataggtcactcgtgttcaatcctgccctcgggggctcgggtcagctaaaatcgccaaacggggcccagaaccgagccgtgccccgggacgtggtgaactccgggggggagggaatcggcaaaaacccacaatcgggtcacccataaccctcggtcaccacgctcccggcttggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgtgtcgccagcctcgtcgccactgtcggttttcccttgctgatgcgcgcgatttgcgaccgccgggattctgcccgaagagagagagagagcagggaggagaggcccccgagccgaacggcggcccaaggcccccgacggccggaactggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggacatgtggcccctgacgaagaagatcggccccaccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgttgttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagnnnnnnnnnnnnnnnnnnnnnnnnnnnnnnnnnnnnnnnnnnnnnnnnnnnnnnnnnnnnnn

SEQ ID NO: 7928 - DNA, 230 bp, Oryza sativa
cccccccccctccccgccgctccgctcagctccacgtcggcccggtagaagggagaggcggcgccgcttcgctcgtcgacggaggtgggggcggccgccggcgaagatcgagggcccggcggcggctccggatttgcctcgatcgctttgcgaggagagagagagaggaacgagggcgagcctggaggaggatgagactgagcgaggggtagtatggtaagtcaacaatt

SEQ ID NO: 7929 - DNA, 520 bp, Oryza sativa
ccctaggcagccggtggcggtggctttggcggcggtgggcgagcggatctgggaatcaattgtggggctttaatggaacctcaatgctcgtaaaaaaaagccactttcttccctgctaacttcttcctcggcgacatcatccccaatgccgtcgacgcctaccaatttcacagctccaccccccgtcgattcccagagccggtcgctcgccacctccaaccacctagggttagatttggatgagaatttcaggtatggggttgaacggtgagtgcgtttggttgaacctgggttacatgctactgaggttgggggtatttttgtccttttgaaatttctctctcatctttttcaccggaaatggtaacatattatctcggatgtcgctattgctaattatataaaggcaaattttgctacaggacactccttatatgtggttttagccctaggacactgcccaaactcacttttgggggaaaatactccataaacgtggtaatttgccagtggacaccgc

SEQ ID NO: 7930 - DNA, 641 bp, Oryza sativa
  unsure (1)..(641): unsure at all n locations
nnnnnnnnnnnnnnnnnnnnnnnnnnnnnnnnnnnnnnnnnnnnnnnnnnnnnnnnnnnnnntaagagtgaagtgcatcgtctgcataataaaagaggggtcaggctgaaaaaggtgaggtttggatatcagctaatgtcaaccaaaatgtgtgcatcctcaactaaagaaaaggagaacatatattattcttcatgcgtgcaaaaacacttctcaggaatccagtagatatttttgtggtaaattaatcaaactaatcatggagtggtaaatttatcacactaatcattgcaagtgatgcattatgattgttctatatatcatgtctcaacagagcagcgaatatgtgacttttgttgcttttgttaactttgtaagaaggcccggtgaattaacttgtaagaaggataccttggttagtgaatttgtaccgtgcaagtacaaaaaatgtaacacttcaaactcctcatcattatctttctggttgatcagaacttgatgctccattaggaggtgtggacaaagcgctggttgatccattctctgctggtggaggatttccccattttctctcagattccaagggttccaatacataaacaccaccatcagtcaggcctagagcaaactgatttgcttcc

SEQ ID NO: 7931 - DNA, 470 bp, Oryza sativa
  unsure (1)..(470): unsure at all n locations
gcaagcgatcgatgggtgttgtccaatttgataccacacggaacaggtttttgggtgctgtagatgaattcttgattaagatatgggacatgggcaacacaagtgttctgctaccattgataccgatggtggtcttcttgtgagagttttcccttatatgtagatactttggtaaatggtgattggttcaaatgaaatgagtaaggggatttccatcttaatctaacccagcacgcaattattaggcaagtccacgggtccgattctacaagaaaggtactctgctggctgtttctacccatgaaaatggtatcaagatcttagcacatgctgatatagtacggttgctgcgcacactgtaaaatcgttcacttaatgcttctcggagtgcgtctgagactgtaacaaaggtaagttcttgtgaccatttaannnnnnnnnnnnnnnnnnnnnnnnnnnnnnnnnnnnnn

SEQ ID NO: 7932 - DNA, 683 bp, Oryza sativa
  unsure (1)..(683): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttcgagtgtgataatagtgtccgatatcagttgtgaaatacagccgagatgggtgaatagagtgtaaagcatcaggtgcttgtgagtgatatactctgcattaattggggtgtgatttttgctgcattgcatttggttttcatgtagagccagatgcagtaatgattcggtatacgtccgaagaatagcggtatgtatattggagggttgttcgattcttggtaagagtctagtagtgaacggtgggtagtctaaggtgaaaggtatcagctcagtcaatgagggtaatggggcttatacgtgagatctcgcgcgataatcgcagttaaaggaggcatgtgaggtgaatggccagccctataattaaggacagatgccgtttgagtcgcgcgtccatgcagtgtatttattgagcaannnnnnnnnnnnnnnnnnnnnnnnnnnnnnnnnnnnnnnnnnnnnnnnnnnnnnnnnnnnnnnnnnnnnnnnnn

SEQ ID NO: 7933 - DNA, 2594 bp, Oryza sativa
ccacaaaacctatggatacccccctaagccccccttcaattttttcatcatagttgataagataggaggtgctaaaggtcttataatagcattttagcatagtttaataatgagattatatgtttatatcggtgtactcggtatgttgagtccccccaactttttgtttctggatccgcccctgatggttggtggtgagcttttgcatgcatggcatcctgggttcgattcccttgccatgcaaattttgtctttaatttcccttggtgtatgctccctctttctatttgactcagtgccatacttatctttctatttgaatcagtgtcatatttatttttgaaagaatacaaacaaatgagagaataaaaaagaatacaaacaagtaagagaataaaaaagaacagggaaaaaaaatgacttttctagcgatcggtgagattcgaacgtaggaccatgtgtacacaaggcaagcaaccaaaccatggcaccactaccttggtacacagaacaaatcaaattgttaattagcaagtatatggggtcagcgccgaggtatttgacgctaaccccgtgccacgtgaaaattcaatgccagctcaacaaaaatctcggcgccaatgtttttggcgctgagacgttagacctcagcgccaacctcaatggcgctgaaccgacggcctagttttggttgaagtttttggcagggactattttcaaaataagtttttataaagggccaatttgtcgaaaaaacggtgttgttggcgtgtatcgatcaggtcaggtggatgggaagagaacggacaccggaagagcgttcccgttaattgctgctcctgattacttatttgctcgctgttaaccgcgacagaattgtgtacgtgcgagaggccgtttttaaagttgtgcaagagattctctgttaactcgatggcgagatgccgatcgatggcaatgcaagacgcgtccatcgtctccaaaaccgtgcgagcgcgacgcgtcggaaatactgtgcactctgtgcctactccgcgtcctctaaacttacggcccgaattcttagtccctccgtttcacaatataagtcattttaatattttttatatttaaattaatgttaatgaattcagacatatatatatctatttatattcattaatattaatatgaatgtgtaaaatattagaatgatgaaacggaggaagtatacagtacaataccgcctcggacgggcacctcagggcgcaacattactgcatcgtattagcccacccgaatctagtaaatctagatggaataagatcactttgactccctcaactgaccactaaatctaaatcgtattcctcaaccacaataccagaaatcttaacccccgaacttacaaaaccggtgtaatttgactcccttggtggttttggagggtgatttcgctgacgtggtgcacacgtggcagcgttgatccggtctttgtcccacgtggcattgacgtggcgcttatgtggcattaaaataaaaaaatatatgcagggcccagtcattcacccaaaaataattgtgggacccacaaacatgtaggtcccacatgtcatcctccctcctctatatttccctctttcgcttttacagcggcgttcggatcggcggcggcgacggcgggcgatggacgaatcaacagcggcgggcgggcggccattggagttgcggatccggaggccggatctgcccctcgcttcattcctcctcccgatagactgcgccatggccgtcgccgctgcgctgccgaccgtcgccggggagctagccatggacgagactaaacattcacaaatctcaccagggctggccgcctgggcccaaggtagagctggccggctactaggaggacgcgggagctcaggtccctcggcggcggtgcgggcgctccagctatggcggagagggtggcttgctttggagggggatagggaagaggacaaatattgcccgctgggcagtagccaaaagcaaaggagtactggggcacatctatacacgagctagacaaacgacagatcctacaatgctcaaaaccaaaaccactacatcagttcaacatctcgaaacaagaaattgtaaattgaaaaaacaaaacaaaataagccacggcaaattgtccaaatttcacgcgtcgacgaggatgcacaaggaaggaactaagagtactagaggtttacttgttcaaatcgttaaacgattggttggaattagtgggaggtcatcgggaagcgtcgacggtgaaggcctaaaccgtcggcttgtacccctggccgcgccgaggctgaccagcacggacttgaggaaactcctttcccagcgacatggctccggcgccctcaaaggacaccgcttctgacgtcgacaaggacggtcgctgctccatgcatggctccggcgacgacgggagggtgtcattaatggcgctgctagagtaggcggagcggtggcgacggcggccggggacgccagcctgaggcgcatgatgaacgccgtcttggttacgcccacgccgatcgtcgccgcgagccccgagttgcggctagctatgccgg

SEQ ID NO: 7934 - DNA, 1301 bp, Oryza sativa
agggaagagagggaggaggaagaagggataagagataatgacatgtgggacttacaagtcagtgggtcccataattttttttttggtgaatgacaaatgggccctgcatatatttttttattttgatgccacataagcgctacgtaaatgccacgtgggacaaagatctggtcaacactgctacgtgtgcgccacgtcagcgaaaccgctcttcaaaaccaccaaaggagtcaaattacaccagttttataagttcgggggtcaagatttctagtattacggttgaggagtaccatttagattcggtggtcagttaagggaatcaaagtgatcttattccaatctagatcgcgaccatccgatttgggccatctagtcttatgcccgagaagagatgcaccgcaccagaaggcccattaaaacttcagtcgcgcatgcatccagttgaggcccacaatatatctagtgccccggtccggccagccgtgagcccacgtgaaccgccaaccgtctccctcgccgatctcggcgtcgcgagtcgtgcgtgacccaacgccgcccgcgttggcggcacggcgcgccgggcacctccacggctccacccttcgccgcgcgtgcctcaacgatgccacgccgtggcgtgcattcccacgtcatccgacgagggcgtgcggcgtgcctaatctacgggcccagcgagcgagcggcggccgtcgccgccgcgccgcgccgcgctcgctcgcgtggccaagatcaacgggagcaaagacgttgtggttggtcctcgtgggccgcgtcaaaggggacacgcacgcgacggtcgaaactgtactggtcagtctcagtctcagtccggagtcattgctatttacaactcaatagcgaacaaaagcgatttatttacatacgtacaatcgtatgtacaatctatactaatttttcaggagatatgcaagctacactgacaaattacatgtttaaacctaacgattattctctgaatcattagttcgtgtacacttgctagcagctacttctttctatactgcaatctagcctgtccatgcaaggagataggactgaaaactaacgaaatcttgggacatttgctcaaagaccatgagcacagagaacacccccatccctactaaaactggctttgcactagtcaagtccacattgccactgccaccggcgacagatgattccgcttcgacagatccagctctcgaatctgacatcctggaggcgatagcccacgccatcaatggaggaagaacgccatacaagatggtcatggg

SEQ ID NO: 7935 - DNA, 1738 bp, Oryza sativa
catgctagctaggatggcaagaactgaaggatttcacatgtattggtgtacactcactgcaatgtcagtagcaatggagaatgaattcggaacggtagctgcaattagcacggttggggcaaccacagcccctgcagcgatgtagctgagcctgttgttgtccacagccgttttcgctccacgatgccttaatgcttcttcttcctgcactcatcgattgtttgttcataaaactgaacagattgttcttagatataaattaatgcaagtcctctggctgatgaagcatacatgtccttgggctgaagaagagacaagattggtcatctgctcaatgaagaactgtgaagctcccagcagtgttccgatcagcgacgtcccgacagcaaggagtgagaacgtctccacaacagtataactccatctacaaaagaaagaaaattttgtcctgttaggattcaacgcctccagcttcatacagagaagcagattgcaggtgaagctgtacacaacgtgttcttgctagtgcagtagtgctacagcggagacgctcactctgtattaagcatatccaggatgtcaaacccatcaagatccgtggagatgctgagcgcgatgtcgtcccacacgagcaaggacagcaatggcacgatgctcccgacgagtatcgagagccgaatcctcacgaggtcccctccaaggtacgcgcatatcactgcgacaattgcacactgaatcttcagtacttgtacctcttgcaagttgcaaatttcatccgtgggatgattacataagttgcattgcatgtacctggtgcgatatcatggaagaccagcgtgaagatgatcaccggaagcgttgcagggacctgctcccagttggtgttagctggcagggtcaggccggcaccgaatgctactgcagacacctcgatcgtcagcagtaatcctgcatcagtagacagatcacgatggtagttagtacttagtactagtgcgcaagacagatcacgttgatgacagcaagaacatgaggtgtatggatgtaatatggttatcagctacagtaggtttgctcttacttcagcacagtgcattgtgttgcaagtagtatggagctcccagtggggagagtgggtgtttgttcgtcattgtctctacactttcagaaatgagttactactccactacatgccatctttgaattccagttgggcgaaccagtgtttgttcatctctgttttcacaatttcagaaacgagttactgttccatatgctgctaccatctttaaagtcacattttctttttcttgcttaattagcttggagatgttcagacagcagaatttcttctgaaagaagacggctgcagatgccaaatttgtcatttaagcgtattaatgcagatctaaacaatgtggtatttagtaccgttggctgttccaagtgttgatcacaacgatagcttaccaacctatcatgacgaaagtgagcagctggttcactttgtcggtgacgcccgtgccaccggcggcgatgaggagcgcaagggcggcggtgaaggcgcagccggagacgggctcgggaacgccggcgaccacgctggagagcacctcgccagacttggacgtgtaggcgaccatggaggtgtaggacaggaacaggtaggcccgggcggccaggttccctccccactcgcccagggtctcctgccccatgctcttcagcgatatgacct

SEQ ID NO: 7936 - DNA, 2192 bp, Oryza sativa
  unsure (1)..(2192): unsure at all n locations
gacaagaacttaaacatccaccatacaaaggaaaagttcaagttcagatttttcttcttgttccatttctgttcgggagatttttttttttttttacgaatttgccagatcaagaatgcttgaggttggtgggtcgacaattaaccaagtgaaccttgaatgctcgtaactactcctcacaacaaagacagagaaattcagctgtttgtggggggtacatgtggacggctacttcagatctgtctcatgatagtactactagaactgctgctactactttcatttttggcgatcagatatcctgtcagttccgtgccaaattcatggtcctgaatcctgatagatgggccatcactaattacttcaccgtacgttgtagactagtattagtagtataatctttcggtgtcatgtggaaaggtcaaggcaagagagggacctgtcaccggtccgagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtactacgatgagagggtgattgattccatcgattttttcgcgttgtcttcctctaaaatcatgcaccgtgttgatcacatgtcgaaatcggcgcaggcgatcgttcgttttagggattctgattgtgatgatgctagcaataggctcgtcaggtgtagggtagtacggcgactcaccgcgggcgccgtgcgctgtggcacggcgaggatgccggagccgatgctggtcccgaccacgagcgcggcggcgccaaccacgctcccccgcttcgcgccaccgcccgaagacggcgcctctgccacgcccgccgccacatctccctccccctgaggcggcggccgcgcgtcgccgccgcgcgctcccgccgctctcacctcggagacggcccgggccctctcgccggtggctgcactactgccgcaccactggacgccgccgccgcgatggactctcctttccggcaagcatgtcgtggtcgtcactgggatgcaccggtacggggcgcggtggaatctagctgggcggtgctgcaagcgggcgcgcgtgatggcgccttgcatcggggaggtttcttgggtgtttgtgagctagagctgcggactggagggaatccccatggcggtatattcatcgtaggagtgacggagtgcgttgtcgagtgtcgaccacacgatcatgtggaatcttgagctccggtggtgggcggtggaagcggaatcttttgcagttgtggagcaggagcgcgcgcggacggacacggttgccgtgagactctggaccatgaaggctgattttgtttggagctatacatctccatcagtggtttgtggctgacaatatgtgaaaaataaacttcgaaaatagagtaaactagcatggtggtccagtccgcgcagattgcgcggctagcatcattatattttctctcatataataacatatatgtttttttattatattattcaaatatattaaaatgacaacataattttaaattttgtaacaactttacaaaactactaatgtgtaatattcatattatattttatatacttgttagttattaattatttttaaaatcaaaatttagttatttgcaaattatatatattcttatatggactctagactcgtcttttaatatttcttttttaaaattccgaattttctgtaaattgtatttatgtatagactctatgctcttcttccaatattattttttttatttctgaatttttatattatattttatatacgtgttagttattaattatttttaatatcaaattttagttatttgtaaattatatatattcctatatggactctagactcgtcttttaattccgaattttctgtaaattgtatttctatatagactctatgcacttcttccaatattatttatttttatttctgaaattttattatttctaattgtatttccatgtggactctaaactcttttttcaatattctttaatttttnnnnnnnnnnnnnnnnnnnnnnnnnnnnnnnnnnnnnnnnnnnnnnnnnnnnnnnnnnnnnnnnnnnnnnnnnn

SEQ ID NO: 7937 - DNA, 3972 bp, Oryza sativa
gaattcgagctctgtacccactctagactcgtcttttaatagttcttttttaaaattccgaattttctgtaaattgtatttatgtatagactctatgctcttcttccaatattattttttttatttctgaatttttatattatattttatatacgtgttagttattaattatttttaatatcaaattttagttatttgtaaattatatatattcctatatggactctagactcgtcttttaattccgaattttctgtaaattgtatttctatatagactctatgcacttcttccaatattatttatttttatttctgaaattttattatttctaattgtatttccatgtggactctaaactcatttttcaatattctttaatttttaatttttaatttcagttacttctaaattgtattcctatatttgtattcctatattgaccttaaactcttcttcccgtgtttttcttaatattgaattttagttatttgtaaattgtatttttatacggactctaaactctacttttaattttattatgtttattccaaaatatagttagttttaaattcctatatgcactctataatctacttctaatatttcttatttttaattccgaatttctatttttttcttaattgtatttctatatggactctatactttacttctgatatttcttatttttaattccaaatgtctattatttcctaattgtatttctatattgcctctatactctacttctaatattctttatttttaattccgaatttcagttatttcctaactgtatttctatatggactgtatactctacttctaatattccttatttttaattccgaatttcagttatttcctaattatatttctatatggactctagtctcctcttctaatattccttatttttaaatatttcttatttttttttaattccaaatttcagctatttctaaattgtatttctatatggactctgctttttctttttctccgattaatgtgagaatttctaggccatgagagcgaatgcggagggtcctttttctattcctttaataatataatagattactgttcgtgctgtatattcttgccaaatatttttaggagtgttaatttaatagggggtaaaagagaaggttgagaaataggtaaacgggatgattcattagcgcatgattaattaagtattaattattataaatttgaaaaatatatcactatgattttcttaaagtaactttacatataatttttttccataaaacacatcatttagtacttgggaagtgtacgcatgaaaaagtcaaatctactcacaatcttgtgcaaatgaaaacacccttaggccatcaccgatgcgtctctgggtcgttccctcgccgacggacatccgcttttccgtccgcgtcagctccctacgatggagcgcatcccccggcccagggacgcgtctctcgccacttttcagccgagcgatgcagccgagggatgcattgggagggggatgggctcctgtggacatcggttccccaacgagttttcctatttcaccccttggtagagctggagtatccgccgaccgaggcggacccacaagagagatagagagcggcggcaacgacaaatccgcggcggagtaggcacctcatccacctcgtgctcgccatccgccgcctcgactgccgcgatcagcacggcgctcgccaccgtccgccgccttgtccaccatgcgctcgccatccgccactgtccgccgccgcgacccgcgcggcgccggatctgccacctccggggtcgccgccaccaccttccacgggagagagagagagggggggagagagcggcggcggcctgggcttctctcggtgctctcgcgtggatgatggagaaagagagagagagagagaagagaggggtagaataggaaagagaggaagaggagagagagagagagagtcttttttgggttgggatactcattgggctacccagatgtgacctgcattatagaggtgagtacccctaaaatccctcagatagtgaggacaccctagaagtggctcatattgttgatgcccttagactaccccttgaagcattttttttcactttgaaaagtgatcgctgccaaatgttaagcattggatcagttgtctcacgtgtaagtgagacatggacagcaaaaatggttccttattgcctgaaaaatagtccctgttacttaaaaatctatccgggacttaaaaaatatttttagtcccgatttaaaagcacaataggactaggtgatctttagtcccggttggcaccaaagatcatctttagtccagactgattccatgtcaggctgtgttaggacgcccaagatttttactaaatatactaactttaattccgattggtattaccaaccggaaataaaaatcaaaacactatatataatttttatgacttatcctcttctcccatcctcaaaaactcctcgtctcctctatattttttcctccatctccttatctctctttcctgtacctgtttttcctttctttccttatctcagcgcggggagcggctgggagcgagccgagcgcacgacgaggagattgggcggcggccgggcgcacgaggagacggggcagcaaccgggcgtggtcggcggcggccgggctggggaggctgggaggaagaatttgtttgtttacgatttgtggtgaatttcttcttgagaatttgtgatgtatttaaccgtgacgtgaatatgtgatgttatttttagaatttgtgatgtaaccatctttgagaatttgtgatgtatgctctgtggtttggagatgatttggggatttcacgatttggtgatgatttgggaatggagttaaatcaatatgcaaggagttaaaaacaataaaaaaactaaaaaaaactaccaatcgagacctggtctcttcatctttaatcccggttggtaacgatctttaatcccgattatttcacgctatagtctcggatacaaccaggactacatagggttacgaactattgggttgtgatccaaatttatttgcacacgtataaaggctaacttcggacggagtgaagcggaggcccgtcgtcggaggcttgggctggagcgaagtgtccagattcgttatactaggagatgccacatcccctcataggttgtcttttttttagacgaagagagtacggggctgtttggttcttaactaacattgacataactcactttagacaatgttaggcagccacactttttgtggcctacaaattataagccacacttatggcaaagttaggtaaaagattgagtctacgacgtgtggggtaagatgataagaaagtatggattgccataagacaatgaaacaaacacaaggctaaaacggtataacagtctaaaatgtattgtggtaagttgaagcattgaaccaaacagcctacgcctcaactgcagtctatcttctccgagatggatccattggtgagcgccttgaatgtggcaggtgcaggttgcctcggcaacgtgggctctccacctatgctgtcgtcctctccaaccccgttccggcgattcgcaggctttcctctcagcccacaggccgagcgagtgatgaggcgtccaactaattctgctctcgccttcattgcgccatttaacactcggcgctctcggctctcctcctcactaccccaactacccactcccccctccacttaaacgcgcgcgcccccccgcccgcctctccgtcctcggaagcgccgcccactcttccgtccacgcctatcgctcctctccgtgggttccccccgcgcaagttgtgcgcgccatggagatgcagctcgccgccgtcctcgcctcgctcgccctcggcggcgcgctgctcgtgctcgtcttcggcaagtggtgcagccgctggccgacgccgacaggcg

SEQ ID NO: 7938 - DNA, 6815 bp, Oryza sativa
ggaggagctggagctcccgccggggaccagtctcacgaggccctacctcaacgaggcgctccgcttcctcggcgactgcgacgccgcgctcggcgtctggggcgcggggggcgtgggcaagaccacggtgctcacgcacgtccgcgacgcgtgcggcctcgtcgcgccgttcgaccacgtcctgctcgtggcgacctccagggactgcacggtggcgaagctgcagagggaggtcgtgggcgtgctcggcctccgcgacgcgccgacggagcaggcgcaggccgccggcatcctgagcttcctcagggacaagagcttcctgctgctcctcgacggcgtgtgggagcgacttgacctggagagggtcggcatcccgcagccgctcggcatggtggccggccgggtgaggaaggtggtggtggcgtcgaggagcgaggcggtgtgcgccgacatgggatgccgcaagaagatcaagatggagtgcttgagcgaggaggatgcgtggaacctgttcgaggccaacgctcgcgaggagacgatccatcgccaccctcggattcctgcactttcaagacaggtaatcacttgatctgtctttgtttgaaatcagattggttcaaaacaagcgctacgtttagcattttcagttttccttcaaaaaatagatatcttccatccgttagatcatacaatggtacatgcttaagtttcagtctaggtttgatgctaactgtaaggatttatttcgattgagaaatgagatggtcaaattctcatgtctccgctaactgaatttccttgtatatttttttataaatggattttccgataaacattagctacctttttaaatcaggatcatctctgtgatttcctgttctttccagctactaccaaattgcaaatcacaaattgaatgctatcagattattatcacccaatggttatggtacaatactaccctttgcagaatggtcttgcagaagattttaaaatgtgttccgttttacacaaaggcaatcgaacaattctgtttctctattttccatgataatctttctgtttcttcaatccttttgcactggcttgttgcacgacttatcaacgtgttatgtacttatgtgccatcaagtttagttgatgtatttcatttacatttgatctgttccatcattgacaactgctaataaattcgttctacaactaaacaggttgcttcagagtgcaagggcttgcctttgtccctcgtcaccgtcggccgcgccatgtcgagcaagcgcacaccgaaggagtggggcgacgcgctcgacgccctgaagaagacgaagctctcgagcgcgcccggcccggacaagatcgctcaccctctagtgaaattctgctacgacaatctggagaacgacatggcgagggagtgcttcctggcctgcgcgctctggccggaggatcacaacatctccaaggacgagctcgtccagtgctggacagggctcggcctgctcccggagctcgccgacgtcgacgaggcgcaccggctcgcgcactcggtgatctccgtgctggaggcgtcgcggctggtggagcgcggggacaaccaccggtacaacatgttcccgtccgacacgcacgtcaggctccacgacgtcgtccgcgacgcggcgctccggttcgcgcctggcaagtggctggtccgcgccggcgccgggctgagggagccgccgcgggaggaggcgctgtggcgcgacgcgcggcgggtgtccctgatgcacaacggcatcgaggacgtgccggcgaagacggggggcgccctcgcggacgcgcagccggagacgctgatgctccagtgcaaccgtgccctgccgaagaggatgatccaggcgatccagcacttcacaagggtgacctaccttgacatggaggagaccggcatcgtcgacgcgttcccgatggagatctgctgcttggtcaacctggagtacctcaacctctccaagaacaggatcctgtcgctgccgatggagctgagcaacctgagccagctcaagtacctctacctgcgcgacaactactacatccagatcaccataccggccgggctgatctcacggctcgggaagctgcaggtgctcgaactgttcaccgcgagcatcgtctccatcgcggacgactacatcgcgccggtaattgatgatcttgagagcagcggcgcgcagctgacggcgctgggcctgtggctggacagcaccagggacgtggcgaggctcgcgaggctggcgcctggcgtgcgcgcccggtcgctccacctccgcaagctgcaggacggcacgcggtccctgccgctgctgtccgcgcagcacgcggcggagttcggcggcgtgcaggagagcatcagggagatgaccatctactcctccgacgtcgaggagatcgtcgccgacgcacgcgcgccgaggctggaggtgatcaagttcgggttcctgacgaagctccgcaccgtggcgtggtcccacggggcggcgtccaacctccgggaggtggccatcggcgcgtgccacgccgtggcgcacctgacgtgggtgcagcacctcccgcacctggagtcgctcaacctcagcgggtgcaacggcatgacgacgctgctgggcggcgccgcggacggtggcagcgcggcgggtgagctggtgacgttcccgcggctgcgtctgctggcgctgctgggtctgcccaagctggaggccatccccggcgacggcggggagtgcgcgttcccggagctccggcgcgtgcagacgaggggttgcccgcggctgaggcgcatcccgatgccccccgcccgggcggcgagcgggcagtgcaaggtgagggtggagtgcgacaagcactggtggggcgcgctgcagtgggcgagcgacgacgtcaagtcctacttcgcgcccgtgctgatctgaacaaaacaacgtcgtcgtcgctgcaatctcgccgcgccgtgccgcgcgtgcgtgcatccgattttccgatgcagaggttgaagttttggagacgtgctgatctgttagggaaggaacgtcgggggaaatttggtgactgttaatttggattatttttcattttcctttaaatttgggacggtttcttttgaacatcttgtgtttcgttgccaaaaggaaaactcaaccgctgaacattgcacttctttctttgttttgctcaaactatatcctatgctacaaacaagcaaacttgaatatctgatatgttcatactagttttgtgctcgaattcccgacgtgattataaggctgaattcctgacgtgattataaggctgagtttagttccaaactttttcttcaaacttttaacttttccatcacatcaaaacttttctatatataggcctggtttagtttccaactttttcatcgaactttcaacttttttatcacatcaaaacttttctacacataagcctggtttagatttcaactttttcttcaaactttcaacttttctatcacatcaaaactttcctgcacacataaactactaacttttctgtcgcatcattttaattttaatcaaattttcaattttgacgtgaactaaacacgcccatacaaatttccaacttttccgtcacatcgttccaatttcaatcaaacttttaattttggtgtgaactaaacacaccctaatacgtaggacatgctgatgtttactggggggcccttccggcctggggagtagcaggctgggttggctatgggccatggtttgggctgcacctggacattgcagctaaatggatcggttaattacctaagcagtcactaaaaagggctgattagagttttctttttttttatctcgttatatcttttttttcttgtgagaataaagctaaactcagttcgttcctttctcaaagtatgagatctgttatgtatgaaatctacgacctgtttggatgttttccagcttttgtcacgtggaaagcttttaaaagatctattgcacaccatgatgaattcattaccagctttgactggacaaacaaagatgtataaaagaaggagcgtatcctatgcacacaggctctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgtttttttgttacggctaaaatataatgaatttgatgttaagattttaaccctatgtgtaatacaattgaaagtatgtgtatgattttttctagattttttggtgacattttttagttggtgtgcacgtgtgtacacgtgagggcctgtatgtatagaatatgttgccataaaaggaaggggtgtgatgtagatattgtctgtactcaactaaggagaggagaggaagaagaacagagatgttgagatgtggatctaaataaacatttactggtgcaaggagaaagcatccaaaacgccgcttgctaaatcataggatactttagtacgagtgtattatataagtaatcaggtaaatatgttgacatgaacataattgtagaaatacatgatcattttcatttgaagccaaaatatggcatatcaaattcttaatagtactttggctagtgtttggtttgctattaaaatgtgccattggactcaatcaaaatttacctatattttgacattgccaatatcttaacatggtagcgaagcaaacaaacctataatgccaatttttattgaatatatgtgataattgttttcactcgattcaattcagattcaagagacgatgagtggttaaaaacaaaccacaaatgaaacaaggagtaaagcaagggcttgtttggattgaagctaaattttgtccaaccaaaatcatggcaaatttaaccgtgtcacgtacgcctcactagttcaaattatatactagcacaaaaatttaccaggttttggcaaaacaagcctttaggttggttcagatccgtttgttctagcatggaaaacaagataatttattagcgtatgattaattaatcattactccctccattccataatacaaggcacaagtactttttagatttgttctataatataaggcatacatgcatacatgctattaactaacacatcttcttcactaaaatattactatttaaattttccactatcaaaatctctaattttattgggtgcatgcattgtatttattagattaatccaaactatgaggtgataataattatttattggtctttgggttgtgtcttgtattttggaatggagggagtaactaaaaactttaaaaatagatgatattttttaaaagtaacatatatatatatatatatatatatatatatatatagaactactatacggcaccttagggtgctacgtattaaacaatacctgatacagcctccagccccaccaggtccataataagcagttaaaatttaactcatcgacgaccaatctccaatccacccctagcccaaactatgaggtgataataattatttattggtctttgggttgtgtcttgtattttggaatggagggagtaactaaaaactttaaaaatagatgatattttttaaaagtaacatatacatatgtatatatatacatatacatatatgtatatatacatatacatatgtatatatatacagaactactatacagcaccttagggtgctacgtattaaacaacacctgatacagcctccagccccaccaggtccataataagcagttaaaatttaactcatcgacgaccaatctccaatccacccctagccgtagtagtaattttttttacttgcattttgcaccgcctatatatgtatttgtatccagcaataagcccgtaaccattcaaacctccaattcccgaaatttttggatccatcccagcacccagccgtagaatgccctaccggcacctcaccgccacgccatcgtgatcgtcgtgttcgcggcgggatccgcagtaggcaacgtgcaacgagatccaagccgtgagtggtgataagttgcgagacttggtggcggatcggtatccggctctacccgtcggcatcgccgatgtcaaattgaattggtgtggcgccggcaacaatgctttcccaagcgcttgcctcgatggcgggcctacggcggcggccacagggatggaggcggttcaggactcgggagaatagatgtgcctcatccttcatcttggatctacacagcagttgcgcgtacatgcatggtcggggatgttgagggtgccatgcatggatcccggtgctgaggggcgtggcggcgagcgctggcgttgtctgtgagtaggccgggctctacggccggatatggcttgttttttgcgaagcaactagcgaacggtgcagtcgacaatcgatctgcgcagcccctaccatcactggatgtcgctccctaggagcgtgccatggaacttccatgagcaggaggatcgatgaagagcgtcagccttggtgccatgccggccatcctccatgacatcgacggtgcccccgcgggccgcgtggcctcgttgcctgctgcagtggttccatggataccggtggtggaagctgctccctcgctggtggtggaagtacattttgcgctcgacgtaggggagcatggatccgacggtcagggatgaggaggtcgtcgctacctttagagg

SEQ ID NO: 7939 - DNA, 1833 bp, Oryza sativa
tatatatatatatatatatatatatatatatatatatatatatatatatatatatatatattaaaaattgttcgagaaatgaaaacgtgaaaaacaaagagtaaggattgaaaagggaattgctatacacacccttcctgcagcctccagcttccctccgccaatccaccatcgccgttggattcgtaatcgtcggacacctcgaatcgccgcaaaaataaaggcgagcacccaaccgcaccgcaacctcctttcgatcggctctcccctctcttctccttccccccttcccctcctgcaagtaaaacaagcgagagactccccccctcaatggcgtcccggatcgcgaggctgctacagcaccagaaccgccgcctcctctccaccgccgcggaggcctcctcccgccgtccgccgcgcgctcccctcagcggcgccatccccaaggtaaccccgcggcaaccggggaggttgtaaccctaaacccgcttaaacccctgcgcgcctccgaggtgttcggcggaatgccgacaccggctcgcatgcctctgtcgctgtttcattgatagcttcgtgtttaagtgagctttccggtaatgtgatgccctagttaggtccctgagccggacctaacgcatgccaggcgcaggtttcactgaagtattaattgttgcttagggcaatgggttatgcggtgagctcatctggagtcttatcgccattgtagcatgtggttcctgttgaatctatatacttagagcctaaagcaatgcttgatttgttactctaatagtggtaatgaatagtgcctttttatttttctatatagacacaccattatctccgacctttttattttctatatagatacaccattatcctgaccttgtttcaacttttaactgttcctaatccgagactgaatagatccttaagaagattgttgaatctgttcattgtgtgataaactaatagttttttttgtgtgttttctgctctaggtgacatatatgtctttttttacctttcgtcttttttttttcagcatgaagttgcaaaggctgaaggtctaagctcatcttcaatcctgaagctctctactttgttcatcaagtgtctatttatgcaagtttcaaattttcttatatggttgcatccatgtttctaaagatgttctgggtattattgcatctaagaaatgaccgctgtttcttgtgctgagtggcacaacatctcctacactacatgttataaatgttgttacttactttgctttaatttaactgcaaataagcatagaagctaaattgatagtgcaaataagaataacatgttagatgtatctgaatgctcactaaactcacagtgtggtggcaaatgtactcgcatccctataaatttcatctgctacctcaattttggttccttcctgatcatacttttagggacaatctacatataattattttatctgcctacctgctgcttgtcacaattttttattcaaattcttgcaatattttttcagctacatcaaaagaattgctagttgctgacatataatatgctttctttatgaaacatatattatctgctgatcaaagattttattttttgtttttttaatgttttaagcatagtatgacagagagttgcatattctaatttcaaatattgtacgtactctttcatatactggtttagagagcattactgaatgcactgcccttgtaatactaagtcaagcatactcttcatacatcaaacctactagactgaaatgatttaagttgttgcaaaatgatagtatgctatttactcaaaattgaaaga

SEQ ID NO: 7940 - DNA, 675 bp, Oryza sativa
tcagagaaggccagaccgagataagggagacgatcgatgccgggcatgacgcatattcaggaagtcgtatgagagccttggcacatgggatggataagctgaaggaagaggctgttgatattcagagggagatcaaaactgttggtgattccatgtccaccaagatgcaggatttgcagagcactgcaaatgatattgggagtgtggctggcaaatcattggagaatcagatgcaacttttggatggacagagcaaggccatggacggtctgaataatctgtacagctttcaggcacaagctcttgaggaaagcaggtattttaacttctcgcttccattattctttttttatttcattgtaaaatatactgattttgactggaattttcagggagactgtgcaaaaacttgcacagtttggccagcgtcagcaggaagagttattgtccaggcaggaagaaatccggcaagctcatgaacacctgattcataattcacactcaatactggaagctcaggttattgtctcctcctgcatatcagaatacgagcaatagttttccttttgtttgactgattaaccatgatcaatcagtaggcataggattgacttctttttcaactgatcttttctccttgtgtcctgcaggaagagttcagagcaaagcaggcca

SEQ ID NO: 7941 - DNA, 1867 bp, Oryza sativa
tgccacttgtgatatcgaggccacgtcggctgtcgccactccgacgtggacccgaccgtgagggagataaagattttgggatgggaataatggtttttgtctcatcttctctcaaggacgaaaattcgagggagagtatacgtgtagatgcacgtgtagtgttcgtaaaggatgcgtactatggttaggtcagtgtaggagcttgacttggcatgggacattgacaaatggcctatgtatggtacagttgtttgtttctttttttttctacgtagtcagcaattcagcattgcatttcaaacagttgttttggttttttttttcgaaaaataaatatgaaggtaaaattaaccgcagagtttgtacttttctagatgacacagatttgccatgaagaagtttatgaatacatgcaatttatttacccgttgatcgtggtacgcaccaaccatacaagttctagaagattcagcagagaacaatattccactaaccatatgttatttagggataaggtgggacggattgaactcatcctattttttggataggatggtccaatatattgtttggcatgagagatattcctattttttctacatgttagcaaaagaaaaaagtgaattggattggtccaccattttttaaaagaacaagccaacccggatcttagaagaatattcactgtcagccccatcctatcccacatgtctctaaaacaacatcctaaaaaaatgggtataacccaaccctacctatcaaaacccttgaaccaaacacatactaagtacacccaatgttgctacaatgttttatactatgctgactacatcttcgccaccttaggggtcaatagtccacggtgatttttaccatactaaatcatcctatgaaaaaaaaggcaatttctacaacccatgatcatctctgtgactttaaacaggaccattctcattccatctcctcccaccacgtacagaacgtttgccgtaaccaccggattcaatatcttatctttaaagagtctaagagcaatttccttattatgggggcatagcccattacaagataccaatagattcctagtactccctccatccaaaagtattatgacatattttttttgtcatcaagactatgaaaaggtagagtcgtagcaaagaacatagccacagcatgccgaataagggcaatagcagtgcaaggcacgcttgccgtgcctccggcccattccagcaaggcgcagtctcgtgaccccacgccttcctccttatcctcacgcgtcacgcccacgcgccgcttttctcctcatccccacgcgccgcttctcgtcatccccgcaccgtcgacgagctaggccccctcctctctccgccgtcgccggcctcccctcctccctccgccatcactggcctcccctcctcccttcgccatcactggcctcccctcctccctccgccatcactggcctcccctcctcccttcgccggtgagaggacagagacgacgacgacgcctggttgaggaggccgaggcggcaacgtggatctggaccggcgatggattggtctctcttctcttcccttgccagctcccctctcacctcacctctccggacgagcggcggcgaaggtagagaaagaggaggcgaaggtggagaaaaaggaggcaaaggtagagaaaaaggtcacgtcgaatcgaagcaacgacttctacagtgcgagtttccttcgccacacgcccttgttgcggtgagaacacgtgtctcccagttagggggcaagcagccgagcaaaggtgcgggtcttggcgccacgtacgcgtgaatccgagctggcgctgtaggagaactgtgaagggcctaaag

SEQ ID NO: 7942 - DNA, 38831 bp, Oryza sativa
  unsure (1)..(38831): unsure at all n locations
tgtcagagaggattttcgtggtgtcgacattctttcagtgtacaaaaatagtccaaacaaagaaacattacatctagggcattaggcttggctctgtcttgttcaaactgacccttcccgatcaccacatgctccaacctcaacttgccaaatgctttcttgatgatccggccctgcaacatcattaagatgagcaactatccaacaggtttagccgacgtctgaagataaaggatcatctaacatacctcaacagaatgtgatgttgctaaccgatagacgtgaactgggcgtgtttgaccaatccggtgacatcgatccatggcctgcaaatccatctgaggattctgcagaatgatggcaaaagtttaacaaatcacaactaaaccagctaatagaaagtaaagttacagtaggcaggagcgaagaagtcactacatgcctacattccacccattcaaacaggcagttagctaattttaagtaaagttacagtatgcaggagcgaagaagtcgctacgtgcctacattccacccattcaaacaggcaggcggcgtgcaaaaacatcttgtaatgttcttgctgtaatatgaatatttagcctgaagaaatacaataatatcaatagggaattacccagtcactatcatataggatacaggtatccgctgaagtaagattgataccaagcccgccagcccgtgtgcttagaataaagatattcatgctgctgttcaagtcattaaattctgctatctgcaagagtagtgcacaaaatggtgagaacagtattagactaaaaatggatgttaaaaggtaacatggcgaaaaatgagaatcctaattgtattttaggatagtatagtcaacgtatatgcgtctagaactttacacgccaagtagtaatcagtaatgcactggcacagcctgctttacctgcctcctcctctcttccaacttaacactcccatcaattcggcaaacctgaaggccttttgtttccaagtagtactcgataatgtccaaaacttttgtccactgtgaaaatattagaacctacacaaaataccggttgaggtctagtttttttccttaaagagttcgagctagcatttgcattaatgtaatccctgaattaaacagaataggagagaacaatataccttgtgcttccgtgcaagcagcaaacttagcaatctgttcaagagctgaaatttgccgcactgttccaagagcttctcaacaggtggatacagacctacagaaagacaataaagcaaataagtgttaggaaacgagcatgtgaatcaattgataacagatgtccaatgtggaacaacctgatgagtcatacgcagactccagaagatcaggatggttgcaatttttcctcaactgaattaacagattatttagctttgccttaatgccaggtttccgcagaactgcaatattcctcagcacttgtcagattaacttgtcaagcctacaggaatgtgtgtgtaggagactaggtgtacaagcatccataccaatttctgatttttcatgcaggtattgatcaaatgtttgttcaaccaagtgattctggatttgtttctgatggtcagtcatgttagcgtaaatgattatctctttctttcgtggaagcatatgctctacatcctccttcatccgccttagaaagaacgggcgcaatatggcatgaagctttgaaacaacatcgacttttctcttctcttcactatcctcttggtcttcttcacctcctttcgcagaaaagtcaaacctgtatggcactcgtaaggccaatgcaggcaaaacaaatcaattttaatgcatagggtacctaaaatgcattagtatattctttgtagcaaagaatgatcaaacatgttaatcgcagcaaaatccatctaaatagtcaatggtagacgcaaaagtaaaatatcatgtcagtacaccatagaaatcagtaggtgtacagcataaatttctgctaatattcaaaagacacattagcagacaccacatacaaaataatatgcatactcacaacaacacatagggcattcaactttacacttcataagtaaaggcaatgagaaaaattaaagcaatgtcttaagagtagcaacaaactaatggaataacatatatatagacagggttagttgatgggaatataattgaaattgctgttaagcagtttaagaggttcttttacattgttttgaccaaattgctagccctcaaggacccagacagatgctgacaaatgtctcgacttgagaaaaagaatatctgctctgctcaatgcatacacaaatgaacaagttgacaataaacagtcaggaaatgattcaaacgtgagactaacaattatttgccggaaaggttaagatggttataggaatgattgcatggtatgaaaatcttcagttactatcatatttgtatttcagtgctgagacgtgagactataaaagcacaaaccgcactagtgaaggtatatatggggaaagggtggtactattatcagcaaaatgaataataccatgactcaaattcttgtgtgaagagaatatatcaggcaaaatgaagttcagcagggaccacagttctgctagattattctgaagaggagttccagtcaaaaggagcttattatccattggcaggcgctttagctcccttaataataaacacttggaattctttagccgatgcccctggaaaaagccatcgaagtaaacatgtaaatacaaaactaaaacagaaaaccagaaggatgataactaattgcaaggtttctccatgtacctcatccacaataacatacttccacttatagtgagcaagatgctttgcatctgacatagccatctcataggaagttacgattaatggaaaatctgggccagtggttttgggcatgaattttctccttatctctgcccgggctgctttgtccccatgataaatcagaccagtcatagatggaacaaacctgaaagcaagcagcttcacttaagaatatcaatcaaggataatgaaagaataatatggatatgttaccttgagatctcgttcacccagtttgagagagtggataggggagcaattatcaggtatggaccatcaagacccttccccttgagatgggcaagaaaaccgatagtctgtattgttttcccaaggcccatttgatcagccaatatcccattaagcccattctgccaaagtgatattaaccacttaacaccctttatctggtaggacttcaacttcccgccagtcattagaggaacaagtctggcttgctctttttcccacctttcttcttctgtgagagtacaatcctcaggtgagcaatcttcatgagatcttgtaagcatgactgccactgctttcttggcttttttctgaacaatattttattttgtcggttagaaatgaaatggtttgcttgaaattttgatctatgtataaaacaagttgccacattcatacagaacactgagcaagctattcacttaaataatataattgatcctacgaaaggatctgaaattctgaataagtgtgcatggttctagagaaatttgaaacaagcccaaaaatataaggcacaagcaaaagttaatggtttttaaacttttttccttcatacggtgtccctctatcttcagcattcatgaataaacaacctctaattagcaagatagtaataacatatataaggtgattttcctctgacactcactagtattgagcattttactctggtattttcttgcttctctaacctcctggttcactatctaacagtcaaaagagcctatttgattgatatactaatcgctaacatttgccacaaatttgtgccccacattcaaacccctaaaaatatcagggtaccagaagaaggcggttgcaaatgtgttatggcgagtctttaaacaccccttctaattatgattttctaacaatgtactacaggtggaaagctatttagtaaatattgaaaaactggcaacattagtactatttgaaatccagatgagcaaggtcaacataagcatatcccattaatttagaatataggaaaccaaattactccatgtatgaagctagaactcacatcattgtactttggtgcagaagtagctttcctctttctgccacgcccattcttcttctcttctactggctcctcttcagcatgagtttggacgccctccaccttagccaacagcacaaccatcaacagaaaaatcaaataaagcataggaagaagcaaaaagagtcatgtggcgcgtggagaaacaatacatacatcagcgatcgtttccatcttctcaagtagaaattctgaatagagttgtgtctgtgatagtagctcgtccaacttgttaaaacgtgcatttggatcaaaagcaagtcttgcagcctcttccctcttccgtgctacctcttcttcttcagccttaacccgggcgtcgtgcaacttctcttcctcctccttcatcgcatcagtgatgagggatgcatcaccattcttggcctcaaggtcaatcggtagagatggaactgcatccacaaaatcatcagctttttcctccttgacaggctccaataactgaccttcttccttcaccggcacagtgagaggtgacaaatcactgttgttagccgcaggttccacattcagggaagaacttgcatccacaaaaccatcaactttctcctcaataagcacatcgagatgatcctcctcttgcttaatcgcctcggtggtatccaagacatccccattcttacattcagaaatcttctaacaacaacaactcaacgtcaaccaaaaaaaacccgaaatgcggaagcataaaacagaaatagagatatctgaaaaaaaaaaaggcattcacaaataaatcacctcatcatcctccagaacggatgtcggggaatccacggtggcagcggcggccgcggccggggatgcttccaccttcatcccagggacggatctaacttccgacattgtgggggtcagatgaaccttcttaaaccgcccctccaaactttttggagaacaaacaaaaacaagccgttagtactcgtattaatgttaaggcaaatcaataggaaacgctagagaagctagggtttaacgcacgtgaactcgacactccaagaaaagaaaagatcgagaaaaaaagtgggcgagagaaaaagagaggatgcggaatgctcaccagccaggattgtggcgggaagcagcaggacgacggcgcccctgccgcgctccctgctcgcgaggagatggagatcggcggccggcgcggcggaggcggaggaggggggagacgagatgggaggtttttcttttgaacgcatataggggacgggaatgaaggggaaaagccgtgttgcgctcccactttgggacctgcactgggtggtgggacccactccttcgggagatggcgtgcaacggttcaaaaattgaagtgtgtgggcccaggccacactatctgggaggtgagtggctacagtcctgtgtacttgaggctgtttacccccccccccatttaattcaaaggaaattttatccctcctcaaattcctatgtttttcctgcggctcaatcaaacggtcattcctatgtttttttctatgttttgcaatcctctattttacacttgtattcctaccagaattctatgtttttcctattcctccgttttttcgttcctgtgattcaaaggggcccttagttcgggggaaaaaatgtgatgtaacatcgtatatttgaaaaaactaattcataactcgtctggaaaccacgagacgaatcttttgagcctaattaatctaccattagcacttgtgggtatcgtagcacttacgactaatcatggactaattagactcaagagatcgtcttgcgattccccccataactgtgcaattagttttttaatctatattttaatgctccatgcatgtgtccaaagattcgatgtgatgtttttagaaaattttgggaagtaaaccaggccttaatttgaatatctatgtccttgggtcaaaattttaatttggataagaccgtgttcgggagataggcgcacataaaatagagcgacatatttttttcaattaagtatttggtacttttataaatttaattaatacttttgtatagaaactatttctttgcgaaaaagtatcgtttaacagttttaaaatgtgcgtgcggaacacaatgaaggtgagttgggaatggtggggaaaaacacagcatgttgtccgttgattctttttggatagagagagtactcttttttttctataataaggctgtgtttacatcttagaggtaaaaaattttgccgtatcacatcggatatactgacacacatttgaagtattaaacgtagtctaataaccaaacaaattacagaatccacctgtaaactgcgagacgaatttattaaacttaattaattcgttgttagcaaatatttaatatagcaccacattgtcaaatcatggagcaattaggctcaaaagattcgtctcgcaaattagtcgcaatttgtgaaattagttattttttagcctgtatttaatattttatgcaggtgttcaaacgttcgatgtgacaaggtataaaatttttgtgttggaactaaacaccccctaatacactttttttgacaggagaataatactcctcccaatatttaggtgcacaaaattatagacgtatgcgtgcattcaaaattttgctcttaatactgtacaaattttctcacaaaagaaaaaaaaagaagctaccaatacatttaaaatgttaatatgtggtacatatataatttcatacaaaaatatgctcacataataattagacaacacataaatgttcaaaatgtgatacaactgatacattgctctcttacaatacatgaactacagaattatacattggaagttctctttatggcatgtttagttccaaaaagtttttcccaaaaacatcacatcgaatctttgaagatatgtatggatcactaaatgtagattaaaaaaactaattgcagatgaatcttttgagtctaattattccataatttgccataagtgctaaagtaacccacatgtgctaatgacttattaattaggctcaaaagattcgtttcgcggtttacagacgagttatgaaattagttttttcattcgtgtccgaaaaccccttccgatatccggtcaaacgttcgatgtgacacccaaaaaatttcatttcaccaactaagcaggcgtatagtatgttttcgtccgtcgcgcaagtgtccgcttcgctcacgttccaacctacccctgcgtgcccttcgctcatctctcccaaagaaacgaactgaatcagacacacaacatacagtaacaaggcaataaagatgtaaccaaagaaatgaaccgaatcagacacacaacattcagtaacaaggcaataaagatggaaccatgaacatatgaacaaagctaaccaaaaatccctccccaaacccaatcttatgaacaaattagggctaacacacatgttctgtttatggtaagacaaattgaatccaagaaaacgaagagattttgagttggagaaaagacaaaatcaaatacagatgaaggtgtcataaatgtaaactgatccagccaaggtggaaatcaccttgtcatctttaaagattgggcatcattacgtccaatctagacttatctgtgtagctggcactcgtcaaataaggcctctcatgcgaataaacacattgggtgagccagcgccccacgtggtcccacaccctctgatccacacactcgtcaaacaaggcctctccgatgcgcaattgactggtgggtgacaatgaccaagtgagggagggaaccaccttcaccgccgtcatgcaccaacttctcttaccctccccttctttctatgttgcgagagagaaggcaagatgagacgaggttgggttggggatcggagtcaccgctcaagatagtgcaagtgggaatagaaggggtagggctgcgatattcttcatgtagtgccgatgaaaaacaatggatagcactataatctagaatctagtgggaattagaggtgccttttccccgctttgcactctagcacaatttttcagaactattctgttccgcttcagtttttattgaatctatactatgtttaattgaactccagcactatataagttaaatttattagaagcttgcgttatactccctccattacttaatacaaggcgtaactgttcacaacacagagaccaagaaatagtataaataccaattgcagtgattaatttttgtctcatttacgcttcattcactttgcctgcaaccaatcgccaacactgcttgttgacccgatatcttctgcatgcataggaataggagaggagatgatagttttcaatgcttgcatgcacatcaaacgggagcaaaagtaaataccgccctatattctgaaacgttaataaaatatagctacgccttctatttaggaatagagggattaccaaacatatccatattttataaaatactctgaactacgtagtcacgagctcataaagagggtggtcgcgtttcttcttccatttttaattagaacaagaaaaatacagaaaggagaaaaacaaaaagaaanagnnnnnnnnngggggggggggagatgcgctaatccacggacgagctgtgacgagcttgaccgcgagtccgcgacgcgtgggctcgggggtgagacatggcttccccggcgccgccgcccaccgcccggctccggccttctcaggccgccagcagtgcctcctcctcctccttccctacatccatctgcggccttggctcgctcggcgacgcctctagggtttcctccgtctccttccggcggcgtccaccagcatcgcctctcgtccggtgctcccaagaccctggcaaggtagagcggcttcttttcgtttcgtttactcggtttttaatcgaacggtgctgcgcgggttcgctttggatttggctagattgggaagaatgctctcgctagctgtattatcgaattttctgtgtgaactacaggaaagcgaaatgtgggtcgttcgtcacacatagggtcatgccagttgccaaaattgatgctgggcgttcgttttaggctcatgttgttagtgtaaatgtggcacaccgatagagatgcggaaaagggttattctgtagaaatgggagtatgggttggtcctgttggacagggttagtatctaattttctttatatcaggaatgattctggcagtatatcaatgtaggcatcattcagttattctgcttttgaaagaggaaccacctgtcagaaaaaaaaggaactggtgcataacaagggaaaaaaaagtagccgccaagaaaatttgcaagcaaagttaggtttagacgtaaaaccacagtaatggtctctggttgactttactaaaaaagatgagtggtcttgttgtaagaacgttaactgagaattttctatataatgcttgaagcaagcacacacgtgttggctgcttactgatatctgaagatgatcattctggcatttgtgtggtgaagctaaaagaggatttatgttgcggtgagattagaggaaatgttgattgctgaaattagttgcagttttgttatgtgcagagaacagcttgtttataccttcggaatatggaagtgcattttcattttacaaacttatctagccaatgtaacactggtgcaatgggcttattattattctttttttgcaaatctaaatacataattatttaaggaaaaaaactattgggcatgaactcttagtgtaaaaaagaaacactggttaaaaaacaacttttgaggttgagtaaatgtgattgaaataaaaattaacttggctgcatttccttgttagattgaagtgtttaatactgaaggaaccgagcagtcacaaggaggctccactggtatgatgtttgcgctgtgcacttattgggtgtgtttggctggccaactacaacggctgtgcagcgctgctgctgcagcggctacagtagaaattgtatattgctactgtagctgctggctgccaagtcacaccgaataggcccaattttattcttcaacttgcatgtgttcttttagagctgaactatttttttctgtcgtacaggttcgataaatcatggcaaatactcaacaaggagtttctcctctaaagagtattcacagctaactgtaaatccaatgactaataatgataccactgttgttcgctatctaaatttctatggcatagcatttaggcacatttgtttcatgaaatgcaatgtctcattagaaattttggctggagcttgcactttgcaccaaattgtattgcatgagtgaatacctcactgaagtcgatgatcttgggtctatcttgcttcttgtgattataagcaacaatctgctgttaatgtttaattgaaataactgttggcagaaggaaacaccttacagagcttatgagcaaaacttgtattggcactgggttaatgatttcagatgcaaactggatatagaagcattttgcatgcacacttcttgttgagaatgaaactaatatatttgaaattcaggctttcagatattttcgtgaattatgataactgtgcttggaatggcatattcattttacagtgctaatattacaacttataaccattatctacactgcttctgtgtcagcttgcttgaaagactaaagaggtatggtgctgctggtgttttgtcatatggactactaaataccgtctattatgtcacgacatttttattagtttggtaagtaagtcagtgattggtactgtgatggatcattaatttttatcttggtgttacacatctggaacgttcacctgtgtaagaatgttggtcaagtgtaaagtggttgatatgttggtcatgagaaagagggttcagttggtagctcagcatttccacagggtcaaacgactgcacatttattcgggccatcagatggaaaagagaataactgaatgacttactttttcaggtttattttttctcctgctcctggtaagatgggttatgctgcggcagtagagaggtaatagctgcaaccaacccccatcccgcgcacgcatgcacgcaagcacgtgcacacagggttttctgatcttaattagttttgtgttactaaaagcagattcctcaagttgatggcaatggtatgggctggcagtcaagttactaaaatttttcgagcaggagggtgagtttactttcataggactggtttctaaaactcagcaaatttagtgatcatttataggattttttttctggatcagccgagtatttttttcatacttttcaatattaccttgaattacattctcagatgtcagatgtaccttttgaaattttatagaacatgtattgctgtcaaaactgactagtttctgttctgagagatgacttgtttggtgtacaatagggcacttgcattggctccttttgttgatagagggctaagatggttcacagtcaggttcaacttcaaatcagaaggaaaggtaaaatactcatctcttgctttgttatcccaatggggagcagttaaaccgggaacgagaggggaaactacatgctagatttaagatttaaatatcagtcttctaatgtctgttgcttcatatttatcaccatgcaggcatttgctacaattgttgggttctgttttgcacttgctgctctactgttctttggattaacaatactttgggcgtaatacacctgtcgctgctgaagaatcacatagaagaccaagaacactggtgaaataaaaagattgggttcctcctcacattgcggaagtgaacctttatgcaatcagtaatgtggcttccactttactattaattggcttagctcttcaaaactatggttctctcggtaccatgtgtttgtttttgaaaacaggtttccatgtattcttgtatgagtagctattctcaattctcatttacataattcacctgcaagtctgcaacctggtgcttcattcgttaatcgttcataatctggaacatcttcagtgtacaactgtacatattcctgtaacatgatccttggggagttgtgtgtgttttcatgttccttggtgcgtgcagacattgtaaaacaaagaaagtttgttctggaatcttgacaaagaaaaccttttgaatcaatacacattgatgcttctggcgagcctctcttgactactgtaatttgtaagatcaataggctgttccacagccagcacgtttgtttcctctgaagaacttccttcacttcactgctcaatgcacagtcgtttctccgttaaaatcagctgcattgcctgcatttgctgctgtcacatggatgcaactatcaacaagctgatgatttccatggcttcttggagagggtgggttggaagctaaggtagtaacctccccattcccatagccatgaatccctctccatactcttgtcagcaatcttgcaagaatgggtgcctgcactgtagcttgatgccaatccctatctctgctgatgtttctgcccatccgatgatctgcagctatattggtgcagtgcatccaacctaacaatgttgtcactctgacctttcgtcagttggccaccctcgatttttctcaatttcgttagcatattttttaaactgataaacgatgtgacttttaaaacgggctcttaaaatcttatgacaatacatctgtattttttttcttcacgaatctgtacaggctgccacatgggctccgagccaggaggagcggagagccgtatccatccccgatcgccggcacattatcggtttcttttctcagagtgagtgcagcggcggcacattctccgtgattaaaaactctcgttgagcaataattatttcttgtctcctacacatcgtgagcttctactccatatcaacccaagaccaaatggattattctttgtaaaaaccccatatccatgtgaaccgcactacgacaaaaactaaagaaatttccactttgcgtgtcgactacaagtacacagctccaaagtaaacgctcatgcgtcgagttcaggtttcattcgttccatctgccagataacatgaggcggtaagctcgtgagaaggttcacgtttctaataagaacaggtcgaaaaccgtgaaatttcaagctttttcacgtgggacagaaacagatttcgaggcggagaaattcaaattccaaacaataaatttcagcaaattttgtttaaaatttatcgaaacccatcgtatcactaggagtcgagattcggcagtctataggcatttaacgaaaccatccctgtgatgactccctccgtttaaggcatttgatttcgtcctagataaattagacttctcaaaatttaaccattttttttaaaaaggggatattgacaattatgataccaaataaatacactgcaaactcataattcacagtggatttcaataaattaaatttgttgctttaaatgttggcgcactattatataaatttgatgaaaattcaaaaattttgatttagaacaaaactgattgtcttatattacaatactatatggaaccgagtaacactagtctacaactcccttcactattaaatacttacatccgttttttaatatatgacgtcattgactttttacataatatttgaccattcatcttattttgaaaaatttaagtaagtattttttttttcttttatagcggcttgatttgtcactaatggaacttcaagcaatacttatattttgggatttccataaaatttttaaacaagacaaatgatcaaagattttaacaaaagtcaataatgtcatagagatggcatataagtatttgtgggttgcttagacgggcccatttgagttcacgtgagatgaaatttaagtacgggcgcacaaaacaataaaactattagctcatgattaattaagttttaattatttcaaacttgaaaaatagatctatctgatatttcgtacgaaatgtaccatttagcatattgaaaaacatgctaacaaaaatctaggtaaaatttgtatcttaataaaaaactaaagggctagtaaatattgagattttaaaaggttaccttccaatccttccattggttgactaagaatgctttaattattgtatattagaatccttgtcaaaattgctatgtactcatggagcgttgttcgttatggtgagggctaaagaggatgaagaataatttcatactataatatatgtgtaataaatcctttatattttctcacacttgattaataagtactatattcggttatgttttgagtaatgatacaatcttcaaaatatatctttcactatattttttctattacaatatatatatatataataaatatatttatttttcctatagtactttgtaagataaatctactaaataatttaatcttatttttatccaaaactccaaaaatcatgaaacggggagtagagaacaaaatgaaaccgcgtccaaattgcaaaggcgtaaatcacccccgccgtgtctgaccgtttcgcttcggtgcggctcccactacgcgcctcctcctccttgtcctcacctctctcactctcctcccttcacttcccaaccaaagcgagctccattaatgacgcctcccctaatctagccgccgtactcgcctccttcccttccgagaccacgcgcgaactgccccatgacactccctcctcctcctcctcctacttaactaggaaatcttcgcgcgccagctgatcgtataccacgtacgtacacatgggctaccaccagcccgtacacggcggcgccgcggccggtgccggcgggagtggcggcggtggcggcggcgaccacctgcatcagcatcaccacccgcggttgcacagcccgcggatatccgggggcgggtcgatgacccggcgtgccaactcgttcaagcgcggggagatcgagctccagatcggctcgccgcgctcgccccgcggcgacggcgtcgggagccccctcgccgagtcgtcgtcggcgtccgaggcgtccgcgggcggcggcggcgcggtccaccaccaccaccaccagagccagcagcagcagctccggttccgcctcttcaagcggccggggtccggcgccggggaggtcgtgctcgggctggggatccgggagaggaggcggattgggaacctgctgttcctcgcgttctgcggcgtgtgcctgctcctcggcgtcgccaagatctgggcgggcggctggttcgccctccccggcgacgacaaggacgctgatttgcaggtatggaagctataaattcctttccagttttagactttctagctgctattttggcaagctttcttcttcggagtcaacaacacgtgtagtttgaggaaagttgcatgatcctctgaaatgttctgtccgtacatttcttaacgaacaaactatatatcctgctgttacttaattcgaaggtctttgaagactatgaaatcatgctagcttgctaatgttcaactgtaatttccgcacgaacttctgatccttggtgttccaatttgtaagcatgcagtttggccatcctatttgttccataccgtaactctgcaatttcatgttctggagtctggacaaagcaacaagagttgaaaacagaaatgtttgaaatcttgacaggtttttagacagttgaatgtgatacttggggaaaaaaaattgtggtggaagagatgttagaatggagttactgcattttagatttgcatggaccttattgaatagggatattttacaggagatttagcattttaatttttaggacagtgtcttacttgcttggtatgtctataccaactaatttactacgaaaacgcttctttggtgcttttggccattggcagttggatgcagttaagttttggatcttacgaaatatattttgtttgtacgttcaatagtttattgtagtagtcaggcagtcaacttgagtttattgtataaaaaatttagataactcgagaggttccatactccatttgttaccaaggttaattataagggacatcatgtgggatggagatgggattcagagcgctgcaaccttgagctagcttaccagccaaccgtttgtcattgtttgatcttcccaagtaggatgtgttgatctctttatctcaagtcagtaatttcacttctagtttttaccatggtgccctctctatctctactaataactcaatgtctgaatcatagcattgcatcgacataatttagttaatccttttagtaacattttttctattacaagcttattttgctgttctaacatttcacgaagtttgtatctacttaccttgttgacccaaattgttgatcttacagtgtaatttggttttgtgctgtccatgtttctaggatctctcaatctcattctccagtgatggagggtatcaatttgatagccactttggacatgttggagggaaagagagtgacaggatgttgatgacagtgggatcagaagacagtgttcctgaggctagtaatacatctctgcctcgacctttttggttcacacattaattagtggaacataacatttattttggctggtgcttcatgtaggcccccgatgtctggtcccagccaagcagcggaaagttcagacaatgcattatttcgaattctcataaaagtaagttggtctgtattaataccttttggtctcttcaatactcctttattaacaaggtatggtcttctgttcttaatttgtagaggaagattctcacacaaatggatacattctcattaacgcaaatggaggtttgaatcaaatgcggtttggggtgtgactcctgtcctactttttgactttaggttaccattagtgtgctatggtctgatacatttttcatgttgcagatatgcgatatggttgctgttgctaagatcctgaaggctacattggttctaccttcacttgatcatacatctttctgggcagatgacaggttgtgctttaacatagtttcttcatccataatctcctaaaaactaaaggatctcctctctttctcaaaaaaaaaaagatagaaagaaagaatagaaaactaaacttttcaatcaatgtgtggccataatgcctattctgatttcctcatttctgtagtgaatttaaggaccttttcaattggagacacttcattgagtcactcaaagaagacattgatattgttgaaatgctgcccccagcatacaagcatattgagcctgtggctaaagctccaatatcttggtcaaaggttgaaactaggtttttatctataatttacattaatatatgatggatagtcggaaacactaactagtgttttatcttgtgcaggtgaattattatagagatgaaattctccctcttttgaaaaaacacaaagtcatttactttacgcatacagattctcgccttgccaacaatggtcttcctagttatattcagaaattaagatgccgagttaactataggtctttgaagtattcccaaacaattgaagatcttggtgctaccttggtttcacggatgcatcaggatggaagcccatatcttgctctccatctaaggcaagttcggtgctcctaacattgttgtaggatgcttctctctgcactcattactttcgttcttctgtgcataataatctaagttaagtaaaggcaaccctgattttcttaattttgaaggttttccacaagctgcagcttctattattttgaacccgagcaagaactgtttatctctaaactattgagcatatgtgagctagatatggctaactttgtggattgatagattatgcatgttgtttataatgtagatgcttgtgtagatgaaactatcaccgtgccctttgaaataaggctcactgaagcaggggtgtaattttggtgaaaatttgcaggtttgagaaagatatgctagcttttactggttgcagccatagcctgacatcagaagaagaagaagaattgcgtaaaatgcgttatgaggttagtcattggaaagagaaagaaataaatggaactgagagaagaagtatgggtggttgtcctttgactcccagggaaacttcgtttttactcaaaggattgggtttcacacgaagcaccagaatctacttggttgcaggtgaagcttttggcaatggaagcatgcaggcgctgatggatgattttcccaatatatattctcattctacccttgcaacaaaagaggaacttgagccctttagaaatcaccaaaatatgcttgctggtcttgactacattgtagctctccagagtgatgtctttctttacacgtatgatggtaatatggccaaagctgtacaaggtcataggcgtttcgagaacttcaggaagacgatcaacccggataggttacatcctttcctccttggaaatgctctgtggttatatttgttgcacacaagacgacgttgaatgccaaatagctgtctttgacatgtgtttccttttttttgtaatgtcttattctttgtattgcaggatgagtttcgtgaacctgatagatgaatatgatgaaggaaggatgtcttgggatgacttcagctcagaagtgaaacgtatacatagagatggagagcgaataggggctccatatctcagggagcctggggaattccccaagctagaagagtctttctttgcaaatccgttgccgggctgtatatgtgagaagcttaatgacgagtgaatatgtatatatttgacgattctttaaccatctacgccacaggtcaggagttcaggatatatagtgcccctctgctccttgacagtgggtcagcagcaatatgcacaattatttagtcatgatcacttgaccagtgaattcgtgctgatgagagttcagagacgagacaccaattttcaggttcatcccacaaaagtttgctgcatgaagatcatcagatattgcaaatacgaaaaccatgtgagaagtctggcagctgctaatcaattttccagcagccagagcatgccatctgagaaggctggaacatcagagcaactgcaatcagtatacggaaggtaaataccgcggaggagattacacttacggctttgtattgccaatttgccatatcataggttttttggtgcacatggtgcttcccaatcttgctgttgctaagctgtattttgtgtagactcaatacaactgaattttgtcacttgtattttatctggatatattgaattaaacgaaagagattttgtctgaggctcagagtcagtctggagcccctgctgttcctgtcccagcattttttcctttaaaggcataacttattccattgatttactgcactgttttgcgtgacatcttttgtttttatgagtagcgccatgcgtctctttgctttgacactaaatcatctgcctatccaatggcattctctgcatttttcaatccacagattgtttctaataaaaatggggaaacaatgcacataatctgagaacttccacactgctgccaaagtacctttttataatgagtcccactccggtgctttctactaggagtagaaaataatttgaaccgttaattgtatatgattgaacggctcagatatatttctactcccaccacatttaatggtagtagaattgtggagggatatttttgtcccagaaaaattatttgtggagaggtatttgtccttttcactttctaaacctagctacactcactcgtctctcgttctgatccggcacgcatttgcaattgggtaagcaaaagctccgccgtctctggcccaagtccggcgacgactacctcctcggctcctcttctggtattctcacgtacacccgtcgccgccatgcacacaccctctctcgagctgctcgtctactactacgtgtacacgtataagtgtactgatgcacgtataatatacgcggtgacatgatggaggagttccacaaggagatgcggcggctagccgacgagctgctggagttgttcctcagggtgggcgctaggtctcaccggcgttgaggcggagaggaggatcgccaagacgatgacggcgacgatgcactggtaccagaggtgcccggacctgcggcaagctctgggactcatcgcacacaccgactccggcttatgctccagagcattgtgtcagggctgtagctattccggcgaggactagaccggtgggtggcggtgccggcgatcgttccgggcaacttcgtcctcaacgtcggcgacctctcttccacatgcatactcaccaacggccgcttccacagcgtataccaccgcgccgtcgtcaaccgcgaccgtgacaggatatcgctcggatacttcctcggcccgcccgccggacgtcaaggtggcgccgttgacggacgccgtgtcgcccggccggagcgccgcctaccgcgccgtcacgtggccggggtacaaggccgtccgcaagaaggccttcaccaccggcggctccgccctcaagatgatctccaccgccgccgccaccgacgatcgaacacaacgacgtaaccgacgttgtcgtgatgtcaaatttacccctaatctgtcttagtactttactattgtacccttaagaataaacggttcagattagttctacttgtagtataatactttcagtataaagcaccggagcgttgcccttttataatataagtagtagaatttcgcactacactgtatcttcgaatgacctaaaattactataagcatgcaggtttctgagatatttgtaacagaagaaacaatatatatcccttcgaggcgacatttcctgctaacccaaaagactgcttcagacaaacgatggcactgtctggttcaagtgatccgactttatatttcttcagcatttcataaaatgtgccggctaacctaataaccgtctgctttgcctgcataataaggaaaatagtcaatatactgtttatgcagctcgccacaacagatataaaaccagaggtaacaaatatgtgaccaaaagcacatttctgcaaactgaacaacattcagcagaagttagtcactacttaaaaattgtagcagaagcatgcatagtccgaaggagcgaggaaaatatcatatgatcctgttgaagtgtgttaacattggattccaacaactactttctgattctagtgaagaataatctaagatttcctatgtcgagtcacatgaaaaattgacttggacctcagtgcctattactttcattgtcaaactacaagaggaatcaagttgtatacaccaatttgacattatggctatgtttagatccagggtgtaaagttttagtgtgtcacatcaaatatacggacacacatttaaagtatccgtctaataagcctaattaatccgtctaataagtctaataacaaaacaaattacagaattcgtctgtaaaccgcaagacgaatttattaagcctaattaatccgtcattagcaaatgtttactgtagcaccacattgtcaaatcatggcacaattaggtttaaaaagatttgtctcgcaatttacacgcaatttgtgtaactacttatttttttcgtctatatttaatactccatgtatatgtccaaatgttcgatgtgataggatgtaaaattttgccaggggatctaaacaggcctatacttatgaaaatagttctcttttaaatacccatgttcaggctctgtattctcaccatgccaccatgctcatcacaattatcaggctctgggtaatcccacgaaaactaaccgatcaacacacacagagaagtttgacattatattcaatcaaatggggacactcgtgccgattcgttaaaaaaaagtagtttgaggttttggacaattattaagttctgcctcactatgctgcatagatatctgaaactacattatggaaagtaaaaattcaaatttcaattgaccattttgtaaaaaggaagtagtttgcaatgcaggctatcactgtctgactatgtagtatgagtatgaaacgctggataccagggagggacctggtatcgattatattaagagggcagcataactctcagtctggagccatactattgtgcaaactcaaaagtaaaatataacacaaaatgcaacagcaacttttaaaaccccacaaaaggatgtaatagaatatcatttcaaatcaaatgtataagatggaaatttcctaaataatattaactacatttacctttaaacaggatctgagcttggggtgaagctcttttgtattttagtaactcactgagcgcatcctcattagacattaggcatttatcaccatgagtaacagatattgtgcgaagaagacttgctttagagagaatcagctctataaaagacatttcatttggaagccaactaattctcgttatctgtacaatttgaaggttggcgcacatgccaccagtccactctgcattttggaacaccccatttgcctcaactttctgctcgttatcagtgatcttcacaaacagaaataaaaaattgtaaggagagagagataaccttcaaacagtgcacatatattcaacttgcgaggcaacattcaaccttaccattattttgagtttttcgagattcggagcattccttagtaagcaaaaaatcgttaaaatcgcgggcagttcacagaagtccatgtataacttcaagctcttcaagctcttcaagctgtcaaaggtgcatggaagtgtctctagtatcttagctccatttgactgaaagatatgaagaaaacaggtactccatcagaacttaaaagttgaaactggatggatagaaataatcaaaggacatattatgttttttttcccttctgtccaaacaagaccaaaaacacatatccctttattgaaggaaatgttccacattgttaatttgtcaaggagaacacaggcccacagcccacatatccaactaggggataaaccttttttctagagcgaaagtaaggagtctaatgtagcaaatcagaaaggtaaaaggccatcggactaccaagttggaagacaaatgagttactgaaagcatacggatgccaatatatattcaccataagaatatgtgcacaatcacataatcccttgtatgacagtaatatctacaattctttgtatgacagtaatatctacaattctttgtatgacagtaatatttacagattaggagacagcacagaaagtttgctacgtttatgtcacccagcaaacatgatcctaatatcctatccacaagaggttatgcaaccaacaacagtcatgatcatataattgttgtcgataaatcatataatttcacatattcaactctgcagtttaatcagcgagcaagtattttgattcaacctaaacatcaaccattttaaagtaaaatgatcacctattttttttagaggaaactaattatcaactggcaagagaaaaacaagaaacatttggaggcatcagaatgtaccggttgataggacacaaagaggtgaagcttcctaacatgaagaagcttgccgagaaactcggcgaaatcacggccaccaagataatcccacaaatcgatgacggcagaacgcaggcgtggcaaatccaaaaggttccatccataatcgttcggcgaacaaatcgttagatgctggagattgggcgctcgaatcacccaatttatgatatcgtctccatcgatgaagattccagataacactagcatctcaagcaatggggaattctcgatgatctcctccagttggtactccccgcccgctcgcagccacacgtggtcgagggttaggctcctcaggttggggaatccggcgaaacccggcgggagcggcgggatgtcgcaggcgaagaggttgaggtaggcgaggcggtcgcaggagaagacggaggagtggacggcgaggtggttgtggatcggcgacgcgaggtcgagggactcgacgccgcggcgcgcgaggacgaggatccagtcatgggcgcggcgggtggtgagcttgtcgacgtatgcgctgaagctccggacgcggccggggcaggcagcggaggaggacgccgtcgacggcggccagcgccgcgccctcctggtgcgggaaggggaaagagatgtcgagggacgggagggactcccaccgccggcgccaggcgcgggagagcgcggaggtgcggacggcgtcgcggaggccgagccgggtcaggacgccgtcgaggacgtccggcggcagggagatcagcgcgtccttcgcctcctcctcctcctcccccccgggaacagcagcctccgccgtccgacacttcttgtgacggtgcggcggcggcggcggctccattcctccggcggtttcgaggcagtgcactctttccgccgacgcggtggaacaaaatggcgcgcagctgggtggggaaggaaaaaaaagcgcgggaaaagagcactcgcgtcgcgccggcgagatcatgtgaacaagcgcaactacgggccacaccacaagcacataagttttccggcccaaaatatcccgctttccaaaatctccatgtcaaatattctagttgaaatttatcagaatttctagtttttagtttgattttcgtgtttcctactaattaaagtgggatattgattattgaaggggtttctgttcaattttctcttgacagctgaggcatcaatatccatgtccagaacgtattcggcaattgattattcgcgcatcaatatccatgtccagaacgtattcggcaattgattattcgcaataggacactgtttaattaggtcccttttaaaattattaaatcactagaaaaaataccagtgtgttacaacgggtatatgctatttaaattttattgttgttatatggtttagctaggataaaatttactgtgtgaattcgcttagatatttttttcgaaaatcataagctgcaagagtccgtatttcatctcaagttagcatgcgggtttttttaatgatatttcttatatgtctccttttatatttccaaaaacaaatgagcttaaaatacaatttaaaaacggatctgtatttctaaaagcgaacgaacttaaaaacctacttaaacatggataacctaccaaaatactagtagaaacatctttaattatctttaatttttataatagtagatatagagaaatctcgcgatcgcggtaacataattgtcgaggctgtgaggaccaaagggaggagccgaggaggggttttgtcgagctttgcttgaaggccgccaatggcgagcagaaggggcatccccgagctcccatgggagcttcaagacgccatactcgcgcggctgccgctccgcgacgccgcccgctccagcgtcctttccagcagctggggccggtcctggcgccacctcggcgagctcgacttcgtctcgtcgccgccgccggcggcggcgtcgttgccggtggcggcggcgacggcggtggcgtgcgacaaggcggcgatcgacgccatcctgctgcaccagcacccgggccccgtgcagcgcgtccgcctgagggtcaccgacgagctcctccccggcgtgcccgcctggatggcgtccctctccgagaaggggatccagtcgctggacctcaccgtgcgcgccatgtaccggccgccgccgcaccccatgcaccgctccatcttcgcctgccgcgcgctcaggcgcctctccctcggccgcttcgccctgccggccgcgccggagcacttcgccgggttcccggccctcgcgacgctctccctcaccggcaccgcgttccgcaatgcccgcgacctggaggcgctcgtcgctatgtccccgaggctggaggagctcaggatgtgctgcatcgccgtggacgtggactgccgtgaacatggcggcgacgggcgccgcaaggtgaggatggtgtcgtccagcctccggttccttcggatcgacgggatggggaacgtcgagttcgtgggcgcgcgcttgccgcgcgtgtcgcaggcagacttcgcgcaggcctcctatccaagcgccccaaaccttctgtccgccatggttacctcgcttgagacgctcgactattactattatgccttgccgttatcgccggtatgtatgtacttttgttcgaacactatctaaatcatcgttaaaagaatctcagaaaaaaaattgatagcattcataccatttaaataataaaacacattgaggaattaaacaaaagacaaactcagacgtgaatagaatttgtctttttcgtttatcaatgtgcagatcgaatttggacatgatttttttggagttatagatcttgctatactctatattaacaattttttaaatacttttttttacaaccatttgcattgattttgagagaaaaaattacacgaggaacacatctcctcgagggatcagaaatcctccccattttgtttcacttcaaatttcgcccgtatctacttcctccatttgaaaacagaagggtattcctttgtttcttacatttacaaattttgactaacaattaaactaaaaatatagtatatgtttactgtcatgcatataattatcatatttgacaatattttcgtactatatcaattttatacttacaaatataatattttcattagtttacatttcagtgccttgtcggttgcccatattatggcttattaggaaataaatgttaatttataggtaaaaattttatatatttgttcgtagcgacttattagccaatgctaacaagaaattatgttgaaaatattttaaaatcaaatttcagcttattaggctaaccgatggggctctaagaacttatggatatagtatactttgttgacattactcaatgtcatgtttcagactaaattattgaagggactaccatcttcctacaaaaatttgaagagattgaaagttcatctagacttcaaccatgctccaccgattctgtctacgcttaacttcctaaggaccgctccaaacctgactcaacttgtgattcaggtaatttccatattcctcttctttaatgtagttttggaaacttcctacttaatttatatataattcctccgattacataattcttaatgttttgaacaacaccatggtcttaaaagatatacatatctattatgaatgtataaaaagttaatatctagtttatttaaaatactttttagaacttgtatatacattgtgttctagtggttcaaacttgatattttagaagttattaatttaatcttatccgtgacgttaaaaatttgaaattatgaaaccggagagaaaatcatgtatatttttgtattcatgctttcgattattgtcagggatatgtcctgcctttttctgaataacatttttcatctttgtaggactttactgatgactcatatgcacaatctccataccctttggcagcggagctatatggaaatttatgccccagccttctttttctccaaatgtcttatgtcacttcgcagaacaacgaaatggatttcattcgtctgatcttatcgaaagcgagaatgcttcaggtaatggaggttaaaatgcgaagaaacagcagaggcatagaaatcaaggaagaaatatgtggatatgataaagtatctccgcgcgctcagatccgttttaaaaattagtaaccattcaccactctgcagatatggagtatcatgtccatgtaatttttaggatcctcgttgagtagttgtcatcaatagcatctctaatagtcctccgccgtccggcgcttcttgtgacggtgcggcggcggcgccattcctccggtccggtgagagggagagagcgcgcgccgcagagagcgcctcgagggtttggagggagctctgtacaggcggtttcgcggtagtgcactctttccgccgatgttgtggaagcgtgcagcttgggtgataactggttggggagggtgcagtcactacatatgctattatgttgggaaatttggtgcaagagaaacaggcgggtttttaaagatatagagctccaaatcccgcagttagtgacaaaaattctagacaaaattcatgtatggtcagcgtgtggtgcaaaaaaacttgcgagaatagcgtcttagtttcctccatggaggtgtaatttttttcttttgtgttgtttcttctcctgtcaccgttggtgacctctgtaaagtgcttttcttctaaatataaaaccagctcggctggcttaggtttcaaaaaataactggtagggggaaggaaaaaagcgcgggaaagtgcactcgcgtggcgtcacgcgggcacaatcatctctctcttctcttctcgatgagggttaacaagcgaaagtacgggccacaaacgcataagttttctggcccaaattatccccctttccaaagttatagatggccataaggcccgcccggtacagcccggcctaagcatgggttaggcacggcccgaggcagtcgggccgtgctgtttggagggatgtatgaaatgatagtagatgtatgaaatgccggcccgaaagtatgggcggcccatcatatcttctttgaaataagtttattttccctcctccctctttgggctgtgacatatatatagctaaaataagtctattttatgtccctactctttgggccgcgtcatataatacgtctattttgtagacaagcagacaattaataagaggtatgtatgaaataatagtggattaatactctacctgtgcatataggtgttatatttacacttctttttacttgtcacaatatttacaaattcatggtgcggtgtttatattaggatggatatgtacacacactaaattgttacatgagatagcttttcatttgcttgaggggccatcccatcgtttgttgcataccatctaaatagtcaataaattttttaaaacaattaataaaatatatattaatataagacgtatatcgcttcacaagcattgacatataaggtcaaatttgactagtacaagttgtgataaaaagaagcaaatctggacccgaagcaggcttatttgaacaccaacctatccacctacatgtactacacagaatagtcttcttgcatgatctcatacatgggataatctccatctccatcgtcttcattggaatcaactatcgttccttgccgatgaaaaattggagtcctcggcgccctaggcagcgtatccaatggctggcagccgttattctcctgaagcttgttgacaactccggcatgattcagcaaagcccagacgatggtcaaaagctcgccgccggtcgccagcttggaggcgtgcacagacgctcgatcagacggcgcgatgtacagcaacaggtttgcccagaaatgggcgagcaccttccacctctcctccgcatccttctttcggtccacaagattgagcgcgagcaccgctccctcgtacagcagagggcatcctgcttcttgctccttccaaccatcgcgacccagcttcatcaacttgtcatacttgtcactggttgtcctgcattctgcgaggtatgcgtgtgcatcctttagcacacggcaagacagtagctggcttgtgtaagtcccatctggtatgagatccggtgcgaaagctacgaggtaggagcagtatcccgagagcactgtggctacttcgtagtgatacctcaactctgcatcagcctgcgccatgtcaaacttggactccccatagcagcagatgcttgtggctatgtgccataccaaaatgtagggggcgtatgttttatggctaaagaggtcgtaatccaggtctcggtccaaaatgccattctggtgtagccaccttcttccatcggtaattttgccattggtaggtttcagggcgtccttgagggcgcacaggacggcttgcttcacttgcggtggcaagacaatggatgacgccataatccacgggtcaagcaactgaagtgtcagagttgatagcaagagttgcacacggtatagataaccagcattatcaagcagggagtactgattaatggcattcttccagtatctggagacgttgaaatggcacagcaccttcaacggagtgtcgacccttgcacggtgccatgacacttttagcacgtactgacacatcaatttaaccttgtgccaatcggacaacaccaacgaaagaagctggtatgactctaaaaagatgtagagggcaacgaccagacgagtaacaaaaagatcaaggttgaagctatggatgatgatgtttactttggctgtagtactgggtcggtagtgaagaagaacggaagagaagagggtgaaaaggctggtaaccatggtgagcaaataaaggatcaaatcgaaaacgagattatctttcaaggaaggataccgagcatagaagaaatcaaacaggaagcccagctcagcctcaaccacccgaaaggctctgtcaagatcgcgatcatccgagaggagcctatcgacgacgagagttcttgataggtcgttattagaatggaagttgagatcaccaacatggtctgccccgaacctcaggcgcatcagcctgaagagcgcaaaagagaggcacaagtctcgccgcctcgccgcgccgcggctccctgcagatgagctgcagctcagcagctcgcccttgcactcccacaccttatcaacgctcaccgtgtcaggcgcatcgtaccgcaagtgtatcgccatcgacgacgactcctcttccttcccatcgacgaggtagatgtactccttcatactggacgggtcgggatcgtacttaccgacgatggagccatctaacagcttgtgtttcatgtactcgaacacgatctggttctccctgatcagcccgttatctcggctcgtcgtgcggtacgcgttgatcctcagaaccaaccgcgcgacgctcaagctccagaggatgaacagggggaccttgaggttcatcctaagctgggccttgtagtacaggatgagaaagagcaggtagatgatgtggagtgcttggttcatcatcgacctggcgtgttgctgggtgtcgttgaagctgaaggccgtcatcgcgtcggcgctgccgaggaggaggaggaggaagcaggcccagacaacgaagagctcgttgcggacggacgatgactgcatgaggccgatggtgtaggagatcaccgggtagttgaacatgaaggccgcccacacgaggaagcccaggaagccgttgctctgatggcgccgacgggagttggagaagacgaggatgacgacgaggaggcagctcagtgtgaccagcccctcgatccgggcaagctgcccaacagagctcgcggcgaattgcttcgcaacctgggtgacattccccagggcaacaaatccatccattctaattttaattcctgtctctctcttactcgctcggtgtgttctttcttctatacgagttcttctatcaaccactccgccttatatattatactccctccgtattttaatgtatgacgccgttaactttataaccaacgtttgaccactcgtcttatttaaaaattttatgtaaatataaaaatatttatgtcatgcttaaagaacatttaatgataaatcaagtcacaataaaataaattataattacatacattttttgaataagacgaaagatcaaatgtttgtcaaaaagttaacggcgtcatatattaatatggagagagtagcttctattgtgaatggatcaaaccacaataaattcatacgactctgctcttcgcgtctttgtgagtgctattatttgaaggaccgactctgctacaggtcatttcttttccctcttatttgtgaagaccaggaaaggtctttcttatctgttgctcaaaatgtcctaaacaaacacaagcgtgattgaactgctaaccatttcttttgaagaacgtactgttatttttagttgctgctgtaagcctgcaattaattatccatgcgaaaaattctgaccgagcaaccgtgcaggtcttgttagtttgaggattttttttttctataccaattgaagtttgcactcagccgggatctatttgacactaggaattcatggtattgccaggtcaattcatggtattgccaggtcacagctactgcccactccttgtagaccaaattactacatgtcaacgcataagatacaatgtacttacggatgttatgagcttcacgggaacaagttaaacagggtgatgctctaaaattttcatgtagactagccacttagttgtgcggtacgcaactttgtacccgtttataacccctatatatatatatggaccgtaatatttaataaaatttaattacttttttattaaaaaaaatatgactctttaaaacaatggtatgttcctatgttgcatattttatgttctgaatttgtgattttttttcgatgttttaatccttggaacttaatgtttcatacattggacgttgtgttgcagtcaatatatatcgagtgttgagtcactttgaaacatttcatcaagggagctaaaataatataggatctgtaatgccccgcttttcgcaagacgataaatataagttaataaaatcctatttgcgaaaatttagttcttgagtgtaagtctaagtcgtgccatggatctcaattcaaatatatccttttcccctctcatcgacataaaaaatcgccacctcgaaattccagctccaaattgaatatacaaaaatcaaattccggaattcaatctctcccggtgaaatcatcgccaaatacttgtcctgattccaaaaaaattaccaaatttccaccttgaatccctccctaggctccaccttgaacccttgagtacagatgcccaatttgatttcaaatccaaactccaattcctctccaattcaatttctctatagaagtctaaatcgccttcctccttattgggctgtttttcttcccgggcacatctctctcgctccctttccctcttgggccgcaaccgtttcctggcccatcaccccagccgctctcgctctctctctctctctctctctctctctctctctctctctctctctctcgcttcttgccgcgccatcgccaccgtctttgccttcaaaattccgccaccgccttcgtttccttcacgccgcgcgtcgtggccgctcggaaggacgccgccgtcaccctcgcgtcactccgcctgtcgcggcgaccgccttgcctccgctcgccgccaaactttgcaccgcctttttggcgacattgccatcgtcatccatggtccccgccgcttgtagccaaaacccggatgccggtcgtgcgaccgcaccacctcggcatccacccccacggctccttctcctccaagccccggttcaatccaccctttaaagcctcgccatctcccatccttctctccttggttccaccccacccgagccgtgcttgccattcgtcctcgctcggccagtgtgcgtctcatcgtcctcgcccaccgcgcgtcacgctgggagtgccgttgtgatcatggtgcaacggcggacgcttcttccccttctctagccttgctccttgccaaggccggaaccgattgcttccgcaccgatggtcgaccgcctcaacgccttttcatctcggtagccctccgtatttttcgcggcccaaccacctcctttaggctgctagctagctggccgccgctccgtgttacgcgaagctcaccgccgctcgccacctctgtgccgatgctagatcgccgccgtgggtctccttggagccgcgtcgtgcccccgtgaagcttgaaatgagttcgtgaatccttgaagtagcacgagctccgaagaatcgagccctcgccgctccggcgaggttgccgttttcggtagccatctggcgaatccgagccgtaggctcatttttcctcgccccgctcgtcattcaggtgcgcttccctcgtagcgccgtgcgccgctccggtaaacgtcgccgccgcccgccgtcggatccacggcagggtcgtcttcctccttgcaccgtcccgcgtggctgccacgtcctcggctctcccctctcccgtgcgcacggtccgcggttagccgtgtggctgcacatgggaccgccgcattccgtccacaccggtgcaccaatcgccctccccgtccaccccaagccctagcgccgccgcacgtgcacctggttctcgtgaaccttgtagctagtaggtgggtcccacccaggatcccgcgcggtccaccggcctgcctcgcgcgcaccttgcctacgtgggccgtgcctcgcccttcggctcgcgcgtgcacgttcgcgcccgcactttgctctgggccacgcctcgtgctcgaccaagaagtttaatttcggtccctcgttcccatttcctttccagggaattctttaattccttttcctattagacataaaaacaaataattcttaggaaattcatatcacttgatctgcagctttgtttgacctcattcaagttccagtatcctctaaaatttagatatatctaatggcactattagttagtctaaatatagatatatatatctaatggcactattagttagtctaaggcttcgttcgcaagtgccggatcggagcttgacttttgggttgggaacatgtagtactgtagaccactgtagcagtgtcagggcgtcagggacggagggaaagcggcagcctggacgccgtctatggccgacactttccgtcgccgtgccgtgcgatgccgggcaggggctggcagtggaggtactgtagcatgcgaattaatgggtgtttttttgcaagacacgggtgaaagaggtatttgctacgcggcaccaattgtgaaagaaatatttgatatgcacacacatgtgatttctttaataataattttcataatatgtgaagattcggacataaattttgcaataacaatgattaattttttgtctgaaataataacgcaagaattaagaaaaaaatgaattgtgaaacaaataacgcaagaatcggtgcatcaaatttgttgttaacgttataaaaataaatggtaaaccatacaatcctgaaaattgaagtactgaacatacgacaagcattatggataacatcacctacctaatggtagttattgtacgcatcatcagcaatacagtcacgcaacatgctcatagcggcctcgctatttgttgcgtaatacatatggtcgaatgaatcgttcagcagcggcactggattgccgttgtagagagcattagtgaaccgataggtcggatctttactatccaacctaaagttctgtagagcgaaagctgcatgaatgatgcgtgcagggatgtcctcatctcggtaataagggatttctttcaatattttccacatcttttttgcgatgccaaattgtctttccacgatccctcgcaacgtggagtgtcgatggttgaaagtctcttcccgtcctacgggtggcggggctccctcgaccgcaagttgatccctgtggtaccgtacatgtgggtacggtgcaaggaagcccatcctggtaggaaatccggagtcgacaagtaggtacctgcctggttaacggcgcataattaaatattagtgcacatgtgtaaaattaaataaaatcaagacatttggcaataaaaaaagtgtattgaccgatacaactcacctaacggtacccgtgggaaatcgtaggggtaagcctgcactgcctcattgagaatcctttggtcgtgaactgatccaggccagccagcatcacagaaaataattctcccatcatgatcacatattactagaacatttctggttgttatgtggtgacggttcctgtgttgcatagcgctagctgcattaggcagaactggaatatgtgtgccatcgacagctcccactgattggtagaaaggcttgaaaggattctcttgcagaatctgagggttgtaatctaagaagttgggatcaaccggtttcaatattttcccagcgagatcattcatagcctgcaaaacatggtggaagtgaaccgacactgtcgagttggagcggacccaccgattgttcgcgtctctgattggacgatttccacccatcgtgtacaagaaaataccaagcttttccatggaacagacccctgctgttcctacaagaccaaaagaagtgaccaatagatcatgcaaattgtgtatctcctctgcagtaagcctgaacattgccctgcattggcttcgatttgccatcgtgtccatcatccaactgacaccggtttgcaccggtattctccttggtgccctctcattgaaatcaagggtagcagccatgtactcaatgatggcatcttcttcttcgctgcttgtgtgaccgcctccattccaactcgatccacccgcgccgtaactcatcgccgatttcctttaacatatgagaaccgaagaataggcaatgtttgtcataatcaaaaggatagaaattaataatggcagtgatctatgcaatcgaagaattatttggatataaaagcaatgcaatggaatacgtagttgctcgaattggatataaagccgcaaatgtttagggactcacagaatgtaaaaattgttagcacactgagttctaaacataaataatggtttatttggaaaacatcgcacatcacaactcaaagtaaagtacagtgcacaaactactaggtgccaccagatgactgtccagtaccaccagtgcgtataaattccaagcgcctagcagcgtccttgagtcgaacaaagcatttgcaggtcaatgggtcacggaatagcgcacaagcagcataccacacacttcctccaatttcatggccatcattttccaccaactccatgcacgcatcaaggcccatagacttctctgcttccatctgagcaacacgactctggtagctctgctgtcggatgtccgcaatcctcnnnnnnnnnnnnnnnnnnnnnnnnnnncgggacttcttggaagaactccctgaggcagtagtgtttgctgctagcctctttcccttgccccggtctgctgccgttgggggtggagttggaggtggtggtctataagcagcagcgagctgcgccatgtcgatggtctgccactgaactgctccttgcggtgcctgtggggctgcccctgcgacggcggagtggtttccgacaactgtgcgcccactgaataccgcgtggtgaaggtcaatgtgcttcagaggatcattcctgaagcttaagacacctttattttgctgcaacataagtagacagtaaaaataagttagtacaaggcaagtgcattaggcttgtgcaaacattgaacataatgaatatgtgcagtccaatgtgcattactactaaaatgctggcagtaaatgtgcacattggtaccaagttatcaaatataatcaggagtacatgttacaatgggccacacatctgacagaatgaaagaaagatagtttgaacattgtaaacataagataaactgcatatgttatattctttgtagatgagcacatttttgttcattctctctatatacatcacaaagaaggtgtgtacagctagttgaatatgtattaacatgttcctaaatgacttgtacaagatctttcctaatttactgatacactacatatagattttgtttatgcagagaacaaaacctataagcattaccatgttacattgactgctacattgcataagctaataaaatgctacattgtgtaagctatatccttcacaattaaacacatgtgaatctgttaaaatgcttttgaatgtcacatgtacaagatcatttacttctcgcaatcattgccaatcagttcatggtagacagtgtaaacatcattttgttaacttaaatacaagggaatggcacacattactaaaaacgacatgacagtaacaactatgaaacatatgtgagcacaatccttccattttactgcagctagtcatttgttggcacacacaatttgaacaaaaaaattattacacctcacaaaactgtatttataattgcatgcatgtactaaatttcagataataccaattgtaggcaaaattgttggttcaaaatatttatggtcaagtgtacgtaccgcattcttgctttcccaccactcatcatcggcaacaatggctgatgtatggggatcacgacccagcccgcttgcatgcgattctagccacacccacctgttgtaccgcttcttacactgcccccaaatgtactccaattgagccttgttcaccttcttcttgcacttggtgtacatcttgtgtattaggttctgccatgcctgcggcttgggggagttggaggtgatggtgaacgctgccatctcctccaagcagctctcaagaaacacacgaacctccatatcggtccaccggctacggccatcgcccatctactccgtgcaagtcaaatactccctccgtttcgaaatgtttgacaccgttgactttttagcacatgtttgaccgttcgtcttattcaaaaacttttat

SEQ ID NO: 7943 - DNA, 1457 bp, Oryza sativa
  unsure (1)..(1457): unsure at all n locations
ataagacgaacggtcaaacatatgctaaaaagtcaacggcgtcaaacatttcgaaacggagggagtaaaattgaatcggaaatgaacaaattaatacaaaccaataccttagatgactcttcctcgcggacgacgtcccaatcaatcgaacggccgacggtggcagggctcactcttcgaacaaagtcgatgacggctctaggagacttggcgcaaaccttgcagagggcatgcgcgatatgaagcacgtcgtcgggagcagccttggcgctgccagcgtcggaggtgacagagtcggaggagtcctcgccggactccagatcggcgccgcggacagagatctcccctgtttgaggggagtgggaaatcgtcccctcctcttggatcgacaatagatcccactctcgcttccgcttcttcgctgtcgtctccatcggaccacgcacacgctcggcctgaaatagagctggctcctcaactccgccagcttggatgccttgatgacactcttcaggccagcactgtctgacccgagaggccgacaggacgagcacacaggcagccagactgccaaagatgggcggcctgatgggcgccgatgcttgctgcttcacagcgagcacgccggccagcttttactcccctcgaggacgacgcagacagctcgacaggcgtggagctcttccacttccccccgattttgagcaccttgaaccgaccgctgccgcaagacgacgcgcggacgagaatcgattggggggggcacgggcctgcaagccacagtcgaaaggggaggaggggggctggcgagaatcggggaggacgggagcctgcagcggaggggaatcgattctccgctaggcctgcgtcgcatcgacgaccgcggaagcaagatagcaacagcgagaggaggaagaaagagggatcgagagcattggatgccctgactctgacggaaaagccgaggcgcaacggcaacttctcacatccgttaacgacgttaacgtcgcctcacaagccgtccttctggtactgtgtgcgggaccacgcttccagtgcacggaacatgaaccggatcaggactcgcacatacgaacgaagcctaaataggatctttcttttggtcttgtataggtctttaattggttgtgtatagttgcgtatagttgcgattgtggatttctgttcgagcccggatttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7944 - DNA, 662 bp, Oryza sativa
  unsure (1)..(662): unsure at all n locations
aaactgttggggattccatgtccaccaagatgcaggatttgcagagcactgccaatgatattgcgagtgtggctggcaaatcattggagaatcagatgcaactttcggatggacagagcacggccatggacggcctgaataatctgtacagctttcaggcacaagctcttgaggaaagcaggtattttaacttctcgcttgcattattctttttttatttcattgtaaaatatactgattttgactggaattttcagggagactgtgcaaaaacttgcacagtttggnnnnnnnnnnnnnnnnnnnnnnnngtccaggcaggaagaaatccggcaagctcatgaacacctgattcataattcacactcaatactggaagctcaggttattgtctcctcctgcatatcagaatacgagaatagttttccttttgtttgactgcttaaccatgatcaatcagtaggcataggattgacttcttttcaactgatcttttttccttttgtcctgcaggaagagttcagagcaaagcaggccaacatttttgctgctctggacaaactttacatcctccacaacgccatcttagccgagtcacgtttcatcaaggcgttcttcttctactgctgcatcgtgtttctcatctacttgctcacaagcgc

SEQ ID NO: 7945 - DNA, 18232 bp, Oryza sativa
  unsure (1)..(18232): unsure at all n locations
ccgagtcaaaatatgcattgtttggaagagctgtggatttaggagaagctgcctaaataggaacaaaatctgcattcaaatattgccaaacggcatgacgcattttagttttagtttccatgtcaaatttgagcaaaccgaagttaatagtgattagtgtactaacaacgcgtcgtttttaagtgagagtgattatagtgataattaacagcagcaatgaaatggaagtgaacatgtcccaggtggcatatagagccgtgaacaaaggctccagtccagccaccggcggcacgccggcgacaccaaccaccagcccaagcgttcggcagcggcgacgtcggcagccacgcgtacagtggttggtcccacagccgaggattcaccccaagacgcgggatccactggaacaagaggccggccgtcttcttccagtccagctaccctcctgcaccggaagattccaccgagacacattcacctcgccagaaacggacatcccaagattctggtccacacacacagctgcatgcttggaagccaagcaggcaggcagacaccggccagctggcagtagctgacgtcactgctgctctcacagcagctctgccgttgacaacttggcattgcttccatcacanagatctaaaacaaggacacaggttgtagattctgctacagccttctctccacaatatctgggagaagctggaactaccttggaaaagactatacactgtttttacttttacacattgcagcctcctgagtcaagctaacagactccagacagcagaacagactccccccagcttacagaacttggtgggggtgtgagtaccggtttctgcagctgcgaagaattagggctgtatttacaatgaattgaattaggttggacaacattgtacaatgatgcggtggcgctgttaataaagaacaagtactgccaccgcctcgagctgccaccccgggtggcgagggcgaatccgccacggtcgtacatgctctgaatctcctcccggtaattggggagcgactcgtgaggaagggccggtgtcagctccaccacatcccccatgctgagcttccggttcagatcgcttatgggctcgtggttaaccttcggtcgcagatcttccttcatggggatgcggtagggactccatcttggagtgttggtcccaactcgatccatgaggttcattacagttgagtttgcttggaattcttgcacagacatctggaatcacagggacaaacttagtgagaactataatcaaaggcgatacggttgcaattttctaggaatgggtttaactggagactgcgctcaccttgtcatgttccagtaggatgacaaatatcggtccatcatggtcgcattgccgagtatatgagtaagggcagtcttctgaatgcatgggaaatggacagggtggcctaattgcatcactgtcgcctagagatgcaggtcgttctttgttcattgcttcacattgccatgtaagcacccacctagcccattccaccatctggagtacaaaggagtgcctacaggtgccttccttgtacctccagtgtgctgcgaatccatactcagcttgcaggtgcatctcttttgtacggatctggacttcaaatgggtggacattctcgctcatgacaacagtgtgcaatgatcgatacctgtagaaagcaaatcagtgcaaagtatagcagaaagtgaatgaagaatggtcatatcaatgttcaactcagcgtacccatttaattttggacgagatatgtagtccttaaatcttccaggaacttggggccatagttcatgaacaacatcaagtgctcgatagcaatcttcctccttctcaaacacgagacgcaggccatggatatcatggatctcatccattgtcaaattcttcctgataatgtgcgaagaccagttagcagaaagaaagaaaaatgtggttcatcgtcaagttttaaaaccgtaaataatgcaaacagaaagccttgtaacatactttagcatcttgttgtgaatactgtataggcttttgtgcctcccagaaagattgtgatatgagaggcctgcatccctcagacctctatctagtttgtccacagcagatgtgattagcacttcgtcaaaggatttggttagtttagatgatagatccttgtgctcttctggattcagatgcttgaagcaaagattttccaactggtctttccagctggcaatccctaatcgattagccaaaggaacaaagatctccatggtctccttagcaaatctttgttgtttaccaagaggtaaagcttccaaagttttcatgttatgcacacggtcagctaattttattagaactgcccgtgcatcagccattgcaagaagcattgtgtgcaatcgatctgcttcaacaatcctgcttgctgtgttgttatcacgagcaagtttgctcaagtggctcaactttgagacctgaacatattagatatcaaccattagttttgcaacaatacaatctattttctctgtacacaatgctatgacgtatttcactaaatatattgccaattgtcacaaattcatcatatgagaaataatgctacagagaaagtgaccttttaatgcactagacttagtacctaagctacttaaatcatatcatagaagtcgtacattgaccccaaatggaggaacctttattagtgagggatgtaaaatatagttgtcttacattagaaaaaatgcagacacatgataattgactttaagtatataaagggataaaccatggtaattcagatcaaataattcaagttggtcctgtcagcagcgtgataatccaaaataagttcaatgttcatattataaaactcattaaccgatccactgggaacaattatcaaaatccaaggaaactggaacacgtaccccctcaacgagatcggccacgccggctccgaacatgtgaaagatgtgatcataatcaatgaatgaatcgtcaatggtgtcgtgcagaagcccggcggagacgaccgtcgaattcccccaatattggccagaagcacggctgtctctacacaatgttgcaagtatggatcgccactcgcccgggtctaatcacaaatcacaaactgaacaagataagagactgatgcagaagcaattcaagtgttccaagaaccaatagctaaagattgtgtagctcgcggttttgacctggccacggtgagccttctcggcctcgaagaaggtcttcacgacgagctcctcgtggaagatgcggtggcgagcctgggcgccggcgaggagcttccgggcgcacggctcgcaggcggggctcgcctccgcgaggttctcgtcgagctcgaacgcgagctcgccgccgccgacctccgaccgcgggctgagtgccggggcgtagtcaacgcaggagcccagcgcgttgcgcacgaagccggcgaagaggcgctcgcggtcgcggtcgcggccggcgagccacgacgccggcgggctgcgggaggccgccggagaggacgacgggccctggaacaccgacacggggctgtggtgatggtggtggtggaggtcacgccacttgagcggcgaggacgagtagccgccgccgccgccggcgaaggcgggctcgtcggatctatcttgccacagcgcaccgagctcgtcgtgcggcggggcacgaggcggcgaggccgccgcggccggggaggagaagaggcaggacagcccgcccgcggcggcgggcgggcggtgagaggtggacggcggcgcggtggagcagggcggcgacgagccgcgggagctcggatcgaactccgacgagtagacggcgcccggtggtgggctggtgtacagggaaatcgccggcaacgacatggccgcctgaccccgagatccctccgacgagctcgaaacacgcgaactcgcaaactaaaaaaaaaaaatcacgaatttgatgtcttggcgaggtgaactcggcgcattcggggttcctggaccaaaaattgaatgaaaaatggccaaaattcggtcttggcgcgattaaattcggcggatttggatgctgcctctcgcgggacgagcaacggcaagggtaagaaagaaattggggaaatcttcttcgctcttgtgacttgtgagcgtgtggggttgcttctactgctgcgtttgcggtgtggatttttgtgaggaatctgggaccctttgctccccagttatagaaaggcggccggtttcgaaatgactctattgcccctgtccgcgaggaatcttcttccatcagtttattgcttgagcaattaacctttgtttaacctcacatttaacaaatataaaaaatgcatattcgtaaacaaattaattatcgggctaatcgattgcaaaggttggtgtcgcctggttagataattggcatcaaactctgtagtggtgttactgtaactactactttaggcctaatctttgaacaaatcgagatatgcctttttgttaaagttctgccctatccaaaacttgatgctccattggccaaagataattgtggttgatgcgatgccagttgcccaactgataaaccaagggaacacaaatatcatctcaaagtcctatctggaatgtactaatccactaagcccgggaggagctagtggtggtcattttctaatccatccagtatttttctccagtggcacttatatgcatgaaccttttattcgacaagaacattggcaaatgctttttatttcgtatgataaaattctccactaagtaacatattgggaaaaagattatacctaacactgtaatctttgtatagccttgtttaatgattgccactggaaataaagagcagttcgcggctcaaactgaacccaatcatcagaggccactatatatatatattccaaattatgtaatgctgttttagtattatttagtttgagctttcaaacatgtgcagaaccaatcgaacagcaggtgcggcactgtttgtaaaacgggcaacgcgggtcgcttacatacatagaattaattataacaggtacagctactgatagtgattagtacgatatttaagcgccgctgaaacggtgaccttctcatggcctttcaatagaagcttcttgcatgatcgtttctgctttctacaattctacgactagtccactttctagagcatggacttcagactcccaagaaagggaaaatcactataaacatctttccatgtagtagcacatttttttttctcacttattttaaactataaagtgggatagaaacggtaacataaaatttttaaccaatcgagtactctctcccgtaataggttgattattttttaacggagggagtattgttttataaattaatacttcctccatttcatagtatatcgtttttacgttttctctaatcaaacttttttatgtttgacaaaatatatagaaaaattagtgaacatctatattactaaattatcatatattttttttctacaaacgactaagaaaaaatcaaaacaacttataatataaaattggggaagtattttttttacctttttgattttatctgtatgtaaaattttaatttcttaaattcctttcgacgtactacagtcgatgataaatagttaaattagcaggtatagaaattccggaccgactagagtagtttccgacaaatatttttccgacgggttttcatccttagatgtaataaatgagatttgaaattgggtgatgcttcgtgtgcattaaccagtttttttctccaataaaagttagatgaagattaagatcacgtttttcaaattgctaaacggtgtgtttcgtccgaactttctatatgaaagttgctctaaaatatcatattaatctattttttaagtttgtaataattaaaactcaatcaatcatacattaataccacctcgttttgcataaaaaacttaatcttcattttcatttttaggaaaaaagaacatgtttcgatctttatttattctctctgttttgtctttacattaacaatggtttactccctccgtctcacagaaaaatcaatttagtaccgggcttgatatgcatatatctagatttgttgtattaggatgtgtcacatttaatactaggttatttcttatgtgacggatgcatgatccagaataatacttaatccagccatagggcttcgttcatttaaagaagtcctcaccgaaagataaaactactcctttatttattttagagtatatttcacagaacttttcaaactatcataaaactataaatttaaatatatatactttatataaatttaaatatatatactttatattaatagtgaaatttggtaagtctggagtaatcatcggcttagagtcagtatcggcttcagagtcctggcattagccgataagagttatcaagtcaccagcagtcggattcttggaggattcggttaaggacattaatctattcaaggaaccttatccagaagagaccgagttcaaggaggatgcggcatgatagtttatctattaattaggaatagtttgttagttttcttttatctttaggaaaatgtgtttagtgtccgataattgctttatgttttccttttatccttaggaaagtttctttcttatcctacaaggactagtatctccccatgggtataaatatgtacacccggggtcattgtaaaagaatctctcgatcaatacaactactctcgacgcattgccaccctctttaccgaggtttttacttatcattcggtagaacttggctcttgacgcggggctgcatcggctttcgatctccggcgaaggggtaagccctatgttccaccggtcctggtgaatctatcggctacattggtattgttcaaggctgcattgcttcgatctcttggatcgctctggtttggttgatatatttgcctacctgatatctcaattctatctctaattgcattgtgtttagagacgcatcggtttagttggaactgtctcggttaggtccgatcttctgtcttagccgatatatctctacaatcacaatgctgttctaaatagatttgttatatccatcacattagatagatcaatcagctcatcgagtattagattatcatatacaatctcatgctgcatcggttaggttcgacctactagattgttattgataatataagtcttgttaagccgataggttcatgctaatgttttatcggggtgctagccgataagttatctagacgttgcatcggcttataaggattgtatatatataagttagatttagccgatgataacaaatgtttcattgatctatctaatcttgtggattttatgacatcggaacttcagccgatgtatgctttaactttcggatcaatatttgttctatcatatcattgttagccgattagtttctactggattatattattgttatttatcatcatcagccgatcgcctttatatcattatctacattgaacatatagccgattactcaaaactctatcgttatcggctagtatcggcatcggctgggattgctctatcggcttgtcagccgatcggctatttgatctactgtttacatatcttgtcagttgtaggatcaaactgactggcacgcccgcatctcaccaagatttggacctgcactggagctaaacagatctccagaccagtgtgtgcttttcgcgtcaacacattatcaaactatcacaaaactataaatttaaatatatatgacataactacaaatttaatgtcaaagttaacacataactttagatgtaaagtatcatatcacaaaactacaaattttagagtttatatccataacatattaagatcgtaaaatttgtaattatgttgataaaattaatgttgaatctgtagttttctaatacgatacattaaatctgtagttttgtgaaaatatgatattaaatctgtttggatttttatacacatatgtttttaaatacatagttttacgatggattaatcaaattagtatgaaatttactctttaggaggaaccgagtgtcgctctcacatgctcatctcacgctatccgtaggctttgttgctgatctgaactttatgggggtgtgtttgatagagggaggatcaggtagtttgaaaagatacgcaaaacgatgtgagctattagctcataattaattaagtattaactattttaaactttaaaaatggattaatatgattttttttaaagtaactattttatagaaatttttgaaaaaaacgcaccgtttaatagtttgaaaagcgtgcgcgcgaaaaacgagtgacaatctcccaatgaacgaacgcagccctgaactgtcggcggagaagatagacacggccggccaagcaacgtggacgcgtggagcgggcctcgttgcctccggcggaacgatccgccggggcacgcgtcgcgcgcgctccgccccgccaggagcacgtggctgcagaggcgaaccgttctgcggttgagccgaggtggcggcttacggctgccgctggccgatggcctacccgtacatgcgcgcgccggtatttcggacgcatacgccgcgccgtcgctggcgggcgggattttacaggtgaaaacgtgtgggaaatgtgcgtacgacgactgggtgtgcgtatacgtacgtactagccgtttactttggcctggttactcacttgctccggtggaaggacggaaggtacgccacgctcggcgcgggggcgagagggacggatactcgatcgcggatagtgatacggtgggagctcgggccgtgcacgtactgcgtttctggtagatgcgtgcccccgtgcccggtttctggtttggtctcttgacccgtgaaatggattttaccgggggctttggttggtgccggtggcaagcgtacgactgttcgtctgttcctactccacgggcagagcatacgtgcacgataggatcaagtttaaaaaaaaaggtgagaggtgcaagaagaagaaacatgattaaatggttagtcttcaaaaatgaaataaaaaaggtcaactatgaaatagaaaaatgaattaaaaaatcttcagaaaatgaaataaaaaacagtatagtttttgggtttatgttgccgtactgccagaatgtcaactactccgtattttctatagcaaaaggtctcacaatgtttcccctgttgcacagggaaaataaaagtagtcaaatggttggtaggatacagaaaattaaacaatccacagtttgctgagtattttttccttgtataataaataaataaacaatagaaaaagaaaaaggaagcgtcaaagggagttgagggacgcaggcaggatactgtcgtgggccgcaaacttgctccaaaaactgtgttcgtttgcagccttgtagcatactcccccgttcaaaaaaaaaaattaacttgtgttgtttcagggcttgtttggtttggagccaattttttccctactaaaatttaggtagtactaaaacattggcaaattttggtactaccaaattaggtagtattcaatttaaactatggtgggtaaaatttggtagcaaaccaaacatccacttgctactattgaagttgccaaaattttggtagggtagtaaattggtatcaaaccaaataagccctcaattttatcccataaaaaattaatttatactattctacctatcctcaacatataaacaggaagttttatcccttaaatgtcctctatctatcaccattactactttttctaataataaaaaacattgatcatttttactcttcactaatttcactttgaaatgctaagaatggtcttattagggactctgcatatagggtatgtttggttcctagccacacttatagatggccatttgggccgcccgacacagcatggcccaagcctggctgtgcctcggccgaggcttgtcgggctggcacggcccaaccgactcaccgtgttgtgccgtgccagcccacgggcggcatatacgacccaatactactcggggccagctcgaaggcacgaagacccatcgtgcttgctctcagaaaaagtctatttttgggtccctcaactctgcgggctgtgtttaaatggctggaaaataagtctattttttatacctcgtgtcttgggtcttgccttacatgattatataagtctattttgcatccctaatttttttttatttgatcgggccgtgctgggctggcccaccccgtgccgagggtgtagcccaggcacggctcggctgttggatcaagccggcacgggcacgaccccaggcgggccgtgtcgtgcttgggccaggccaaaactgtgggcttcgggccgagccatgggcctcgggccatatggccatctatagccacacttgaccacgctacaatttatttttgttaagtatgtgttttgactcactatttcacaattatagtcttggcttgccacacttagtgaaggatccagaaaattagttccttgatgtcataatgtgtctatcagagtcatagtatactaattatacttaaattatagtattctaatttatggataaacagtttaaatataggttttactgaaagtcgtcagtgtcatctgacaccggcccaatacacggtagattcatccctgaccacacttttttaatagcatgtctcgtatatcatagatttaacttttttttaacacagtttgtgactaaaatttgctcaccacattttttgtgatcatcataacttatctaattttagtcgtggtaaagtgtgaccaggaacaaatacatcaataacgcggctttcaattaatagttacttcctccgtttcacaatgtaagactttttagcatagcctatatttatttagatgttaatgaatctagatatgtatatgtgtttagatttattaacacatacatacatacatatacatatatatatatatatatatatatatatatatatatatatatatatatatatatatataagcaatgctagaaagccttacatcgtaaaacaacagagggtgtacccataatgcggctttcaattaaaagctgagtctctgacctactctaaaaataacaaacacacccatagtatttcaagagcaaacctttacaaacatcgctcggtaacaagagcatcacttcgtgtagatttcgtcaacatcccgtaaaatcagaaacgtagtacaagtattacggtacacgacgactttacctctcccaaaccaaactcacactggaaacccagaaacaacaacgttcacagtattacgcgcacaaagcgatctccagttaattctccaaccaaactcacgtctgcctgtaactactccgtggccgcaggttgtacctccggccagccgacgtcgtgatggagttctcgccgacgacctcctccggcgaggcgcagtgcctccggcgaggagcgaccaccgccacctgccgctgctcatcccccggcaaggcgtagctcggatccgcattgctgtccacctcgtcggccaactcgtcgaacacccacgagtagtccatcaggctcctctcgctctccgcgccgccgccgccgtagggcagcatcttctcgccggcggcggcggtttcctccagcgcccggaccttctcgacagcgtttcggagcaggtgatggttgagtagttcgtaatccctgaagaaaagtttacaggctaattaattaccaggagattgagatgaatcacgaatgcatgcaaagatctgatcgtgatgaacatggactggatttggtggttacctgaatgtgaatatggcatgcaacatctgaacggtggcaagtgcaaggaacactgatctgacaaggaacaccttggatatgacccagaattgcttgtcgatgtcgtcagctccgagcttgatcaggccaatttcgagcagaagcgtgatgcacaagcctgccaggagagtaaaaagcaatagcaattgagcattttacaaggtgtaaatacaggtagtaactgctaatagtatgtgaaatatcctgagatgtttttttttttaccaaagtaaagatgtcccctgatgctgaaagtttgcttcgcgcttgtgagcatgtagatgagaaacacgatgcagcagtagaagaagaacgccttgatgaaacgtgactcggctaagatggcgttgtggaggatgtaaagtttgtccagagcagcaaaaatgttggcctgctttgctctgaactcttcctgcaggacaaaaggaaaaaagatcagttgaaaaagaagtcaatcctatgcctactgattgatcatggttaagcagtcaaacaaaaggaaaactattctcgtattctgatatgcaggaggagacaataacctgagcttccagtattgagtgtgaattatgaatcaggtgttcatgagcttgccggatttcttcctgcctggacnnnnnnnnnnnnnnnnnnnnnnnnccaaactgtgcaagtttttgcacagtctccctgaaaattccagtcaaaatcagtatattttacaatgaaataaaaaaagaataatggaagcgagaagttaaaatacctgctttcctcaagagcttgtgcctgaaagctgtacagattattcagaccgtccatggccttgctctgtccatccaaaagttgcatctgattctccaatgatttgccagccacactcccaatatcatttgcagtgctctgcaaatcctgcatcttggtggacatggaatcaccaacagttttgatctccctctgaatatcaacagcctcttccttcagcttatccatcccattgccaaggctctcatacgactcctgaatatgcgtcatgccggcatcgatcgtctccctcatctcggtctgcccttctctgagctttgcctgagagtctgcaatctccttggactgctcaaagatggccttggagtgagccagcacgtcgtcgatctggtctccgacattcttcgacgcctctgcgagatgatctgcctgcatttcgatcgacgagatcgtctcctgaactttgcgtgattcttgtatgatctggtctgacctctcctcgatcacctccagcttctcctcggctgacttggatgtccttgtcaggtcgttgacaagcctctccgtgttatgcttgaacgcttcagctctacacaaatcaacaaaacatgaaaaattcaagaagcagaagtgaattgcaaactgaaaatgggagaattgcacttactgcaattggtggcacagggtgttggtctcgaggaagaactcgaggaacacctggtcctcggagacgccgagcctcttgcggcagtgcaccatgtcggagacctcgccgcagcgagggaacggggggcggccggagtcctcctggaagcagctgctgaggtgccacgccagccgcgactgcatctccttgtcggccatgatgtcgccgcagctggcgaacagcctccggtacgcctcctgccagcagttgctcggcccggcgagcttgctcctcgcgttctccagcagcttcaccgccctcgggtcgtcggccccgtccatcaagaagtcggccaccgcgccgtccagctccagcatcggggcggcgcggctctcgccggccgtcggcggcgaagacgacgacgacgaggagaaaatgttccacgagaagccgctgctcctcccagggcacagccataggcaggccaagatcaacaacaggataatcgtccctgcgtgtctcctcatggtgaaatcggtgaactttgcaccgggcaagaagcgatcttggtgagtaaaatcacgggttaattgcagttcctgccaggaaggaacaatcaagaaggcaagaattaaagcctattcatttgatgcagattgttacgccccgtgttaataacattctgaaattcttaaacccaaagaccccaatcgaattgaatcaccgaattgaacagaataggaattaacttgcaaatttgttcagactaaaatatgattaatcgaagccagtaacaacctaaaattctaaatcaaatcgccggagcaagatgcaacaaggggcagtgacaaaatagctgcaactttcccctgcggtgtgaagggctccctgataaatagcacccggtgttccttagccggcaagccagagagatccagatgagcctgtcacatcacatgcaggggaagattaagagagaatcaccctaaactaaaccaaatgtttagaacttttgacaccgaaaatgacagcgacacgcacgcaaacacacggtgaacagcactgaacttgatattagtaatggcggtttacatttggaatgtgctagttatcttacacggttacaccaatggaagtgtggaaagctacttggatgccaagttgaatggtggggcacagatctcttgccgtttctatgttccgttcccagcaaggaagatcttgatcagttaatgacaaatcaagtcggtgctaatttaagtcggttgcatgcactggcttacaccacaagatactactccaagaggcgcaagcgcttggcccaccatgccagtgacagagggccaatcaaattctcctctcctataccttgcgggctatctttactgacatgaacactgaacatataccgcgaaattctgaaaagttcagaacgaacgaacctacaacgatggttcaattttgttgcaccggtgaagttcagagagaagaaagaaatctcgctgtattttgattcggaaaagagaggcaagagcagaggaaaaaaatggaggaagaacttactcaccggatcgcctgacgttggcagaggttgaaggcgacggagcgcgacgggaggcgaagctgtaggaagggagagcggccgccatatatgtagaggttaaaccggccgtgatttcactggcggtagttcgcggtgaaaacgcgcgccggttaactcgaaacggcgcgaacgggcgaacctccgcgtgagaaacagacggagatcaagaggcggcggcggcgctggccgtgccgtgtgccatgcacgcggttgggatgtagtagtacaaaaatttggcaactctttacgctcgttgagtgagcactgaattggcaaaagtttgaaagtgttcggtacagcaaccgtctgaaattggcaaagtttgcatttctgtttggagatgctacatcatgcgcaaaaaaaaagttggttcacatttctccaattttatttttctttcctgtttgtttgaactttgaaggatactaaactcgacaggaatttcacaggaacaagaaaagtcacccgcgttccaaatggatcatgaaacatccatgcggtgaactgaactgaacttcagagagtagagagacaagacagaggctgtgtttagttcacaccaaaattggaagtttgattcaaattggaacgatatgacagaaaagttgaaagtttgtgtgtgtaggaaagttttgatgtgatggaaaagttggaagtttgaagaaaaactttggaactaaacatggcgagaataataagagatttgaaggtcctccagtggtactaaaatttttagtataaattttctagtaccggaagtaccgagagttatcaaattttataccagaaactataatagatggctgtaaaatcactcgaataataatgtacacatgacccggaattttcgtaactgcactatgaaatatgaataggccattctgtcgcataaataggaatttacagccatgtaatgagtactctgaaaccccaattgctggattacctacacaaccatacaggagaagattacatgcactgggctaattcatgtccttatgatcttatattcacaagaaagtttcagtttctgtatacccatcttcatccttggacagaaaaatatattattgaggccaactaaattgacacaatggaactaatccgtgggcacctcatgcaacaatagggtaggatgcgcaagtagcaatacctgcataatttatatcaagtcaatattgtgatgcagtgcaatatatccagcgtaacaaatgcgatatcagttcatcgtagccatggacgtcaatatggaaaacttaccgcacatgttcttgcccatttccatcttgaagtaaccattgtcaccccagtctgcaccccatgagttcttgatgagccagtagggaacgccattttcgacaccatagccaacggccagaacagcgtggttcacatcctagtagtagcattggaactcacaattcagggtataattggacagtaatcatacaaagaaaaactcgacacaaacaaatcaaatcatatactgaaaaatgagctagatctcttgtacactcaccattggagaagttccacaatggtcacttgtgtaaactccactcttgtacatcctgaaaccgttgatcacctgaaggcaacactaactggacgaacaagtccaacagcattcttcagctcatcctcagcacccttaccagagcaataaccaaaaaaagaggatcaataaatcagaacagtatattctagatgctcccatcaaactttacaacggggttccttaccagggtgatgttaacggagtccaaaaccttgactccaacgttttcaggcttgtaatgacagatgccattgacacccgtgtaagggtaagcctcttcagtgtcaaggccaccattgtatttgatgtactcaaaggcctgagatggtaggcctccactgcatccgaaattattgtatgcagtagcacaatcaaccagctgctgctcagaaagagagacaggcttcccagtggcctgagtatatgctgcctcaagagaaccagtggtgctgccagaataagttaaaggtcactcaaatgatctgattataggaccccccccccccacccgtgactttccttttttctactttgtctgctataattgaaatgaggcaccttttctacaacggtcacactatataaagttataatcgaaagtaacattccaggaacattttcaacataggtttgtcaattggtatgtgaagcatatttgccactatacttgtggagtagcaagaatatatgccaaatggacgaaaagtaacagaataaattcatgaaagacatatgataattgaattgtatgcttatttgagagtagtgacagatacctctccgtccaaaaaaaaaagtccaattctaacgataaatctggacacctatttttgggacggaggaagtacaagtcaaatagacaggagatatgaaaggctccattatcagcaaccgaaacagattatgcaagcagcactagaggggtgttcgtcactactgccggttccaactttcccctctcgttttctgctcgcacgcttttcaaactgctaaatggtgtgtttttttacaaaaagtttctatacaaaagttgcttaaaaaaatcatattgatctatttttttttaaaaaaatagctaatacttaattaatcacgcgctaatggaccgctccattttccgcgtgcaccgctcttggttgggaacctctagtagcgaacacaccctagttagacaataatgtcagattctccattattttattactcgcatgtcacacgagtgcaataatttaagtcccatgcttaacattttcaaatatttttgtaatcgtttctgtggtgaaagttctccagttctcacctactgtactcgagagttagcaatctccagcttaaccgacatactgatctgccagtccccattcaacgtagtttaaaactatttaccaaaaagcagcacaattggaaagtgcatccaccccgattactttcaagaccatgattgaatcagagtttgcgagtcctgacgccagacaagcagactccaactggtacttcctgtctggtaagatagccttttacacgtaatttcgaaagttcagttcaataattatcaaagcaacccccgtttgttagcacactttgccgtaacttttttttataggttcagtagttcagggaagatatttagaaaaatagcacggattctttctttttcgttcgatggattctattgttattagcacaacaggattaccaatacatgttgcacctcaaaagatagtactaagtaattttatcatccttaaaaaaatactactccctccgtcccataatataagggat

SEQ ID NO: 7946 - DNA, 38391 bp, Oryza sativa
aaaaaatttgaataagacgagtggtcaaacgttacaagcaaaaactcaaaatcccttatattgtaggacggagggagtagtagatatcagtatatcacactttgtagtataaaatttggtatctttaagttagtaaatacctcggggtaaaaaaaaattagtgtaaaatttaggtaccttgaggaccaaaatttctcaaattactactacagtttgcatctagaaaaatactcacacagtttgcaccagaaagtagttacctgaaggtccaacaggaaccacagtgaccctggtctttcacggggctcacgatcccatcctccctccagtctttctgcagtaactaaaacaatcaggaaaaaaagtcccccaaaattcagtgctaaaacgtacaaaatgcataacctgatgggaccgattagcatgcaaggacacagacacacagtgtatggcctgatcaagcgacccaataagcatgtaacgacacactgtatggccggatcaagcgacacaataagcatgcaaggaccacagtcttgcgagtatgaatgccatactctcacaactcacaatcgcacctacaaatacgggcagaaatgctgtacactacagttcaacccctcataaaaaaagatggatgatttctatttttcagaaaactaaccaggcatagcaggctcgttgttcgtatcagtaactacatcatgtgcagaggtcacagaagaaattaagtggtcattaaaaaatgttctttacggggtatagaagccgcgaccgcgaggacacagtaacacgtggtagggacagccaatcgaatcgagcgaacgctgcagcgatgagcaaagcaaatcttgctgttccttgcaaagcccagagttcagatcagaaattaaaaccctctccgagcctgatccccagctcacgcatggcggatgatgcaagaattccccaagaagcaattcccacatgtgtgtgtgtgtggctacctaccgttactaccacgttactacagtacagagctttggcacttacggtctccgggagagcggcggcgtcgcgcatccggtggttgccggcgagcgtcgccgagcagttctgcgccgcgccgagccggctcgcctggaactcctcccagctcatgtccgcgaaacctgcaaaagcaccgcgacgggggtgtgtgagaggaggattaggaggattaggaggcgctcggctcgaggtcctacggttgatgccgaggcggtaggggaggcccctccggttggtggagcggacgagctcgaggctctcggagaagatccggaaccgccgctgcacctccgccgcgtcgccgtacctcttcccatgcctgcgcgtaggacgagatcgaacgagaggtcaggacgacgaggaagacgaatggccgcggcggcggcggcggcggcagcggcggtggggtgggattagggggaaccgaacggggggggcggcgccgacctgacggcgaagcgggcgaagcggagggcgtcgcgggtgcggccgagggcggcgatgacggttgactcgagcgcggaggcggcgtggtccgtgacggagcggatcgggttggagtcgtcgaagccggaggacgcggcggcgacggcggaggtcgcggcgacggcggcggcggcgaggaggaggataatgcggcggtgggccatctcgccggcgaaggtgacgatatttttttactggttttggtgtgagagtggacagtgggggcaggaagcttggatggatctctgggttttatatagggcttcgcagccttgctggccactggtatgacttggataactttggttgcgtctttttctgcagttttgaaaatttcagttagctatatttgaaatccgattaattagaaacatatttactttcattatcattttacaacttcttgatctacagtatcatgtacattagcattgggatcatgcatctctgctgatttttttaatcagttattactttataaaaaacaattcctagctattaatctagacatatatatatatatatatatacatacatacatacatacatacatacatatatatatatatatatatacatacatatatatatatatatatacatatatatatatatatatatatacatatatatatatatatatgtccagattcgtagttaggattgattttttttttacggaagggtatatcacatgactgcgatagaaaaatatacagtgcacaagtatgcaacaggcacgtgctaagtaagcaatgggggaacccgtggatattccccaaaattttcatgaaaaaacataatatatgtaagtatattatactgtatatatttatattcgaatgtgcctaatacttctttttcctcaacaaattcactcctgcacttctagtaaccaactgtctcaaatctcctaacactagtgtaccagatacctctatacccacctaataaatactccatccgtcccataaaaaaaccaacctagtactgaatgtgacacattctagtactggatgtgacacattcgtttttttggatggagggagtattgtcgtgttcgccactgtaagtaagtaagagtgacccaccagtaaaatcaatttttgaaacagagaatgagaggaaggaagtacgcatctgtcgaaaaaaatgatccaacaactttggaactgaaaatcctctctgatatataaaaaaggcaaataaaattggtgttggaaagtcatgttcatgcatactacctccatcgaaaaaacaaacttaaaattaaatgcgacatatcatagtacaacaaatcatatccaatccagattcagatttttgtaggacggagggagcaaggttgtgttattccctttcttttctaactcatcttcatcttttcttacgtgtatgcttttcacgctgttaaacaatttgttttttacaaaaaaaaagttttctatagaaaagttgttttagaaaatcataataatttatttttaaaacttttagactaatatttaattaatcacgtattaataggtaacgctattttccgtgcagggaggctcccgaactcggccagaaacttgtttgcttttcaagtttccatctcctcttaaaaaattaagggctgtttggatcagggactaaaattttagtctatatcacattagatgtttggacactaattagaagtattaaactgcaatactactgctagcgttctgcatctgtataggtgaacatccaaatctgcagcggaggaaaggaaaggtacccatgggccatgacgccacgggtgacgccgatcgatcgatcgagacgcacgctccgccggcgctcgctgattggcctccagcgtccagcggaagcttcagacaaacacggcgcagaccatgcaccaatgcagtgctctctgctctgatattttcgttctgaagctgagctgagtgagtagccgatgccagagcgagacgggaacccatcgcgtcgtgattggctgagcagatgagatgcagatgcggttggaagaagaagaatggctggcagtccccgatacgacagcagtatgcatggagtcatggagatccgtctcgggcacttcacttcgatctgcaagtgtccaagattgcagctccatcccaaaataaatttatttatggtttcttcgatatttgactgtccactttatttaaaaaaatataaaaaaatcagcgtaaagtattatttatgttttattatctaataacaacaaaaatattaatcatgaaaaagatttaataagatgaacggttagatgtcgaacacaaaaatctataaataaacttattttaggatggacggtgtatatgcctttgtctgtgtgcatatgtggacagtatggaccctgaattcatgcagactaacggttcattggatcggctgcatagccgtttggtctttttctcaagagtttttgaaagcatgcggatcacttttgtttgtaggtgacggtatatatgatttcgttgtggccgttcttcagaacagaggcaaaagtgtcaccgttcttcagaacaaattaattagcaaaattaaaaaaggtctgagttacctagccaaaaaatcttaagtgggctcatgttttctagtggacgtggatatatgtagtaggagaattgtagtatagtaaatttctgtttccttttttttttgaacgtctttgcgtttgatttacgagatagagtatgttgaaacattgctacctagcagtaaaactgtgcaagtactagctatcatgaacagcagtgcactaattaatctgtatgaagacatcaacaacctcattgtttccctttccgttgtttagagtttgtgtttagccgccgtagttttctaagcttcagcttttttattttgatttttcttccttccgctagcataagtcggtctggctgattgcattgtgtaactaaaactcttttcttctaatatattgacgtgcaatccttttacgcgttcacgaaaacaacctcattgtttcgcttctatatatgctgataagctaaaaatttaattttagagttcattttatgggttttttcatcgtagtttattttatagcatttgctttcgaatctctaagaacatgtatataaaaattttaccgataaattatttgttagttgctaataagccgtaggaataagcataaacataagcgaaacaatatggctgtaagcatggccgtgtctttagtactggacggtgcatacctcaaaactcactgtaacccagtgatagatgtaattttaaaatatagatggggtggcatctagtaagaggctaatctggatagccctagttggatgatggtgcaacacacataaaccatagtcaccggctcatggcaccggcacaatggagaatggcacgaacatcaagcaagttaacaacgaagatttaacagttgaacaaatgccagagtcacatagacgaggcaatgagtatagtcataaagatgagacggcgatggaggcctcttgtcaggaatcaggtatgaaaatggtagaacccaacattattaatttaaatatgatttacaaaatttttatatctagaatgtccattttattctcccggagtatttcgttggataactaaacccctgaaatattttgttctcattttactccccccctaaactattaaaaaatggttttctttaatgcttaatagtatttctcttcttggtttctctttatactacttgtatgttaagtgttgtcgaaacgacaaccgcatacgtcgaaagacgtggttactcaacagtggttgaaaaaacgaagtgtattaaattttgaatttcactcgggatccccccgttacatggccctagggggctatttatagccctattacaggttcttactactagggtttaggttatacaggggaatttacatgattacccttacgaaagggacatttacaggggtacatgatgatataggggctcatgggcccctgatgggccgtctggcgatcacctgccctattgcccctaggcttgatgggccggaaaggcttcttcggccctcgcggaggcgaacttgccaagtcgaagtcgtcttccttcggcagatagtcttcgccttgcacccttcgcctgagacgcctctggcctggcaaggcactcgtacgactcttcgcctcgcgccgttcttgctccatagccttcgccatgggtttcagcagatttggtcgaagggcctcatgccatccgccaacattaagtataatttttttaagtcataaatgacaccattatcaaagtgtcagaatattttcaaaattcttaacaaaatattaaagaggtaggttataatagatctaccaatcctaccaaatttagtttatatacgggttatatatagagagagaaaatgagaaatattgttagggagtaaggtgaaccgccttcaatagttcagaggtgtaaaatgagctaaaaattatttaaggggttaagtgctctgttaaaatagtttgagtgagtaaagtagacttttttaatgtgtatttaccaattagctatttaatttagactttaatatggtactaaaataaataaaaataaaatcaaattttatataaggcctgaatcagaaaggatcaaaatggtaccttaatactcattcggtcgtgaatttcataaataattttatccctaattgaaatacttgatgtatcggatggtttgatagtgggatgatgactaatgtgttaatctaggtatgtgaagtggcactgattgtagccggactggcaaacccacgctacccaatcaataggtgtgtccgtccctcctgtatccttcttgagaagtctgcccctgcagctgtttccttcttgagaggacaggacgagagattcagattctttcggtgaatattcacatgacaagtgcctcaagagatctttacttatatactgcctccgtttgaaaagataggaaatttctagctatatgtttagataagttacttacaaagacgctggaacaaatgaattgatcagcttaagttttgaataagttagttggcataactcaaataataaaatggattcatcagcacagagatatttatcgtgtagcaactggcagcacaccatcactcagcatctggagacgatggctgcaataacaaatagacagcgaaacggagagagactttcaaggcaaaatattgttgccttcggagtgtcaagtgtcaacatcaacctattattccccgaaaaaaaaatcagcctattatttatttgccagaaaagaaaattcaatgtgtgttttcttgagaaggaaaaacacctaaagtatcacatgcgggaccaaaaaaaaaaagataatgttgtgtgcttacgcacgagatgtgggcaggctaatgccttatgacattgatcacagctaccggatttgatttgatttgcaatagcaaaccttcttagaatatgtattcacgtgtgtcgacaaatgtaggagattccatctcggttggtactggtacatcaagaaaatgtcagatatcaatagagaacactattttactttctccagtaaacctgcatgacattagccctactagctaattcatcattcttctaattttgtaaaatattattgctacagctacgaatgatgaattataatatcatttatctgaaatgacatatttatggcatgatcgaattaaccctaaattttgtaggttaacccatgcagctttgggcttttgccccatactttgtcggctgggtcggttggtcggcctagcctacccacatcccaattcacggcccatgtaagactaactgcaggattgggcccacaaaagaacggaaatcctctctcagttccttgtgctgcggcccacctattataccgaacgaaggcgacagggccgtagccatcggccgagcagagcgggctagcgaggaagcctatgtgggccagtgaatttcggcccaactactgttgcgacctgtatggcccaggcccgtttgatgcatcgcaaccatcggttgcgaactcgcgatcctgtaagtcaaccccctgtgctggatcgtgtaccgtacttgcggtccatgtccttgcagataggttacgctgtcagtttagtcactgcaggccatgcttaccttgtggttcagatacgcccgtgtccgtgcgtgtgttaactgtcggtcactcgtttcttccgttcatccataagcatcatgtaagcaagcgtgtcacattctccaaattgagcttaatgatttcattaatcgcaagaaaaaactcgcccatcagtcataaatttaaagctcaacgcataactatctcatttcccatgtgcaagaacatttttctccccatgctctgaagtctgaacttcttctatttgcaggtgaaggcgtccaaaaaaattaataataaaattcagaagcaaaagaattgcatccaatctctgaatgactgaatccgccgtccatgcttggtatggtaagattaatcgaaaaccttaccaatccctttcacgatccacgtatccgtttgagtttttacggcgtgtgagacgcagaggtttccgtcgttttcgtctcacctaacctaatactgctgcttcagagttcagaccggacaaagattgaccgtgaaagtccagtccataggttgctaaagtatgcgttttgtgaaggtcatcagtttcgtgttctccttgtatggcggcgcgatcgatcattggcgtcattctatcttcagaactcgcgtaatccttcatcagttggtttcagtttttgccaaatgatccgtcactcgtgaaatttaccagtcacagcagtacagcacagtggtttcctgctgatcagatcattttttctagcaaacagataacttagatctcaaataacccaatctgaaattcgttcatatgaagatttaaactcaggactacttagccctcaaataattaaatctgaaattcgctcctatagagatttgaactcgggatcttagggtgctactcaggtcactgtaaccactaggcacagcagtacagctcagatcatttggaagaagaggaaatgaatcaacagtgacaacatttaattgaaaaaaaaatcagcacgaggcacaggaggaaattgaatcgattgacagtgagaacgtttaaaaattgacaaatttgcaggaggccgggcgctcgacgactgaattcgtcaatgagttatgagctcctaatcactagctctgacttgcacgctccatttgcacaactagctagttcatatgcttccggctccactaatccgctaaaagcaacagacgcgatcaagcaaagacggctgacctgggagtaaactcagcatgctgtcacgcccccgatcgcaaccagcggcgcgtgcaaatcgagccggaaaactgctgcaaggacagagacgatctcgtatatattcttttcttttgtcaatttgggcgcagggagagacacctatccatctacctgcagctgcaacttggtcagttcgttcaccacaggccggcgatctgctgtggttttcgttgtggactatgaaacttttgcacaagtcgcgtgttctgagctgactaaaaaaaaatggctcttgcatcggatattcttttttatttgtatatcatctggtcgcccaactacacgcacggcaatgctcgtaaatatcgtgaggctaatcaagctggtttcagggttaattaaccataacaagtacggttgcatcatgagcacgtgataaatcgtatataacaaattaagcagcatcaccacttgggtaagctgtttagtctctgattaattagaaaggtgcgaaaaaagatagagggaccatatactgtggccaagttgacatcttttttgcgcactgatttcgcatttctgtggttctgcatgccctaaaaagttatctcgactggagaagaagcagtctggatagctgactccattaagaacggcgagctgggtgattaaagagggattgcccagctcatgaaagcatgatgtagcatctggtcgaatggttgatccccccttgatcatcttgcttttttgctatggacctcgtgtcgtgtcaccacagtgccaaacgtgctaaattattacgagaaagcaacgcgattaattagctcgtttcgttccgagcaaggagactggctatgctactgtatgtgtgttcatcacagaagaaacatatatatgtgtgtccgtcacacacaagaaacatatatatagtccctccacagttataaataactgtcactattgatcagtacagttttaactttaaccataattcttttgaatgaatagatcatgacgtgtttttaaaatgaatagatcatgatgtgcgattgtttcatgactatattttaagatgtaacactccttgttaatatgatatacttttaacttttaattattttatacaatttttttaaaaaaaaggcggttaaagtttgaagataacagtatccggtgacaaatattttgacaatagaggaactatgtgatgtgcatacatacgtgtgggtgatttcaccagcacagttgcaagagtagtagtgcacactttgatgaacataaaagtctgaaagataatattttatttcttcttttttccatcgtaagaagccatttggcgggccagtcaacatgtacacgtcaccagagttggcaggaaaaatatctgtctattttatgaggtatctagcagctgatggtcggttgacaatgatgcatatatattggtgctaaaacttaataaactaccaatcagaaaagcgtatgctgcatgcatgtatgtactagcgaacccctagatatataaaacatattgtactagctagataagaaagaatcaaatcaaaaccgcctcaactcgaaacagggcgagagtacgtgggcgacaggaatatatccagtcctttttatccacacatcttcagaaacacagttcatcctgatatcaatatcagctgaagcacctcaggttgattagttttatggatttgatgtgttcctgggaatgtttttagtcaactccccatcaatcaaataggctaatttttttttgtcaacttatcagcctacaaggtagcaacgcaatgcatacataatgaatccatacatccagtagttgttaacaacaacgaaatactacatcagtaatactccatatgcagtatgggaaaaaagaacattaattgatctctagaagaagtagacggcctaataattaatttcttaagcctctcactccttgagcctctgttacatctatcttacgtatgcaggcaagttagaatgcggctggtcaagatggtgaatgcatatgcatcatgcatgatatattccaagtctccgtaccatttctcctgcgttaattcctcctaattactcgtaaaatcattttcaagatgatgaactggtgatgccatcctttcgtaaacttctgatgtgatttaccctctccaagaaaaactcaacgaagtctgcacatatacagtactctcttttaattatcactaccagtatgtcttaatgatccactactcaaagccttaaatttcacgccatgaaagagatttctttctccacggcgattttttggtctccacagatacagatatttcagtacccaatctgacgcgacaaagacgttatccagacgtcgtacgacgatttgtacttacacgtaagattaatctgcagatgagaggagcatatgcatcgatcggcttctcttctgaagactcttctgaaaattggatgtcacgtacatactacgtgaactgtgctgagaatattaccactcttggaagttctcctgatgcacgtatctcagattgggaataagttgagtatagaggataataagattgatgatgatttgcgaggaaatcgatcgattacctaacgcaaggcatggccaataaaccctaataaatgaacgagatcgaaaaggatgtccaagatatttgggttaggatatactgttaactactgtacataggtatggattttggggatatttttgggcgattatcttgaagaattgacagaaattagtaaggacgacggcgactaggttgatataagcgatgatgttaatcgcagtgtgagatctgaataagtaatggactgatcggcaacttggaggatcggcgaggcagacatgaagtacatatcgcggtacagaggtagctgcaagtttgtccaccgcattggttgatgactttgatctcggtgcaccacccaacgtcagaaatagactaccatgggtggagaaaaacacgttgctaattaattattcactaatgatgttcttccggaaaaattaattaactgatgatgatttcgtgaaggagttgatcgactctcggatagtcgctgaaaatcatgcgtgcataaaaagtccgagcaaatggaaagaaggaaagaaaatgaaatttatactgagcaaccgtgtcggtcatcgcctatcatcaaccacaccctgcacgtccaggtgcctcgtccctgatgcatccacctggcgagccatatctttatctagagaactattaatttacaaccctgttttgaaaaattccaaaacgagatattgtaaataaaaaaaatattggatttaaggtccatgaacaactgaacagtgattctagatgttagattctttttcacacttcccaagctcctaaataatacgttttataaaatattttttctaaagcaactgttcaacatattactagttaattcatctgtttatagtttcaaatagctataaaaataagcgtattcatcaatttcagttatcttaaatggggcctagcggtggatcctggtaataaaactttcagattttgttgtgaatttagcggagatctgttcaaatttcaaaatttctcaaggaaattcctcccaaatttaaaagcctctgtggcactcgccctagagcccaactgacccacgcgcaaaatctgcgcgctttttgtgtttgtgcgcgcgccctcatgcacgttcgctagctgcaccgcacgaccacacccccggcccgaccgcccgacccgacagcgacgacgacatcgctcggacggcgggccggacggcgccccggaggccacgtcgcccaacagcgagaccccggccgcttccaccgttccacgtgacgcgcccccgttcggcgcgcgcgccgcgagcggatgacgcatccaccgagatatcgcaagagcgattgtgaaccgcgtcgaggtctcacgctctcacacctgttgccgctgctgccgcagcgcacgcgcgcgcgcacgtacgtacgcgccggtgttgatgcggctgcggcttttttttgcctgcccttttacgccggcgcccacagcgccccgcccaccacacgtgtctccactcgctcgcctcaaactcgatcgcgcgtccgcggccacgtcgccgcggcagtggcagcgacgcccgaaccgacgaccgcgttagtacgtagtacaacgttgtcccgcaccgcgacatgtgtggtttcgttttcttttccggatggttgacccgatcctcgtcggcggccggtgtcgctgcgttgctcgtgcgatgcgacgccgacgacgccgtcggccgcttgagggattcggtgaaccgcggtggctggaggggggcgcgttacaggtgggcgtgggtacgtacgtggcgagctcttgcttctttgggaagagttgaatccctctgaattattgtgatctgccgtttcctggatcctttgtcaggcgtcagcatttgtgtttcttccgtttggccggtgcatccatctatccgtcatatccattgttggtgagagtgcaaaggttgacgtacaaatccatcaacaaatctggtcccatgcatgacgaaactgtacagtgcaaagtccagcgtgcgtgatgatcgtggctaacgtttaccataatcttttggagtgtaaccaagcatggtatgctttactgttgcaggaagacaaaaaaaaaaaaggcaaaacatgtcaccaaccaaacgtaaaattcccattaattgcactatatatgaagggttaactttttggaaaaaaaagaaatatatgtatttacacgttatatatgagggaagtagaagaagcatctagaagtggatatatacacagaaatgagtaaatgacacgaacaacgtacaatccaatccttcagggcgtgatctcaacctcatggtgataatcatttctattttaattaggacaccagatgagttgtgcaaccaagagactgaattccacgtcaggacgtttctttcatcacttgggcaagaaaaaccttgtggtttctgtcccgtttccttcagttttccccaagaagtttcaggaataaactaaataatcctctgtatcaggaagaggatagcaccgattagaataatctggtccgatgtgcacgcttcatttacaaacgtgtaagtatgcaaccgcctgaagatctttggagaaaattgaattgatcaaatggacggacaagacagctccgacacctaaacacagactgtttgggatggccccataattcaattgtctctgtagcaatcgacagcatgttctcctccctttggcctataattcatcagagaatttgtttgtggggtagttcagatacggtattgggcactcagatgcaatgtctttgggaacagaacagacgaacaattttcagtccctttcgttcagagaaggatataaaattagaaagatcctggaagcaaccaaagcagaagcatcaggttctagtagcaagtagcaagcagacgacacagagtcacagattgactgatagtatactgcacgtggacgatatacttctgtacttgcaaatgcaactcttctgtacttgatagttttggctgaagcccatgggaaaggagccaaagatctgctggaatcaaattcctctgcgctgcaactagtattaagcagcaaactagagcttctttttttttacacccaaactagagctattagtagtacttgtcctagcttctagtaatctaattagcctcctaaattcacctagggattagccttggaccattttgcaactgaagggcgtggatgactgagattgcttgtgagattattgtgatgttaacactacatcgccacgtgtcatcgtcttgttggatggggccccacctctctcgttttaacttataagccacctcggttagtatccacaaagtcaagttggagagtatcatatgcggttgtgcacaccaagcagcaagcaccaaaagttggagtctcgtaggacgtatggatggttaaccataaagctacttgaataaccaaataaaggtgcctttactaaggagagatcaaatccacggctgatgtcgtcgtgaaaaccacctgtaacaaaataagaacaatcctttttaatatttaagttattatcggtgccattcatcatcaactgtcatcagtccattcacatagaagggctcgttttaaccataatatttctcctaccgactaccagccactcatcgaacaaatccacaacacatactacgcgcgaccgctgataagatatcacggcgcggcggtttttatggagcggctcaactaactatcaaatatttatatatttttatattaagtgaagtaccaatattttctctttcttcttcttgctctcaactattgttttgaagtatgtgtagacaagttacaataaatattgattccacatacaaataaagaaaaaactaggttcaacaagtaataacgtaatagtataatagtggatagattcattcaagttcggataagcccctcacagtcctaattccatagttttaaaaatttgggtcaatttgatcagaaatgtaaacaaacaaccctggtttgaggattgccaccccaccaacaaccctctatcgtactagtctaatagaccagtattgtcttgttccatgtcccccctacttcccctgtttgcggctatcacatcaacccgcggtttttgccgcgaaccgcaatccgcccgtgcggcagccatggcgtcgcccacacttataaaagggccctgcctctccagctttccctcctcaaggctcacctcctcctcttccctctccggcatctccatctctcagctcctctgctagctcgagctgctcttcccggatcctagccacatttcttggttctgatctctctcgggttgttttgaaattttctttggttcaattgccatggccgcgcaatcttggaggtccttcatgtgctgcggcggcggcgctgccgtccacgacgacgacgactcggcgccgaggcggcggaggatcgcgcgcaggggggacagcccgaggtcgtcgtcgaggatgtcgttcacgagcctcagctcgtcggggacgctgtcgccggaggacctgtcgctgacgctgtccggctcgaacctgtacgccttcacctacgccgagctccgcgccgcgacgggcagcttctcccgcgccaactacctcggctgcggcgggttcggccccgtctacaagggcgccgtcgacgacggcctccgcccgggcctcgccgcgcaggacgtcgccgtcaagtacctcgacctggactgcggcacgcagggccacaaggagtggctggtgagtgcgaaacagagcgttcttggcaatgcaccagctcgatcgatcagatgataatcgaacacaattcagctaattgaatccacctaattgaattgcggatttgggtttgttcatgtaggccgaggtgttcttccttgggcagctgaggcacaagaacctggtgaaattgattggttactgctatgaagccgagcatcggatgctggtgtacgagtacatgagcggcgagagcttggagaagcatctcttcaaaagtgagtccttgtctttcaacttgaatcaggttgatttggtcgaatttgagagtacagtagttttttgagaccaaaaagttaaaaaaggagtacccaattccacatcttttcgtaaataaagaaagagggagtacgcaacttagaaatttgagcacgtatgggtgacatatggtcgtccacttacgatgagctgttcctgtctccctgcctttagttcctcccttttttctcccttttctcaaagtcaaggtctctaggtgagctgttatatgactcaacaaatataaaaactcatgtttcttttcaaaaaaaaaaactcatgtgtttttattaggtggtcacattttgtcaaaaaaaaaacagcttgttgaacaatgtggaggaggaaactgacttgaaacatatttatctcctgcagctgtcaatggttctcttccatggatgacaaggatgaagattgccctcggcgcggcgaaaggcctcgcattcctccatgatgccgatccgccggtgatctaccgcgatttcaaggcatccaacatcttacttgacctggtgagccaccctacaattcagttccaatgtagtgtaattgttattcatttattccaatggtagattagaacttacagttcaaagttcaaacaccacattgtcaagaaatgacacggtttctgaaatgtccctttcatttgggaacagtaagttcagttaccaacaaatggggtcagtcaggcagcacacgtcacttctggatgaatgcgaaattagtaaatgtttggggcccaaattcaaggctgccacaaacaaccttcgcaaaaaatgacttcattttttgatcgagaatttaaactttttgaccaattgaatcattccaatgaccgtgcaaaaatatccagctgcgccacacgtttctgaactatgcttgcagtggcccagttcgttatgggcaaaagccttgacttggctgattagaactttggaagatgcatgccaaacttcagaaatcctagcaatcctgccctcacatcattcacctaatcaaaaatatctagccgtcattatccacctcacccaagtagcccacggattattaatacatgaatagctttgcaagtgatatcttgatatcccacttccattcacattactaaatctcaacttgtgtgttttcaggattacaataccaagctgtccgactttggcctagctaaggatgggccccagggtgacgctacgcacgtaacgacacgtgtcatgggaacacatggatatgcagctcctgagtacatcatgacggggcatttaacagctaagagcgatgtgtatagttttggagtggtattgttggaacttctctcggggcgaaagtcagtggaccgctctcgacgcccgagagaacaaagcctggtggattgggctagaccatacctcaagtgggccgataaattgtacaaggttatggaccctgctctcgagtgccagtactcgtgccagggtgctgaggtggcggcattggtggcgtacaagtgtctgagtgagaaccctaagtccaggcccacaatgagggaggttgtcaaagccctggagcctgtgcttggcatggatgacttcttcccagttggcccatttgtcttcactgtcattgtggaggacgagaaggtggttaacatgaaggtggacatgaaggttgaggttgaggagaagaaaaacactcaccaaaaccatcaggacaggcatcgacagaagtacccagactcggcgattcacgctggcattgtgctgcatgaccgtgatggtgtcatcggaggagggtacaccggtgcgctgcgacgacaccggaggacggcgagctacaacaaggagaggggagcataggaatagaggtggggaacagagtaggagaaaaaggtcatgcatgtacatatgctggtgagggtgtggcagaatgccacatttgattgggtttagtttttggtgttgtcattttttagctttcttcttgatggtgacagtgggtgggtgtaagataatacaggaatgcaaaatagtgtgatgaaaagttaggcttggatttgcaaggattgttggatgttgtacgcaatcaaatggtctagttaaaaggatgccccatgcttctttttttttttttgccccttttcgttttcggtttatattggcaagtgtttgcaattgaaactgagaatccgaaaatataaaagaaagacagcaaactataaaatgtgataaaattgacactgtcaaaagttcttttctttgatgaagacattttcacaagacataagttgatgttgatgagtggattaacgacggcctcacatgaccccaattacccatcgtcaataacctatctaggccggggccgagggctgacacatcaacgattaatcatactgttacatcatcatttatctgaagaatttactgttcgctatctacactgaacccagttcagtctaaactacttaatttgttcgagacttcgaatcatatacagatcggtaatatcagtggaaagaagcttctattaacttattaaattaatagaagaaggagcatccacgtttgctttcatggtgtagaaatttttatattaatcggagaaaaaaaaatagagttcatatggaaataaaatttaaaaatagtacaaattcgaaattaaaaaataagaaatattgaagagcaaactagagtccatataagtaacttattaaagtgatagaaaatgagcctacacattcactctcatgatctagaaactcttatattaatcgaagaaaaaaaatagtgcccatatagaaattaaatttaaaaatagtataaattcggaattaaaaaataaggaatattagaaggggagactagagtcgtagaggtgtacaatttagagctaattaaaattcggaattttaaaaaataagaaaactaaaagtagatgttagagtccatataaaaatacaactttgaaataacaaaaattctaaattaaaaaagaaatattaaaaaagtgtctacagtccataattccatatatgaatataagttagaaataaataaaattaagaattaaaaaaaggaatattgaaagatgagtttagagtccatatagaaatacaaattataaataataaaaatttagaataaaaaagaatattgaaagaaaagtctagaatatgtataggaatttagaattaattgtaaataaaaaaattaaaagtaaagtttagagttcaatagagatacaagttagaaagaattaaaattctaaataaaaaaagaaaattgggagaagagtatacagtctacataagaaatttagaaataactgaaatttagaattaagaaaaaagaaatattagaagaagaacgtagagttcatacagtaatacaattttaaaaaataactaaaatttggaattaaaaatgaaatatcgaaagaagagggtagagtacatatagaaatcttatttataaataacataaattcggaataaagaaaaaattattagaacagagtttagagtccatattggaatgctccctccttcaaaaaatctaagacctatttcattctttggtttctccaaaaatctgagtcctatttgtagtctccatgtgctaaattaaattgatgatcggaaaccaagaaactattctactacatattggttgtatgttcattggttttgccacagggtgagtgagttaattgcttcttggttttgatgaaaaagaaataggtctcagatttttggaaggagggagtataatttagaaataaacaaaatttaggatttaaaaataaggaatatattatatctctactattataaaaattgaaatgtttttgccggtattttggtacgtcatccataaatgagtcggttttaaagttcgtttgcttttggaactacatatccgtatttgagtcggtttttaagataattcacttttagtaatacagaaggaatcatataagaaatatgtttaaaaaaactcacatgctaacttgagacgatcatccgtgtttgtgttggttacaaaatatgaaaatgtttccacggttcgtcatccgtgtttgagtcggttttaattttatgttttggttttaatctatatcttttctctactattataaaaattaaagatatttttaccggtattttggtatgtcatctgtctatgagtcggtttttaagttcatttgattttggaaatatatatccgtatttgagttggttcttaagatcgttcacttttgataatacagaaggaatcatataagaaatctgtttaaaaaaactcgcatgctaacttgagacgatcgggctcctaactgcgctcccacaatgaatttatcttaactaaaccatttaacaataataaaattaaaatatacttcacccgttgcaacgtacggatattttttctagtattattaaaaatgaatatttaaagaagggttcaaaaaaatataatttaaaaataattaaaattttaattaaataataattaataactatcacgtatatataatataatatgaatattacacattgtgattagtttggtcaagttagtatataatttaaaattatgatgctatttaatatattttaataataaaatgtgaacacatatatgctgtcatgtgagaaaaaaaatataatgatgtaagctgcccaatctacactggtcaccatactagttagcgaaaaacaaaaatttaccttcatctgctcgattccattccgaaaacagcccagacaccgttgaggtgctcgtcctggatcagggctatgtttagttcagcgcaaagtttgtattttggttgaaattggagatgatgtgattgaaaagttgtgtgtgtatgacaagttgatatgatggaaaaggactaaagtttggatcaaactttcgatctaaacacaagtcctgaacggaggcggagaagcacgactccagtggatcgcccgcgaggggcacgccgccgcgatctcccgctcctctccggcgcgatcgccggttcgccgttgcagatcgaggaggagagagaaacccaccgcgtttcgagtttcgactggggtcggagactcggagaaaagcgtggggagggtcggagggacgcacgtgacgaacattgcaggatgtagaggcccagtagagaagagcagcccaactgcccaagcgatattttaggcccattactgacggcccatactggatccaattcccgtcggcctcgttgtcgtgggccggtgtcgccgctggacttccctccgggaaagggacaacggagtccggttggaatcggatacggtttcccagtcagatcagataaaaggcagcaacaggctaatcccagggatgattagtcgatcgacagatccatccatggagagcggaggcgacgccggcgatcggcggtggccggagtcgcaggggaacgaagagaagtcacaggttcctagctccctcgatccaaacaacacggaggatgaacaccaggaggagaacaactcggaggacgaggaagaagagcaagaggaattcttgtacgaaatcgatgacgaccactatgtgccggaaacctacggcttcatgggctgcaagcacagcgacggatccatctacaggcccgactcccacccattccaccgccactaccgcctgggcgacacccgcgagactcgcctgtggcccaaaaggctgacgagtccgaccgatcgttgccgcccatgctggaacgcttgtgaggtacacgtcggctgccgcatgatgcaaatcttctccgtcaagatagcagctctgtccgccgccgccgatgacaacagcggcgctccggttcagatctacggcttcatggctgccagggacctatatgaaccactgcgtaactatgtcttcaaccgcagccgggatgatcccttcgttctgcccggccactactccgatcccgattcgctcataaaaatgtcgggccctaagcgaggcatctcgctgcaaaaccctgccttgatcgagtacgacctcaagatcaagaaaggggaggaggaaaaggatgacttgtagctcatcgacggggtgaccagcttcagcgaccttacaccattccacggggtgtatagccggcggatccatggcatccatggcaccgtagatatcagcttagcacttatccgcgatgggaaggaaggcactatacaagtcaggattctgaggctaataaatgacggcatacacctatccctctcttgcttagtccaccaaatacctgaggaaatcaagctcttcgatggcatcgttgctaagccatcatatctcggtgactttgtggttgccgcacccctacgcactgtgctaattctggatttcaagattacgccggtgggtgcggcggtggctgtcagcaaaaatgatgactccaagcatatccgtcgcttctgcaacttcaaggttaccgctcatttaggtactattgaacgaatccaccatgatttcgcaactatagatacggtgcttcagtgatcgaatttgatggagtaattcactagactagtggtgcttttgtcccctctgttcgtttcatcaattcggcatgtcatttaatcctcggaatattatctctaaaggactcatgacgaattttatcttcagcctgacaagtactatctccgtactatacaattggtcgactcacaaaatattattttagttaatccctgggattagcctgttgctgcctttttatttgatatgatgattgggaaaccgtatccgattccgtttcccggttttacaggactcgcttttattttcaattcctttgatgattggattaccacgtcagtatacttggaccaaaggcaacctgccacatcggcaaaaccgctttcaaaatcactggataagtcaatttgtatccgtttttgaagttgggagacgttatatctggttctgcggttgaagcctgagggatgtgattgaccgagggaagatataagggatgcacatagatttattcctatccacttcctgtctgtatcagggccgaatcaacagccgacacttcttggcgtcgtactttcggtccatatactagaaaataacacgcggcgttgccacgtgcaacactcgatgggccacgctatttgaccctattgagacataatgatcagtgcactgcaagttatagcaaaatactatattgcacatcatgattattgtagcagagtaaaaaacgtgaatattaagaaattgcctaataccaaataaatagaaggggtgaggctgcgaacccagatcagctagcccaccatcttgtggagctagccgaaaaacccctaggcgtttctcattgtagcagagtactaaatttaaaagattaatttatgaaactacagaacaaaacactgtggctatttatatacaaagattacttaacataagaactggaagtttgtaacactcatttgaagagtatgggttggtttggtttgagatctaaataggccttaccaaaatttgacaatgccaaattttggcaagttttgcatgactaattttggtaaggtaaagttgtgtttggattgaagccaaaatagcctaagttcactattgaaatggcctattttcttaggcatgccaaaatttggcttcaaaccaaatagacactaaacactattgaaattgtcaaatattggtaagcctaatttaggccttaaaccaaaccagccttatgtaacatattatagacatttgatctagagcttaaataatggaagattttaataaagctccatgtcaattttgcattagagtaattggcgagtaaatgagtccaagttcttgtcagtgctagatacaccaaaagtaaattggcttgtagatgagaagataacaagtgtccatcttggactctaaatagtaaaagtaggctatcttgattagagaagttatcaagtagaacgcttctttttatcctttatctgaatgaagccgtagtcagtgttttttccttcatcattttatatcactaatacatgtgattgcaggtcattgacctcgtcctcggcggtgcaggacgtgctcgccgcagaggtactggccacatcaggttccatatttactccaacgtaagaagattcgtgtcccttccggagacatcaggtggctttgcagtttttcattttactccaacgtaaaattgttttttatattttagtcctttttaagtgtgggagtgctgaaccacgccatgtcacgtgacaccgctaatcgttcgataatttgcatggatttcaatattagagatataggcctaccgtcgttgacgggccgaatttgccgggcggcgtggtgaagcaacggcggaaataaaaacattgagctcgcaaagctggctgacaggtgggaccccggctgtcctcgccgtcgcgcagcaaaagtcctcgcgaaacggcagccaattcgacctcaccctgtcagaaaaattattcagcgtgtatggctccatatcttcacggtctattggcgcttcaatggttcaacctcgtctcatagctatgaaaaatccttgaaatcatcatttctttacaggataaacaccatatatttatgaaagttcgaacttaatcaaaggcctaacaactaaaaaatacaagaaaaacaacaaccaaaaaaggatctagatcaacataagcaaccactgagacagcatgggttacgacaccgtgggcatcgacaaccctctgtacaattcttgcaagaccagacacacccacaggaacattcagggcacgacggtttcgggaggctgcagcagtgtccctcgcagcaggaaggctgcccctcgcagcaagacgactggcacttgcagcacgaaggctgccgcttgcagcatgacgactggcagctgaagcactgcgtcgtgcaggggcacttgcacaggctcgagcagcagccagcgcaggagcatttgaagatgttgaagcagctggagcaacgagggcacgagcaggagaagcagtccgcgcagcggcagcactgctcgccgcagcagccgttgcagcttggcttgcagctacagcaattggtagagcacgagccacaatcgggtttgcattgggcgcaagagcacgagccgcagccgttgcaaccgcagcttggaaggccacagccgttgcaaccgcagcttggacagccacaaccgttgcatccgcagcttggacagccacagccgttgcatccacagcttggacaggcacagcccttgcagctacagcttggaagggtgcaagtgcagcaattggggctagagcagttgcactgggacttgaagcatgaagggatcttgaagcagctgtacagggatttgaagcatgaaaagatgttgaagcaggtgcagctcggtttgcagcacgatgtatcgcagcatgagctgcagcttggacaggagcacgagcagttcggtttgcagcaagaaggggtcttgcagcaactgcagttaggtttacagcatgagcagcagtctggactacagcatgacccagcgcagcacgcactgcagtttggcttacagcatggctcgtcgcagcatgagctgcaagaacaattgaggcaccttggtcttttgcacttgggtgagcacttgcaacagtagcaaagacatgaaatgcagatacacaattttgatctgcagggaaaatattttcaccatgtaaaagctcagtttggcagtagtacagattattatgccaaagtttctacatgtaatttcagccgcaaaaaaatcaatgttaatgtaaaaaagcactagtttttccttttttagttttagataacaaagatgattacatccctggactagtttgctttttaaaatgcgtcaataatattaatgtggcatatagaaaactactgcttgtttattgacttttaacatacaaagggactagaggcactttcagactttcaattccaatagtgacgaatgcttttttttcgagggaaatagtgatgaatgttgaatccaacagaaaacattatagatatttgaatgttcttgcccctcagaacctgcgagcaaactatattggatcaaaacatacccgatccaccgaaaaagacggcaagatctgtgcctccttctctttctggaaaaggaaaaaacaatgtcaaaactcgtaaataaacagcgaacatgcttaaaatgggggaactgaaagtttagaggccatacgttggtattagtgggtcatgttttgtaccaacaaactcatttatcctgacaagtaatgtaagaggacattagcaacctgcaaaaggacataacttgtagtaatgaatacaaagtatagtccattgctcagacatttatatttgctttcactacagtcatgtgtccctcaatttgagcacacatgttcaaaacttcaaatgcgatatcggaatattacataattccaccacaaatatacaatgttaagctaacgtgataggttacttgttaaaaataatctgctttcattttttaaattgaataagaatatgtgcacatcgcatggaaagaatcggtgaaacaaatctcaggactgtgagctgtaatatggaactcaagcaaagaggacgtcatactactgttcaatatatttagttcaatataatttttttcaaattgttggaccagtgggccacaaaataataactgaggcagagttataggcaccactaggaacgttatgatgcaggtggggctgtttgataagtagctgtcaagacagcagttttaagaatttctgtaatggtacaagtacatatgcatttcaaacaagacttcaatgctggtttcctttttctttttcatcccaaggtaattttaacatatggtgatttgctaaggccctgtttagatccatttgaaatagcaaatggcaaatggcaaaagttttggtggcaaaagttttagtattgtaaaagtactagttggtgtttagatgcatcctaaacttttaccattctagcactaaagtgagagagagaaagaaagagagagtggttccaaagcactttttggcacaatttgctactatagactagcaaatgccaaatgccaaattgccaagttttgttactagtgtttagatccaaaatggcaaaaggttcttcaaaatggcaaactgccattttggaggatctaaacagggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccaaatctgcggttaaaacttaaaacccattaatcaaagcctggagtaattgaccagtacgaacggtcccataaagattcctgctttactgtgtaagtgtaactttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaaccatggtggcagcccataacaccaacacggcaccacccatcgtgcaaagccctcatggccatgccgtctgcacgtccagtgtcgacgaagcaatggcggagatagacacgtccactgctatggctctccctgacaaggccactcaggtcagttgtccatgcccacgctcttcttttctccaacgaggagcccaaccaaacaacgacaaaggtagtacagccatggcgccacgcccaaagagggccaagcttgtctcgccagcctcggattgatggcgccgtgattcacctccgcctagaaacagtactacaagtactagaatagcactagctaccgcaattaacaacgccattactgtacacttcacagcatcctacttgcagtagcgggtagctccgtactcggccgcttgggttttgaaaaatgcgcggcgaatcggatctccttttttttaaaattaatcggtaaagtcaaaggaagacgaagcaagtagagctcgggccccgagaatttcgagcgagcgagtgtgaaagagaaacctatagagaaaaacgcagccgccgccgccgcggggcgctcaccttgaggaacgtgatctcgcggctcaggatctgcacctccagctgcatccgccgccggccgcacaggtccgggtacctcggcggcgacttgggcctcggcgcctccatcaccaccgcctcctcccccatctccacacgcagcacgccaacggccaactcagaaccacccctcgccgccttcactcatgggcattatagcagcagcagggggcgtggtgggtataaatcgccgcggcgagcggggggacaggggacagcgcgggcgcagccgtgcagcagcggggtgggggagcgagcgagcgagctggcgtacgaggcggatcgagctagcggcacggcacggcgcgcgcgcccgtgcgaggtgatgcgatgcgatgcgatgaggaggacccccatatagcagcgagcgtgagcgagaggaaggatggtggcctgcgtctgcgcgggcaataatagcagcggagatggagaggaggaggcggcgacgcggcgtgcgtggggtttggagagagaaagagagagagggaagagagagttcaacagcgagcggggggtggggttttgtgtctgtgggctttgttccactgcgacgtgggcccgagcctacgttggatacgctgtcgccgggccgtctcgagggatggatcatggctgcgtgggcccggtacttctccggtatggggccatgattccccagaccatgcaaagccgatccttcgtcccgtggtacagggatgaaatcacgcgttattttttgcacagttcaaattgcaaatcaaataggggaaataccatggactcttccagccccctttgccaatttgtttggattggcaaaaactacacacaaacacaaacagcacccccacccacgttccttgagctaaactccgggaagactgatgtgtgcaaagacagggcagtggtggtaccacagtaccactcctttcatcgcaagtttgtaccaactccgcattgactgccgcgtcctgagacggcacgtacagttgccgagcgagcgtgacggtgcctgcacgagatatatggcgatatggctatggccgcatcccgagcgcggagtacgtacgaaatgaaacagcaagggaataaattgagcagccggcagcgatggccggctttgacagggacgcgaccgaggtatgcgacgacgacgtacggctcgacgccctcccctcccccccgcgcagcggcaaccgcgagcggacaagcttccccggtgacacgtctacatcggtctcgcgtgccgggccggccccgcgcgtcagtcgtgataccgcggccgcgaccgcgatggatcgaaatgcccagtgccagcgagacgtgcagcgcggggtttggattgggggagcagggttgcggtgggccagagacggtcagcgacgcccccgtaccgtggcacgtgatggggtcgccccacgcgcgcagttacggtggagtggagtggaacgtcccgttgaaatgggtgtactagagtagccacgccgtccgatttgaaacgagttattaatgtgggcactcctctatcccttccactgccgcgctttctactactaccaccactgctgctactgcctactccgggtagagctgatagcgcgccgctgctaccccgggtagtatgcgtagtaactgtagtcacgaactggccatgcaggcagccagcgttcagttgagctcagcacgggcaggcggccaacttcccttctgcaaacagcatgcactgatgcacacatgaagatcgtataaaattgcactgcgacgacgtgccggtgtataggactagtgaatttgatgctactcctaccttaaactgggctctcagagtctcattcactgcatatgcgattcattttagctgtgtgacgggaggaacggcaggagagagtcgaggacggggggcgccaacgttcgactgtaccgtgggcctgcgacaggccggaacgtcacctgagcgctcatcggggaatctgggcccaactggagctttcccgggcccatgcgaggatggagccgtctgttcgctgggccctcgccgacgtggactggtcacaggagcgtgcaaatgggcccgtctcgcgcgcgacgacgacgccaccgaccgggaacggctcactgagagacgtgcgccggtcagggccggcagctggagctgcacgtcgcgcgcggttagcgtggcggattcacgtggactcgtgggcctcgccggtcgacgacgcccagtcacccgctaatcaccagcgcaggttttgtactagtgtacagtctcttctcttttttttttcttttcgaacggctaatttgctgtcatgcgttaggtctcctctcacaatcaccatttgatagagacggactgatcgataaatgaattgcaggactagttcagcacgctcctcatcgctcaaacagtcaaactccccgcggatttgctcgatctgttgtttcctttccatcgatggaaagctcgccgccgtgcgtctagggatctcacaccccgagagatgatggtagtagcaacatacgaggttcagccggccgggcaggcgatgggaccgggaacacacgttgtcaccagtatatgtcgctgcttttgttacccactttagtaccaagcttttccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaatggaggtagcactctgtgcatcctttgttgccattctgctaaccaccatgctcttcctaaaagccatctcgacgaggtgccgccgtcgaaagtataacctcccgccgggtcccaagccatggccgatcatcggcaacctaaacctcgtcggtgcgctcccacaccgttccatccacgagctctcaaggcgctacggcccactcgtatacctccggttcgggtccttccccgtcgtcgtcggctcgtccgtcgagatggccaggttcttcctcaagacgcgcgacgcggcgttcatcgaccgccccaggacggccgccggcaagcacaccgcctacaactaccgcgacatcacgtggtcaccctgcgacgcgtactggcgccaggcgcgcagggttgtcctcaccgagctcttcagcgccaggcggatcgagtcgtacgagcacatccgccgcgaggaggttcacgcgctgctccgtgatctgcactacgcgtcgtcgtctggcggccgacgagctatcgtgattaaggactacctgtccacggcgagcctgaacatgatcactcgcatggtgatgggcaagaggtacgtgcagggcgaggtggtccatgaggagccgggatcggcgcggacgacgctggcgcagttcaaggagttgctcgaagagctcttctttctcaacggcgtcttcaatgtcggcgaccagatcccgtggctcgagtggttggacctacagggctacgtcaagaggatgaagaaggtgagcaaggcgttagaccagcttctcgaacacgtcgtggacgagcacagtgagcggaggcaacgtgaggggaacgggtttgtggcaggagacatggtggacgtgctccttcgactcgccgatgattctagcctcgaggtcaaacttagtcgggacagcatcaaggcatttactcaggttagcgactgcatagcgtacatcgtagtactccctcgtccaaaagtctaggctgtttggatggtattttcagtacatgtcacatcgatcggatgcttaatactaattagatgtttaacgtattaaacgtagactattgacaaaattcattctataaccctgactaatttgtaaaataaatctattgaacctaattaatccatgataaacctatgtgatgctacagtaaacatgtgctgattggcttaaaaaatttgtcatgaaaattagctctcatttacgtaattaattttgtaagtagtttatgtttaatactccaaattagtgtctaaacatccaatgtgacagggactaaaatttagtcccggggtcaccactagtcctagcatggtttagtttccaactttttcttcaaacttctaacttttctatcacataaaaacttttccacaccacaaacttcttaacttttccatcacatctttccaatttcattcaagcttccaattttggcttgaactaaacacaccccaagactaagaatcaattaaatcactcacgttgtgacaaaaccaatgaacatgtaactaataagtactaaaatggtttcttggttctcatcaataatttaatttagcacataatgactaaaaaatagaacttagacttttagaaaaaccaaagaatgaaataagttttagacttttggaatgaggaaggacatatcaatcaaggggaatagacaattttgtcccaaatttcgtccacaggtcaatttggtggttgatttttcattttgtctaaaggagtcctccagatttgcgcaggaattaaggacaagctaatgcctaaccttatggtaaaatcccagtgaagtatattagtccctccatacttcctcaaatactccgtttcaatttacctatcacgttcaagatttgttttaagtcaaacattttgatctttaacttcaatttctacaaactcatgtagttttacatcataaaatttatacttttggattcatcatgagaatactttaatataatatataattcacatgttgttaaattatacggatttctaaatattaatggttaaagatagacatgtttgagttaattagactaaatctaaaatgataagtaatataaaatagagggaataatgaaaaggaaaagtcactccagcggtctcatctattcgttcccatcaggcttgctcaatgcaagaaggtgaacaacagtagccagtagttacatcatgttagggggggtacagcacacccaggaattatctgagatgttaattaaagtataagaacaaataagggcaaagttgaaaactcttttgttctctaatgaaatcatattagattacttccaaattactaccttcgtcccatattataaggtaataaggcatgtattttttacacggtctttaataacatactttgactattaatttactacatgttatgttctcaactatgaaattagcatcacataaaagtacttaaaaatatgaatctagtaatataacatgcataatataattagtacaattattaataaaaaaaattaccgagtttgattttctaaaaaaaacatatgtaatttggaacggaggaagtaagaattttccatgaggctaaatgttggttctagctttgctcacacatataacaaacttaaaaaggtgggaccacaggacctttctaaacctgcagatatagaattgtaggaatcattttatgaaatcccaaaagcaaaatgattacacggtaaaccttttgataggcaaaattaatcagttattctcctccaccaaaaaaaagttaattattctcccccaagaataagtcaagcaaataactggcttggaacgttggaagttcaaaagttcatactaatatgctgtgcaaatttagtatatgagttgtgaagtgtaaatgactgaaacatactacctccattttttaatagatgacgccgttgattttttctcacatgtttgaccattcgtcttattcaaaaattttatgcaaatgtataagatataaatcacacttaaagtactatgaatgataaaacaactcataacaaaataaattataattacgtaaattttttgaataagacgaatggtcaaacatgtagaaaaaagtcaacggtgtcatctattaaaaaacggagggagtatatatgaaactagaatttcttacatgcatgacgccaaaaattattggcttatatataggagtaaatatcactataggtcgccgtgcataatattttttacttcagtgcaccctttttttcatagttgacaaatactaatccatttttttgtcaaaaaatattaatccaatttgtcttcacaaccaatcaatcacatacgtggacaactgcagaaaatgcacattttttttcaaggagaacacattacaagaatataatcaaattaagatgttacctcctccgtcccaaaaaaaaaaatcaaaccctaggtctgaatctggatatacatatgtccagattcatatccagggtttgatttttttgggacagactagtaagtcgtttctgagttaactagtccaaaacggcatgtgtaggacctcattgctggcggcacggagagttcatcggagacaatcgagtgggccatctcggagctcctcaggaagcccgagatgtttgcaaaggccacagaggaattggatcgcattgtcggccatagacgttgggtcaacgagaaggacattcttgatctcccctatattgaggctattgtaaaagagaccatgcgccttcaccctatcggacctttgcttgcgccacgcctttcccgtgaggatacgtctgtgggtgggtatgacatacctacgggcacgcgtgtattcgttaatgtgtgggccattgcccgtgaccctacgctatgggacgcatcggaggagttcatgccagagagattcttgggtaagaaaattgatgtgaaagggcaagactttgagctattaccatttgggtctggtcgacggatgtgcccaggctacaaccttgggcttaaggtgatccaattgagcatagccaatctccttcatggcttcacgtggaggctcccgaaggacatggtaaaagaggatttgagcatggaggagatattcgggttatccatgccacgcaagttcccactagaggttgctgttgagcccaagctctctagtcacctctacaaaggtgattgatatatgtctctatgtcattactcatgtagctggtacataaaaagtatatgtatttctgaacaagaattctaagccctcaagagatgttctattatgtgtatgatacaaacagtcatgaaagattctaaaatatttgattatacagagtacaatgatatctacaactccagaaaatttctagtctaaactcaatatatatgaagcgggaaaaatgaaggcaatcttagttgtatgtatcattcctgccatgccaatataggtgtggcccttttttctatagaaacacggttctaacataggcgctcacaatgtgagtgtactcacccttatgaacacatagtctctacccctatgagcacctccaaaagtctaagtcagcacatcttgcgattgataaagtcaccgaagacgtctcgtttgtcaatgggtatgtcgtctaccactgaaagaataattaactgtaaatgcgagtacccatgtcaagtccaggacttgaacgtagacaatatagagaagggtgatgtgcatggcttcccttctttcctccatgtctttatgccagaatgatgaaccttccaagtttgaatgtttacagactgaacctacaatacaaccttgttgcatatgcaattaatgcaactatcatactcatgcgaatggcctatcatttggtccacaaggtatatcttttaggttttcttccacatttagagaggtatatacctctcctatttcaaaggtaaaaaaacaaatcagttgaagtaaacagaagacaagtttatgattagcaatgacatgacttctcttgttgttaggaggtacatcaaggtatatatataccacaaagtgtaagtctggaggtatataccttaaaaaaagatggaaagtcaaaaatatacttacaccatactctattagttttggtacttcctttcacaaagaggtctatattaaaaatgaagagatataagtatgggagaaacccttttatttttgtttttaggttgttgtaccatgattttttttcttgtttatcatgttaggagtatttggccttttgatggattctatgatagtgcaaactgtgtaatgattatgtacatcatagttagggcagagattctcccatcctatatttatagttgtcatgcttaacaatattacattagcatactttcggctagtatatatgaaaattaaactggaaatcaagatactaccactactggagaccccatctttcgtgggttggtaaaaaaccacaatagtcccgatttaactaaaaaccgcgactaaaaatcatttttagtcccga

SEQ ID NO: 7947 - DNA, 5303 bp, Oryza sativa
  unsure (1)..(5303): unsure at all n locations
tgcactacgcgtcgtcgtctggcggccgactagctaggttaattacagactacctgtggccgagatgctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaatggggtcggcagtagtgcggggtgggcagcgggagaagaagtggcgggagatgcgacggcagccgggcccgtgccggtggcaggacaagaagccacggtagggtggggttggcggcgcctctctccgtcctctcctctctcgcagtggggttggtggcggccaggcccatgccggtggcgggagaagaagttgcggccgggctgtgtcgacggcgggagaagcagtggcggccgagctggggaggcggcggcctcgccctcccttccgccagatccggcaggaggggaggcggcggcggtggagcgactgcaaccagaccggaagaagattttttttttaggatttgcgatgaatttgtttttgagaattagtgatgtttgatctgtgatgtgaatatgtgatgtatttgtaatgttttttttaaaatttgtgatgtgatttttttgagaatttgtgatgtatttgatctgtgatttggagattatttggggatttcacgatttggggatgtagtgaaatcaatattcaagcagttaaaagcaatgaaaaaaagaaaaagaaactctataccaggactaaattaggagcactagccacctgtctctaccatcttcaccaactagaacttaaaaatagatctttagtcccggttattttaatcgggactaaagatagtcttggattcgtagtaccagtttgcaacttaggactaaaggggttgcaaaccgagaatacagaccacttgttcactggtgtttttttttgcttaatatagagtgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacggactcaacatttcaggtagttcaacactccccctcaatctaaaccataaaggttaagattgtatctaaatacagctagctgtttctcattcaagggttttgtaaatccatctgcaacttgatcttgtgaaggaacatactctatttccaacaatttcctagatactctttcacgaacaaaatgatagtctacttctatatgcttagtacgagcatgaaacacaggattagcagagagatactttgctccaatgttatcacaccatacctttgctgtttttggtacttctatcttgatctctttcaacagagtttgcacccacatgatctcagctgtgacattagccaaagccttatattctgcttctgtacttgatcttgacactgtaggttgtttacgtgcactccaagacacaagattaggccccaaataaacagcaaagccaccagtggatctcctatcatctaagcaacctgcccaatcagcatcagagaaaccactgacaagtaaagaagaagactttcttatcttaagaccaagcccagatgtttgttgcaaatatctcagaatcctcttgactgcagcccaatgaactgtagttggagagtgtaagtactgacagactttattaactgagaaagaaatatctggcctagttagagtcaaatattgcaatgctccaactatgctcctataattggtagcatcattaggtccaagaacatctccctgatgtattgagagtttctcagttggtgacagaggcgtactcacaggtttgcacttatccatattgattcgcttcaatagatcttttacatatttttcttgagataacagaataccatcacataccctttgttgcttctattcctaggaaataatgaagctctcctaagtcctttaaggcaaaagacttattcaggtcctgcaaaagagctgtggtggcatctggcatagagctagcaacaattatatcatcaacatatataagaacaaatataatgacatcacccttgctgtagaagaacagagatgtatcagccttggaaggcatgaatcctagctcttgcagttttgtgcttagccttgagtaccatgcccttggtgcctgcttaagaccatataaagccttgtctaacttacatacatgattaatcaaggatttatcttcatatcttgggggttgtttcatataaacctcctcttccaatatcccatggagaaaagcattactgacatctagctgtcgaaggctccaacctctagagatagcaatagacaaaataattctgattgtaattgcttttaccacaggactaaaggtatcttcataatctattccatacctctgtttaaatccctttgcaaccaatctagctttatatctgtctaagctaccatcagcctttcttttaatcttatagacccacttgcaatctataatattattagctttttctgcaggaactaaatgccaggttttattacccattagtgcctcatattcagcatccatagcatttttccaatttttatcatttaatgcctcatgtaaattttctggttcaccagaagctgtaaagcaagcatatttaactgtaccatctgtgtataccttttctttgcggattccactctgtaagcgggttctaggccgaactatttctggttgatgctgctcagccacaggagagctcgcggcttcttcatgcgatgcagaggattcagagacatcatcattacctgccatcgtcgtggcagacggagactgatcactcggctcgttctcaacacgcgtgcctgaagttgctgcatgcgtgtcactaccagacctgcgcacacacaagggtgtcacagatcccggcgactgcggcgatgatggttgctgctgtgacagctgctgcgtatttgcttcatccacccagtcctctgcacctatatttcctgtatcttctgcatgctcaacagattgatcaggcatttcattaggagaattaaacatctgatcattctcaagttctcccccttgatgagacgtgtgaataatgagatcagagggcaaaagagagatctcatgacgaatacgtgcgccagcattgtcatgcaatttagaaaaaggaaatacactctcatcaaaaatgacatctctggatatatagattctaccagaagcaatgtccagacatttgtatcctttatggcggtggctatgaccaagaaatacacattgctttgaacgaaattggagcttatgtgcattataaggacgaagattaggccaacaagcacaaccaaacactctaaaggatgaatagtctggtgtttgtttgaagagacgttccaggggagactcaaactcaatgactctactaggaacccgatttataatatgagtggcagcaagaaacgcttcatcccaatatttgagcggcatactagcatatgctagaagagataggccaacttctacgatgtgcctatgttttctttcggcagagccattttgttgatgagtatgtgggcaggagacatagtgagatatacctattttctcaaaaaaggaattgagtttctggtactctcccccccagtcagtttgcatggaaataattttacgatcgaacaaacgttcaaccaaattctgaaaatcatgaaatttctgaaaaacttcagatttgttctttaaaagataaatccaagtgaacttgctataatcatcaataaaactgacataatatttcttatttccaacagaaactggagcaggaccccaaacatcagaaaacacaagttccaaaggatgactcgatatactcaaagatttagaataaggtaactgatggctcttggcctttagacatgcatcacaaaccggctctttattggactcatctagacaaggtaatttattcttgctaatgactctggagataatgggtgctgaggaatgacccaagcgactatgccatctctcaaaggatggcgtgacagcacaaactacttttgcagatgatggaggagatgcagatggaactggatagagtcctttttggcgtctccccttaagaaccgttctcctcgtggcctgatccttgatcaaaaaatgttttgagtgaatttcaagaaacacagagttatctgcagcaagcttatatgcggaaataagatttttattggcttgagggacatggagaacattattcagatgcaatgggcgagtaggggtatgaactattgaatgaccaatatgtttaatctccatacctgaaccactcgccgtgtggatttgatcatgtcctttgtagacgtctcgagcggtgagtttctccagttcccaggtgatgtggtcggtggcgccggtgtcaacataccagttggagtcccgtgcatgggtgtggatggcagcagcaactagcttgtcgtcggggacgaaatcttcatcaaatcgatgccaacagtccgctgcaacatgtccgcgtttatagcagacctggcacaatggacgattgtcatagctgcgctgctgctggttgttgccgcgtccacgacctggtgcggcgctgcgcccacgagttgcgccgcgtcctcgcccagggtttgcgccaccaccccgtgagccaccaccaccacgtccacctctgttcgccatgttcgccgtggcctgcgcctgcctcattgctaacctgttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7948 - DNA, 3012 bp, Oryza sativa
tttctctctcgagaaatcattcctctaatggagtacgagagatttagggaaatatgcttcgattatttaatatcctgacttagtattttttttaaaagatacataggaagacacacaaactcactttatactcacgccacaccacatacacacgtgcacgcgttcaacacatgattagactagagacttgaaggacctaaagccttcggtgtgcgggaaacgcacattacaacagaacacacgtaagtgtgtatcctctctagccgttcgttcaaaattattgggttcatgcggactattcaaaattttgattctatcataaatttttaaaacaattacaaaatcataatcataagacaagtactattttcaaaaatgaattcaacatcatccataacactcatcttcttttctcagctcgcgtcccattcctattatctccgttctcctcctccctccctttcttgacgactttaccccatagtgggcgtcctcctccctgccttcctcgactactccgccccatagtcggcatcctccctctacttaccttcctatgatcccatctccgatcgccagagaaccaatcgatgccttccctaatgtcaacagtgtcttccatcttttttccccttcactcaccagatcagagggcatcaatgagagtgtggtggacgatgaggttatgggaccaccgaaattggtgaggtcagcaaagaggaaggcaactacggtagcaagatcgactgaggaggaagaagagagaagaagcaaggtatcaaacctcatacctcgggtatcatccatgataccccgtggtatcatccatgatacgtacttaggtaccaaccgatacccatagataccaggttaccaagtaccaggtatcaggtatcatgtcgtgaggaggaagctcgggccgtcacccgcctagccggtgggtgagccatttacctttgactcctattttcttccccctttctcccctcgacacactacatcctctcctattgttgatgacgttcacgagggaagtagtcagctagcatagctgcgataccaagcaggctcctggctggggaagacgccatcggcgtggtttgctcggagtagttgctgcagcagcgctccgagccagttccttgctgtcgacagctgtggcagaggaggaggcaaaatcacgtgaacagtgtgagggacagattatcaggtgttttaattatcccgtgactttcataatgccacaggatcccgtgcggtagctgccctctattaaaaaagtatctaaatccttataaggtaaattagattatcaaaatatataaacaaaatattataaaaatattttctgcatgaaaggataatttatctaaagaccacactcctataccttacatatcatccaaattgacatcaaaattatgaactaattatgcgcatggatttatacaccaatatccatttacacctatgcacaaataacggatagactgaggaaacatatacttatatgatgatcatttgaaaataatttcaaaaaagttatatgacgatcgaatgggaatggagggagcatcatttattttgttgtgagttattttatcaataaaagtactttaagtatgatttatatcttatacatttgtacaaaattttttgagtaagacgaatgatcaaacatgaatcaagtagaatattaaaaaacggacgtagtatgaacattaacaagttgggatcatgttcatcctttattcacatgaaggataactttggaattattttagattctacaacataccaaatataagtaagttataggaataattaaagtaaataccagtacgctagatcatatatggcaactctgacacaagttttgcagccatgggcatagatatagtgactaagacctacaagagattaaccaccaatcaatatgacaatatccataccagacatggaaatttaaaatgaattagattggattttcaaaccctaaatattttctaatgaaaacacgagatgggaggtggaggaatagagatagggtgggtgtggaagtgggggtggggggagggagtggaccagtcttgatgagctaagaataatactaatgtagtaataaaggttatcaggaaagaggtgggatatcatacgtacaatcagtttagttgggcttgagcattaatttttgtggacatggggcacatggactatgagctacaagagaaatatggcaacgagcaattctcaagtaaacatttgcaataaatttgtttagcctttggaacacaaaatttatttccgcacaaccaaaaagaggggaagggatgaatgaggtgtgattcgtgtgaagggtgcacaactcattcttgataagctacaaacaatttgtactccctccgtcccagaatataagaagttttagagttagacatggttattaagaaagtaggtagaagtgaatggtgcagggttgtgattgaatgagtagtagaggtaggtggaaaaagtgaatggtggagagttgtgattggttgggaagagaatgttggtgtagaagttgttatattttaggacaaatcctacaggctaaaagttgttatattttaggacggagcgagttttacattaatttattatacctacttttggaataaactaaaatgcaggccaccacattcgcacatgctatcttctagtttgcatcataagcaataaacggtcctgctattcatcccaaggaaccatgaaaaccagctaacaataaagccctcaagaatatggagcctactatcatttcaagctaggacaatatcaggttatatattcaagtgcttaccatacaatcatgcagaacatgaattctcgttttgttttttcttctttcttcctccagaccttctctaggacaatagcttagcttggtccgtctacatgctcttcttgtctattgaatatatatatttttaccgattttatagaaatatacacgtttaaaaaaattggcag

SEQ ID NO: 7949 - DNA, 1037 bp, Oryza sativa
aacatgaattctcgttttgttttttcttctttcttcctcaagaccttctctaggacaatagcttagcttggtccgtctacatgctcttcttgtctattgaatatatatatttttaccgattttatagaaatatacacgtttaaaaaaaatggcagaagtataccattatcgcggtgtgtgtgtggtggggggggtggtaattgaattcgcatcgactttgcacggtgaatgcgcaaactcgtgatgtcatcacgagtttgtatgatgaatgcgccactacgtgcaaagaaaatagagagaatctattctataccactgagtttgtcatagtttaacaatttaccattgactttgtctctttctacaatataccgacgactttatcaattgttctacaatacgacattgggttgggcttatttttcaacaccatttagcaattaattaagtaacaccatttagcaattaatttattggccgtagtttatttaattatcatcgttagtaattaattaacaactgattcatcattagcaatggaaaacaacattccacattacctccatccatgcgaactcgtgcgtgcggcagcaagttcgtgttcccacttgcagcaacgacggtatatcggaattttgttataattttttgaaaacgtgtatattcttgtaagaccggtgaaaaagaatatacctttaaaaaaaaatcttgttgtcttagtgccctacttttattttgcttttctttgctcctctttcccatcgctcggtccttccaattcactacaccagatcctcacatctctgacgggatacctgtgacgggcaaacgaaatggtcactgatgaccgtcacctctgacaggtcatacgggatgccgtcatcggtgaggcatccggctgctacccgtcacaggtaactagtcacctgtgacgggttgaaaatagaacccgtcacaggtgaggttacctcaccttaaatgggtttaagtcctaacccgtcacagatgactagtcacctgtgacgggtcgcagccgg

SEQ ID NO: 7950 - DNA, 3677 bp, Oryza sativa
gtggcaagccccccaatcagcaaggcaacgaggacaaggagactcggctgcggtgaccagcagggttcacccgtgctgtgcatgtatactcttttctcatttttgttctataactctaatcttgtctttggcattggcagggattaattgaaaaccctgaaaaaataatatctgaagttgcaaaatctctcatcctccttccttagatggctatatttgattaaaatggaaatgccaaatcagtgaaggcatgttgcatgatctctaggattaggtcaaattgaatcaatcaattatgaggaggaacataggcattctttcatacttcctccgtttcacaatgtaagactttctaatattgcccacatttatttagatattaatgaatctagacatatgtatgtgtttagattcataaacatctatatatatgtgggaaatgctagaaagtcttacattgtgaaacggagggagtattttatttcacttgttctacatcaccaaggctatatccagggcttcactctcgtgatggtgatgcaaggtgttaacgaccaaatttggtaattcaaggatcggatgtaaaggagggatcgagacggagttcgagatagagattatcatgaaaacagagtgaagatcggctgagtccgaatcggctacgactaagatcggcggagttcgagtcagacggggttagcctattgagccgaatccgacaatatggcacgacatgcgttgtcgggttaggttgacgtgcttcatgatgattgccgtgcatggatagagtcctgagaagtcaattgtatctattaattaggatattttatgtaattttcttagagatatgtttgggcaaaagtctgccgcaaagacttatggtatcttagagtttgttagggataagagtcgtgtccgatatggacatatcttgtaattctcgggtataaatagacccgagccccatgtaatcaaattaacacacgttcaatataatctcggcgcatcgccaccctttttactttcgttttgtttcgacaagttcttgctttcgggttgagctgcatcagttttgatcttcaacaagagataaaacttgttatggcggcttgcgttctcgggattagtgcttccatctttatgatactctaatcttgtctatgtaattcgtcgagttatcatatatcttatataatctccgacaatatcgttatctaacctacaatcggctaacatctgtcagtagaaggcagccgattaggttaaatatcaatgttgacttagattatataggatatccaccactctatgaaacttccagcggcttgattgtctagatattgtctttcttttcatacttatagctgcatcagttgagtttgatcttatgagtcgtgattagaattttaatctctagcatgtctttggttgccgattagggtagtatcggggtttcagccgatcttacctaatttaactatattcatcttatgtgcttcattgacatgttaaatctgccctttatattaagatcttattgcatttaagtatattaggctttcatttggtatattttacttgctgtgatatcttaatatagagtagtatcggagtattagccgatacatgctagatctatctgattggctatgctatgaacacatatagtctcgttattaatatatatttcgatctaagtgatttatactgtctcggcatggcgaccgatctatcccaatcacttgatttaagtatatatcgatataaggactatataccgttaatatctacagccgatcaaatagatttagttctttcttacttattaatgaccgccgatcgatgcatatatgacatcggctcaaagataaatgatatgtcatcggcatctagccgatcgactatcgtttatggatttaaccgcggtttctttgtctttgtttcttgttgattgcaggatcaaatcaaatggcacgctcacatacccaaaggcaagttttggacctgtactggagttaagcagatctcccaggcctcgtgtttttacgtcaacacaaggttataaggaaattcaaaatagggaagaataatatcggaagacaataggaataagttgcaattttgttgttatatttttgctcagttcctctaagaatgcattactggttcaacgtcaaaataataaccatttgtactatacttttttataaactgtgaaagctatgatttggctcgtgacataggcacacccagggttaaaatcctgggtccgtcaagcacacagcaaacgcaaaaagctagcttcacaccaacgatacagtaaacagccccatgacactcgcgtgattaatggatcaattagcaccattaacaattactccctccatccaaaatgtttgacgccgttgacttttttaaaaatgtttgaccattcgtcttattcaaaaaagtaagtaattattaattattttcatatcatttgatttattattaaatatactattatgtatacatataattttacacatttcacaaaagtttttgaataagacgaacggtcaaacatgtttagaaaagtcaacggcgtcaaaaattaaggaaggaggaaagtattaattgttactcattaagattattattaattgtgtcattaggccagtgtcaatgggcatttcaggagagtttcatgcacatttaatgcattgacacatgatgtggcgtatgtgaaacagtgccgtgaaacttcccattgagagtggccttagcatcattacggccggtgtcgctcgaggaataaagaccgaggcttctcctactggctacccggggggggggggggtaatgggcgatcggatctgctcccctcccccctatacgatacgctggatctgcccccctcccctatacaatacgctggatctgccctcctccccctatacaatacccagctccctcctctcccccttcctcctccccttcttctcttctgctacagtacaccacacaaaaattttttaaaaaataaaaagttagaaaaatttatatatagtatactatatataaaaaatttaaatcaggtatgtaaacttttgacttataaactttgggtctataaactttaggtgtataaactttagatgtatagaaatactatatatagaaaatatttgaattcaaattcaaatttaaatcggatataattcaaattcaaatttaaaatgggtctataaactttagatctataaactttaggtgtataaactttagatgtataaactttagatgtatagaaatactatatatgaaaaatatttgaattcaaattcaagtttgaatcggatatataaactttggacttataaactttaagtctataaactttaggtgtataaactttagatgtatagaaatactatatataaaatatatttgaattcaaattcaaatttgaatcggatatataaacttttggtctctaaactttagatgtgtaaacttgaggtgtataaactttaggtgcataaataaattactagaataggaaaataatacgatgccaaaaaaaccaggtggaggatgggagagggaggaggggggaagaatccgatcgcccagtagcatttccgggctacggcaaccagcgagcgatctagcactctcgccctgcaagaccactt

SEQ ID NO: 7951 - DNA, 1604 bp, Oryza sativa
atctatttatgcaaaccctttaaatctcgcatatttcttagaaaaaaatcaataatataatttaaatttttttttcttccaatgatcaccctcacgttaaaccccaatcaaaagccacggagatatgcgtgtccgctcccgcggcgacttgcgtgcgccacgtcaggtggtatcttgcaaggaatgatctccgcacaaaacacgcatattctcgcgccctttccccgcgatcctccggctgattccatccatcgatctgtccgcatcaactaccccctacggatcatttcatttgaggccactaaggccctctttaggcttagacttattggcctaaacttttaagtcagcttattggcttatatgatttataagccagtagatttaatgtcctaagtttagtggtggagtcatatatctatctcatataagccaaaaaaaacttctccaacatagcttttggcttaatagtgttagagtggcttatggcttcaaaaaagacaaatgaaaaagctgcttgtttgttttggcttagactttttggcttataaacctaaacaaagagggcctaattaagttagcatcagtcaaattgcttggctgtagtttgccaaaaacgacgaggataattttgtactcctataggtgtttttaattatctttttaccgtagtactagtcaattgggtgtcccacgatccactgggaccagctaatgcaaatggtttacgtgagctaactagccgttgctgggaaggatgattaattttcaaacgatttttctcatcgagtttaattaaacgatgttttatagagaggaaagggcaaggacagttcgggattatagagtcagtgataggagcttgattcgatggtcatatgaattcatgacaattcaagtgctaaacaatactaggcatggcagaagttttctttaacccatgaaatattgaattatcttttacagtacacttggtctatagaaagttttttgctcggtgacttcatattttatttagataagatatgtgagtaatttttactgaaagagtttagcttcttgctttccaaggtactacctctatatcagaatataaggtgatttggctatataattacgtggacaaaaccttttatatatttaaaacatgctagttgtttcttgagttgttttagctcatattcacgtgaactatagtacatttttttaagacaacgcactgtatataagcatattctctgactaaactgtataagcaattgagtcactgacatgtggtttcactttgccatggcccatatgtcagtgacttgaatccttttactagtagattactacatagtttaaaaaaaggaagtagattactatcgtgtcaccacattctagcagcaacattgcatcaggctattcccaacctaagacattagatataatttttataaacttcacattatcaagaaactaatacttcatccatttcatattataagactttctagcattgtccacattcatatatatggtaatgaatctagacatacatgtgagcctaaattcattaacatttatatgaatgtgggcaatgctagaaagtcttataacct

SEQ ID NO: 7952 - DNA, 2594 bp, Oryza sativa
gaagtgtactgtttgaacttcttgtaatgttaagttccaatttggtggatgcacatgtatgctttgttacatggaaacataaaacccaagtcaaggaataacatgagctgtgcactatcacagcttatgtctagttgatatgttctgtaaaaaaaaactaacaccattagtctgttccctatggattcgtatcctgaacctcttttccataaggaaaatggttttccttttctgtaaaaaaaaatcatatgaaagtggtttattatccaggacatgctattttcatttcacctttttgcattgttgagattttacagttctgtgaaatgcgaattatgaacattttatccttcggtaatgttaactagttcttctatcagtttaggtggcttctatataagaaggcatcacaggttctatatctacattttgcgttgaaaaggcgtgcatttcttgaggaattccatgagaaacaggaacaggtcggttacataatcatcacagttcgttagctgtatttgcatctgtttatcttttcaattgaaatgctgaatgctgtgattggacaccagaaaaatctgttactggaagttttgcagcaccacttttgttgacagtcattttgacattttattgtatgttgtaaacgtattaggaaaaacataattttctctggtttactattttgcatttcattcgccatgaactatcatgccccacttgtttgtggaaacatataatatttgttgcaagcatctctagtatgccattcctattgttattattatagccatgaagaatgcacttaataaaaaatgagagaatcctcagacctttgttccactgctctttctactctaattactcggctgctaattcatagtaggagagatatcactgctcagaacaaaaggatccttttcagtcgtgaaactgaaccaacctcttttttcttttcaaacaaaattaaaggtcaaggaatggcttcaaaatttgggaattggggagcatattccagttgtgcatgatgatgatgaagcggatgacgtgcatgttccttcacaacatgatgaacactctgtcaaaaataggtaatgctgttctattaataattttgaccttaatggactaaaacgaagacgaaaacgtcagcaatgaaatctttctgtaaccagtttattgatgcaattggagtagttgacttgccataagtttacctgtgcatattaagaaatgaatacaaaacttttgttgcagaaatgttccctctagtgctgtcttgcctgtcattcgtccagcccttggtcgtcagcaatctgtttctgatcgtgcaaaggttgccatgcaagaatatctgaaccatttcttgggaaacatggaaattgtcaactcaagagaggtaccaaaaagcctatattttctctatactctcgtcatatttgttttggttataatgtctatacatcaccaaaaacatcgaatttgtcaattaggatatatttctgtggtgctaccctcttttggactgtaacatgaaataaaatgcaggtttgtaaatttttggaagtctctctgttatcatttctaccagaatatgggcctaagctaaaggaagattatgttacagttggacacttaccaaaaattgacgaaggtagcagtaacatatgttgtttgtgtggatgttttagtttctgcaacagtagctggcagaaggtatcaaatgatgcgcattgatgttattttatatctatttttatccttattagtccttgtttgtgacccgtgacattgaacacttcttcataggtttgggctgtactgaagccaggatttttagctttgctccaagatccatttgatccaaagcttttggatatagttatctttgatgtatcacctcacatggatagaaatggagaaggccaaagcactctagcaagagagattaaggaacataatccattgcactttgcatttgaggtatgccctggtctacagcgtgttcctccctcaaatgaaaaaaaaaaacttataaccttgtcaccgtcttccacaacattaagactttgttgacccatggacctctttaacctgatttgttacccagataagttttaagtccagtcaaaacaaaatgtgtttgtttgtatctaattgtaaaatctagtttcatttaacttctaaatatggtaaagcaagcatgtttctgagttgatgtaattgtaaaatctagtttcatatgacttctaaatatggtaaagcaagcatgtttctgagttggcgacagtctcaactggcatcgctcctctaagtttagttgaaaaaaatcattgttaaaatatgatctagaaaaacaatatgctagtatgcctctaggctctaatacgtgtgcctgaactggtgacatgagtgaataaaacgagtaaaattttctaaagaaggcatttcccattttgatagcattttgcttgcctggcacttcacaagatactctagtcttcatctccttttaacaaaatggataatgctcataccaaatcattgttaactggtctgtgtttgttggatacatccaatgaccaaaaggtttt

SEQ ID NO: 7953 - DNA, 1424 bp, Oryza sativa
aaaatctagtttcatatgacttttaaatatggtaaaccaagcatgtttctgagttggcgacagtctcaactggcatcgctcctctaagtttagttgaaaaaaatcattgttaaaatatgatctagaaaaacaatatgctagtatgcctctaggctctaatacgtgtgcctgaactggtgacatgagtgaataaaacgagtaaaattttctaaagaaggcatttcccattttgatagcattttgcttgcctggcacttcacaagatactctagtcttcatctccttttaacaaaatggataatgctcataccaaatcattgttaactggtctgtgtttgttggatacatccaatgaccaaaaggttttgaccatattttcctttttgtcagatgaaaccagaccaatacatgaacataattgtagtaagatcaggaggctataattgtccaatgtactccatccataccatgaactttcgttaagcaagatagagtgggtatacacctaaggctctgactcatggtgaatcttctttagtgcttcatgggagtcgctgagcttcttcctaggagttggatctttatgaaagtatttttgattttagtttcttcctgagaaactagtaaccataacaggtttatttatcacccatcttctgcacgttccttatattagtacttgttctacatatgctccctagttgatctacagctatatatcctggtacaaatcagctgtccatagttctgtcatagaaaaacgtaggaactaatgtatagtactccgctgatgttaataaaactcaagctcttttgtgatactggccttggccttgatcttcctattgtaaaccaagatggtagcatgcaataaatgtgggcatgcggcatctgttttttcactgtaagtttctaagtgctaatacttgttgaaggtgtcttctggggggcggacaataaaattgagaacaagaagttctgctaaagtgaaagattgggtatctgcaataaatactgctcgacgacccccagagggttggtctcacccacaccgttttggttcattcgcaccacctaggggtttgactgaagatggtagcgtcgtacaatggtttcttgatgggcaagctgcgtttaatgctattgcttcttcaattgaggaagccaaatcggaggttgattttcattagctcaactactatttccgaaaaaggttaaaattttgaccatgcagtggaagataattaaactgttaaatgcagatattcattactgattggtggctgtgcccagaactgtaccttcgacgccctttccaccatcatgaatcctctagacttgatattcttctagaatcaagggcaaagcaaggtgtacaggtatgtgattgttttatggtgttatcaatcagttcaagcgctaaa

SEQ ID NO: 7954 - DNA, 2978 bp, Oryza sativa
ctttgctatactatttgctttattttgactgctagagagttagaaaataaaatgcaatactatccaataatggcatttaactgatagtttcctttgttcaagtaaaatttgaccaaatagtattgttatacttttgtttccttttttaccctttccagatgatatcctgtgtaaattgtcagaggtgtattgtggggtgcaacattagttatgccacagtgctcactggggacttatgtgttggtaggattggggaagcaaggtagattgtaagattttgagggtgtagtcataccaaaataagtatatcttatgaatagtaggatcactaggattgctgaatatatgctttgttgtacataattctttaagaaagtgtgtataaatttcatttctttgtgggacactaagcagcatttgtttttttttaagcaaatctgcgtttgcttattatgagttaattcgtacttcttctcaactgcaagtttcagataactatgacttggtactattttgcagatctatattcttttgtacaaggaagtttctcttgcattgaaaattaacagcatgtacagcaaacagaggcttttaaacattcatgagaatgttaaagttctgcgataccctgatcatttctcaactggcatatacttatggtacggtgagaactttacactcatttacactatttctgcagttaattagatccttatggttggctattgccttgaaggtcacatcatgagaaaatcgttattgttgataatcaagtatgctatattggaggccttgatttatgctttggtcgttatgatactcctgagcataaagttgtggatgttcctccttcaatatggccaggaaaagattactacaatcctaggtaatgttttgtgctctcatcatatttttatctcaagatttataggatagtgtttcctaatttaccgaacacgattaatgtttcctaatgattctaaaacctttttttttgcctatctaattgcattttactatcttgtttaagggaatctgagccaaattcttgggaggacaccatgaaagatgagcttgatcgtactaaatatcctcgcatgccctggcatgatgttcagtgtgctctttatggtcctgcatgccgagacatagcaaggcattttgttcagcgctggaactatgcaaaggtatgtttactggttaatattactcatccctatcaccgttgaaattgacaactcaatcttatgcagaggaacaaagcaccaaatgagcaagcaattcccttattgatgcctcaacatcacatggtaattccccattacatgggtaaaatcaaagaatcaaatgaggaagtaagtaaacagactcatgttgaggatattaaaggccagaagttaagctccttgaaagcaccagcatcatgccaggacattccattgcttttgcctcatgagcctgatcaccaggcatcaaataatggagagttaggtctgaatggtttagataacaatcatggtcactcagatcacccaaataaaacccattggaaacagcccattcccaaccggaaggccaagcaagatacttctcttcaggatttacagatgaaaggttttgtggacattcttggtaccccagatgtttcatcagtaattggacattatgacacctcaaaacaaaatgtgcatcacatggataacgaatggtgggagacacaggagcgaggagaccaggtcgattatgtgcttgatattggagaagttggtccccgagcaacttgttgctgtcaggttagtttgcaccatctacactggcaattcagcccttcttgtttcttgtggattattagattttaaagttagatttttaagaataatttatgtagattttttacctgtattgctgacaattacaaaaaggagctggacaatgaaaatgacaaaaaccactctaaaattattcctaaaatcatattcttaaattaaaaatcagcttcttacaatcctaaggagaaacaaacagggacattagtaataatttcttgatgtctatattgtttactggattggatagtgtaacttcacaaattcagttacccaagacttgtgttttgccacatgcaactcagaattattattatttatatcagaagcagtagggattccccctgtgtataattttataaaatgttaaaactattaactataaatcaagaggattatacagatctaagccatgattgcaaaaaatgaagatcttgccctctaagggcctgttcactttgatgccattttcaaccttaccaaattttggtaaagttgccaaaaaagtggccacatttagtttgctgccaaattttgataactataaaagaaatcctgccaaaattttggtaagatgccaaaattttggcaatgccaaattttggtatggttttttttggcatcaaagtgaacaggccctaagcctaaataaatgtaggcctagctcctccttgaaagcatgttaacacccacgctagcattggttcaactcagattattcaccattagacgaatgatctggagaaataatgggttggcaaactgaaacttaacttcttgctcttaaaataatatatattttttatgaaaagagaactgagctgtcaatccttaaaataaatacaattctttagtgccggacacccttctctttctatgaatgtattttcctgtcaaaaagcagcagccatttagtgggcatagtgcatactgcaaagtaggaagtgcaatgcgagggcgcatggagggcgcatggtacagatatgcgagtgagggaattggggatctgtggtgaggatacaggcccgcagttaatgctggaggtgggaggagggatgtgaatttaagcgcattaggtctaatgcaagggtattaccgtagtactccctccgtattttaatgtatgacgccgttgactttttaaccaacgtt

SEQ ID NO: 7955 - DNA, 3195 bp, Oryza sativa
tatgtcatacttaaagaacatttggtgataaatcaagtcacattgaaataaatgataattacataaattttttgaataagacgaaaggtcaaacgtttgtcaaaaagtcaacggtgtcatacattaaaatacggagggagtattatgcataagccagaggtagtgttggtattgtagcctctcttgcgctgtctatatttgcctcgtgggttcttgctatcatttcttccaactaaagaggagggatgggtgtacaagcaaccataactaccacgaactgaaatattataaggagtgaagatatgtcttgctctagcttaaatatgtcataccgatagataaaactgaatttgtaaagcatggaatttgtatatctttatttttacaggtggagctttggattggagtatttgagacatgattttattgtccttttaggaatgttgcttgtatagtaacactaaaaaacaaatagaaattattttcaactgtattatacatgtgtggctaatcaaacacacattttaaattttaactcaggttgttcgaagtgttggtccgtggtcagcaggaacaactcaaattgaagggagcatccacaatgcctatttttctctcatcgaaaaagcagaacattttgtgtacattgaggtgctgaaccttttttaatctcttgattttcaaatgtaatccacaaactccaagaaaatttgtatatttggaagtattgaaatttcatacctagatgatacaatacagattcatttcacttggtctaaactctaagcttcattttactggtctatgcagaatcagtttttcatatcaggtctttcaggagatgacacaataaaaaaccgtgtattagaagcattatacaggcgtatacttagagcagaaaaggagaaaaggtgcttccgggttataattgtcataccgcttttacctggatttcaggtatgttctgttgtaacaattattgatggttttgatgcttcgtgttggccggttaattacatgtttaattacagggaggcattgatgacggtggagcagcatctgttagagcaattatgcactggcaatacaggaccatttgtagagggcctaattcaatacttaagaatctttatgatgtggttggttccaaagcccatgattatatctccttttatgggctcagggcacacggcagactaggtgatggtggtcctttggtcaccaatcaggtagagaggcctgaattaattttccactctatttgtttaatattgtcctgttaccttcctaggtcatggattaagattagtataatgttagtttctttcttttccttcttttgctaacagtctgaattttgcagatatatgtgcacagtaagttgatgatcattgatgaccggatgacactgattggatcagctaacataaatgacagaagtttgcttggatcaagggattctgaggtatggctttctcagttgcctcttttgtctaattctctgcatgctaaggccccatagggaacacagagatattccattcctgtgtgctccaaacaggccccaacattattaggttaaacagaggactgctcctaaggttgcacgccctccagtcacaaatgcatgtcatcttaacattgacagtcttccaaatacagctttgacggtgttccaaatacagctttgacagcgttcctatcataatgtatttctttttcttgaaaaatcataatgtatttctgaatatcaattgaagttatacattacggaagcaattttcaggacagatgcacacgtatgatttttatatattaagagtatatgaaaattgcttgcagacatacagataaattaattgttgtgttctcgaattaatattttaaaggagggcctagcctagggaatatattttttctttctttgccaactgcatccggtcaagactaaatggcatgcttacatcttgttagtggcatccggaggtcatttgtgtgtctgctgttgactctattatcggtctgtttttattctcttttagattggtatgattattgaagataaccagtattatcgatctgtttttattctcttttagattggtatgattattgaagataaagaggttgtcagttcaattatggatggaagacattgggaagcagggaagttctctcttagcctacgactttctctatgggcagaacaccttggccttcatccaggagaggtttgtacaatgtttcacttgcttgaatcacaaaccaactcttttaagtttaaagccaccatacatatatagacttttagctgattatgtcaagattaagataactgactatggcaccacttacatccttttacctggtataattgtactggaaaacatctaccttgtcatcttttcctagatgtcagggttccatgccctgttaatgtgtaaagtgtagcctgtgtgcacctgttttctttgtgaataagaaaactggaaaatttttgcattctatttttccttatttgaaacttgaaagtttaggcctcagggtgggtgtcacaaacctttcatgttgtgattgcttcagtgaaccacagtagaagaacgtcctgtgtaaactccacttgatgaatggttccatataaagaatattgacagaagcatttatattgttttcacaatacattacggtattgatgctgcatgtacaacatagatttttgtgagttttctttctgctgacacttctccttaacaggttagtcaaattatggatcctgtggacgatttgacttataacaacatctggatgggcactgctaaggtgagtgaaattgagatttatcgtgaaatgctagtctgctcaacctggaaacttttgaatatgactgttctgggttctggcattgcactgttttctactcaacttttgccatctttcagcagctgataattttccactgcattttctgtttataccgctgtgaacacatttacctcattctctaactgaacaaattgatattgtatggcaggcaaacaccaagatataccaaaatgtcttctcgtgtgttcccaatgatcacatccattctaggtatggaacaaataacctgttttccaggttgcttgcatttcagctgcagtatcatgtcctctggtatttaaaactattttgaccttcttgcaggtcccaatt

SEQ ID NO: 7956 - DNA, 6305 bp, Oryza sativa
  unsure (1)..(6305): unsure at all n locations
caacttttgccatctttcaacatgtgataattttccactgcattttctgtttataccgctgtgaacacatttacctcattctctaactgaacaaattgatattgtatggcaggcaaacaccaagatataccaaaatgtcttctcgtgtgttcccaatgatcacatccattctaggtatggaacaaataacctgttttccaggttgcttgcatttcagctgcagtatcatgtcctctggtatttaaaactattttgacctcttgcaggtcccaatttaagcaaggatttgctcaccggaaggagaaaatcggccacacaaccattgacctgggtgttgctgtagagataacagaaactcacaaggatggggatctggcaggcaccgatcctatggaaaaattacaggccgttaggggccatctcgtttccttccctttggagttcatgtgccaagaggacttgagaccattcttcggcgaaagcgaatattatacgtccccgcaagttttccattagcttctcccaaatttttttaactacattttagtagcattagcttcttgtttggtatagttttcccataggatctttttttaggctgtacatgttacatacagggtttttacaattgtatagatgtatatatgtcttgtggaaatagttaaaacttaagagaagaaaagcaaagagagaatcgggcagtgttagttcgcccatcacaaagggaataaaaaataatttcttaggcaaggaatgttgccgttcactttattctttcgcactgcacttgcaaaagaaaggcagttatgttgaaactggtgtcttcaccttgtagccgcatcaggcaccaccattatcaataatgatgtattctttcgtgattattttgaataaggttcatttacaatcttctattattgtgggaattatactgaatatgaagccattttcccccaaatgttatttcttcatcgctttacctctttgcaggaggaaatgactcaaactaaatcggtataaagctaacaatgggccaagctaagtctattgggctcaaacttagttagtaaaattatggaataagttcaccggaggtccctcaacttaatagtgagattttttgaggtccctcaaccacaaaaccagaaatgttcgtccctaaacttattcaaaccgttcaccggaggtctatttttgcccggttttactgacgtggcatcctagtcagcaaaaaaaaataaaaaaattccgtggggcccacatgtcagtttcacacatctttttttctcctcttcacttttcttcttctcctcttcacttttctcttcaccggtggagcggtggtgggcaagtgnggcagatgagtggnggccagatgcgggnggagcggccgctangnngaggccgnnggnggnnagaggaggaggtcgccggcgagcgcgctcntgttcctgctctagctactaccgcgcaggcgcagcggcggtggcgccgatgcagccgagctcgaccaaaaaggggcgnacggcggcgccgatgcgtcggggcgcggctggcggcggctcggcgcgagcgtggctgtgcggtggcgccggccctggcgcaggacgcggcctcggcggtgcagccggcgtcatcgtcatccctccctcctgcggcctccggatccagttcaagctctacgccctcgacgacgaggtgcacctcggcaacaagacaagtcgacagaacaatcttttagcgattatctttgctgtttaaggattaattaactgtgattgattcttgattgcttacatgtgatcaaggacaagctgatggacgccatcgaggggcatgtgcctgggagaagccgagctcatggccgtcttcgaagacgcgaactctctgcattttgacatccccagcgcatggcgatacctcccgtgacgacgaccaacgacgagcccctgcatcggcgatacctcctggccacatcggcgccaccgccgccgcgcctgcgcggtagcagccagagcaggagcaggagcaggagcgcgctcgccggcgacctcctcctccggccacctcccgccgccgacgacgccctccctttcttttgcgtcgctggccggcgccgccggcagccgaacctctcgtgacccgtgggccgtggctccgtgctcgttcgccgtccgctccacccgcagcccgcccaccgatgctctgcccgccgtcgcgctcgcccggcgccggctccgcccgcagctggccgccgctccactgccgcgctcgtccaccgcgcgctccgtcggtgaagagaaaagtgaagaggagaagaaaagtgaagagagagaaaaaaagatgcgtgaagctgacaagtgggccccatggaatttttttattttttttctgactaggatgccacgtcagcaaaaccgggcaaaaatactgccaagggacctccggtgaacggtttgaatgagtttagaggtgaacatatctatcttgttttgtggttgagagacctaaaaaaaatctcgctgttaagttgagggacctccagtgaactcattcctaaaattattagtggaccaagcccaacccactgggcaaatttcttactctgaagcccacgagcacgggacgagatgacggctggttggattttagtaccacctcgtgagatgaggaggggagcggggcggccggaggctataaaaggctcgggggggcctctgtttggattcaacccgtccctgcggggggtgatcaggcgactcgttgatgatcgtttagagactgacgtgtcgcgccgacacccacaaaccgaacacgctttgccatggtgcgagcgatgtcccgtccctactttgggcgggctcgcgcgccaatttttggaaggccctgtgcccctcgggcaaccggggcctacacgacagagccaacctgcaacgttaaaacgatataagtatgatggtgaaaggttttttctcatattaaacgggccagtttctgaaccgaggattttgacacttttgacctttaaaaatttactaaaatgtccctagttaggttaaacatgaaaggggatataaattcgtcaaaaaaattactatagacagtatagatatatgaagtaattcatgaaacaattaccataggtatgaagtatattttcacccttttctttaaggaacgatagctcgtgagagaagaaaaaaggggaaggttaatgaggttaggtatatacattatatatatctattattttcttcatgaattttttttaaaaaatatgctcggtttttacaaaggtttttataaggatatttcccttaaacatgtattctagaagtttctaactgcatatgttaagtcttaaaaggaaaaataggaaataccagcggtaaaatgggaatcaccatcttgagtagcgtgtagtaataatgtggtcagtatttgctaaattgagacatcgtttttttaaaaaactgagactccaagtatagtacactagagggctgttctaaactgtgttttggctttggctagttccttatttttcgttagcacattatattaatcatgttttacgtgcggctaatcagccctatgttctgacattacaaaacgcatgtgggtctaaacagagaaacaccatgtatgaggaatattttccgttaataaacatccattaattctatttttcatttacattttacatatcatatcatccacaactctcttaactaattcaggacagcatctcttctatattgtaattcaggacagcatctcttttctatattgcatatcaggagcatatcaggtggttaaagctaaacagaaagaactactatacacttcgatgttacaagtcatccatattattctactgtcgagtctgtacagaaattttcatcattgttcgcaaacttctcaatcaatatttccattgttttcttatacatcggcatgtaatggtcattgatcatggtgttggatagacggattttactgtaaagatcccttggggtctcgtatattcccacactgcactcatcagcagcaaccggatcatcagggcaagaatctgcaggaggcatggcaaccatgtgcatgattctaccaggagggtagaactgctgcctctccaaactatcagatgaaaaggattgcctatcctcaacattttttagaacagcactttcctcctccattatttccttggcagcagctgcttcttcctgcctggtctgagcctccacttcagcctgccgatccaggtccttctcgtactgaaaccacatctcaccttcagttatttcttcttctgcatgctccctagaggattcatgctcactcagaagggcctcttcttctgtttcctcatgaactgaaacactatctgcagtgtactgcagctcctccatggtcttggtgccacgttgttctacaacataggactctgaattagtggtagatgtgacgtgggtttcccctgttatttcctctttagcgcttgcagcaactacaccaacacctcgacggcgtgcacccatgcatgaccatgaagaaaatgctgatctacttctagcaacagcctgcgcaacattctgtgcctgtttcatcacaacctgcaacaaaatattcatcaacaacattgaaacaactatttggatttggcagatagaaatctctaaatgtttattagacagaccaggcatatttcatgcaccgactgtttcagtgttatccttgagcacttttagtttatttcaaaccgccctatctcattttgtggtacacaatattaattcatgtaaatattacatttttgacagattttggttcagatattttacctgagttttgcttgaaacaggtcgtagcagtgcaccagcacctgcaaccctatctctggcaccagaaaatgattgcaggcgagttcctaaagcagtagcagaccggtaaacaacatttaggaagcgtgtctgctgtatctgatccctcaaatcatttaaccatgaagatgccgttacctagatgaggggataagacgggaggattagagacagtgaacttcactgctactaaattttgagaaaggatatcatggcatcatattctatccatgtttacagactcagttcatttaaatggacaacaaaaataatcatgttacataaatataacaaacggatcattttctccctcaaaacaatagaactatatttggaaacacattagcacagttatcatctatgggaagaatagcacatcaaatggagctacctctgaacggagatcatctatagatgaagttgatactgtaggaaccagatcagcaccgtttacaatagtcctcacaaaatgcttgcctgattctgctaactcccatgtcatgcatgaagctgaccaaaaaaattaactgttactaattgctcaggtcaatctaatgcatatcaaactatgtttttatacctggagcaaagcaacacaagttgttgaagacaactcctggtgttctctcaggatgtaggtcagtaatgcagcagtaccaccacccaatgaatggccaacaacctaacagaataaaatcaactattattaaaacaactagttcagaacttattatcaccattttgtgacacaacatgacaatttcaagtttctagtcaaccatatttcataacatatcctagtaagtataagaacaatttcaatttcataattttttattgacctacaaatatatgtctgataaagagagaaaaaatgaaaattgacatggatcaccaggttcaaattgatgctgatggtaaattgatacaatgatatgtacatattttgtttcgagagcattttgtcaccagcacagattaaataggtttgttaaaaacaaatgaaaaatcatcatcagctaatttcacagggcaaacataggtatcgtcaactagttctgaaaccataaacgaacgaaaaagaagtgtgtaccctgatttggtagtctgggcattgactgactgcttgacagagacatggtgttatacttcttgcaatccagcgggctgctgcaaccatcccacagtgtgcatatcccagcactaacttgctgacaccaccttcatctaaaagtgagtggtgaaatggtactacagcaccagtagctgcagtcaatgtgtctttcatactatgtgtcccacgaatcaacacaaggaaggatttggtgcattcatcacgcaggattgtatgggcaggctttaaaatctgtaagtatatgttgtgaatcaggaattgagaaaaataccaagtgatccttt

SEQ ID NO: 7957 - DNA, 765 bp, Oryza sativa
catatacactagcgacaggtaaatttccctgaaaagtaacccaaacaagaaaatgtgccatcagttccacagacaccaaatgcttttatgatctacgtgatgataacaaacttgcacacaataatcaatgtttgcacatgaaaaggaatagtccataagctccaatttcctttgctgagttacgtgactaacaattcaattcttcgtcccctcagaacgaaaggttcatctcacagcaagtcagcaaccatctcttcagtgaaatcatccagatgaattactaatcctattcttatgaaaatacatgctattctaatactctactcaacattgcacattcatctatttggtgataagcattaagcagcttgagatacgggtagtgcacagttgcaacgctccctgccgtgggcttgccaaagagaggattcacccaaaacaccaaaccattcccaaccatcaacataacagctactacatagaactatgctcagcccagtacaaaacacaccagctccgggcacacaaattcccaaactcctatgtgtatagagaacaatcagagctgaattcgccggttttacacgcgaattttctactacttgccatctaagcgaacaagttcctacagctcgaccccaagcatgcctcctatcagcaacgcgagcacctcgacttcggaggtgcagctccaacacaagacaagagctgccatttcagatccaaaacacaaaaacttgcaggtgcagccaaccagccagccag

SEQ ID NO: 7958 - DNA, 2237 bp, Oryza sativa
atccggtaattaaagaaatggacgactgaaattgcatgcagtccttaaattacaatcacagctataacaacaccttatataaatccgaaatatcacaaaacgaccacctagagaatggtaaggatctatatgaaaaatgccctgtgtgtccatataaaccaccctttgatatggcgatttatttattttgtaaattagtgaaaaataaatataaaaagaaccaagaagtttcttcttgttttactccgtaaatgggctaattgcctgatccagtcgaccaaccggccggtgcgatgttgtcctgagatccagtctcgtggaatatgttcatttgagatcctttaatttgtcgtggagtttaaaattcatccctcaaaccgaaatatcagatttgttaaatctcccaactcacactactatgtcaactttaacctcttattgctcccttcgttcctaaatatttaacaccgttaagtctaacttctgggcggtggacttccggcggcccaactgccactgcaacccgacggcgccggtgacatgctgtacccggcgtgcgtgacggagggtgatgagggagaggcagatatattgccaaaggatcaacattggatacatggtacgagttgggggatggactatatctaatatttcggtttagagatgaacttcaaactcgaagataaatcgagagacctaaaatgaacttattcactttcttgccctgttcggtggtgaattgggccgcttgaacttgaagcaatgtataaatgggctttgctttcctggagatctttttttcttctcggatatgatgattttcataggaagtattttctttcaaatagttaaaatttggatttttattgacaattaataaaactataagtatatttattgaataaaaaataatttgatagattaatatcccaaaaatgctgttaaacatatttttcccagggttattaacaatctattttataagcaatcgatggttaaagtctaaaccagaagacttcttaaaacaaaactactccttgtaaaaatcaacatatttaggagtagtattttataacttcctaaagctaagcaaataaaacatcacgcaagtggaattaaatcaccgcgagtctataattaattggcaatatttgttttttctggggtcacaatcacttttcttatccacctcctccaggtctgacattagtcttgggagcagtcgagcagatataccttctctggatgactgaaaggaatggaagattaacttaacagtttaattggtctagccctgagcatgagtttgtcttgatttataaagtctgaaagccattgacttctctttaagcttatcattacacagaaatgtctctttctcgtcgacctgttaaacaccttccatcctgtcggtcgagtttggtctcctgaatttgctctgaaaacttcccttcactagaaactatactcatgtcagatcaaattctcctctgcatcagtacacacctagcttccctgttcttcgtactgttcctagtactacttgaaacaccgctccatgaagaactggaatttatcccattggtctgtcaatctgaactgaaaattcagcaaactgcactggatatataaatgttttgcctccttttatggacaccagtttcttccttgcaagaagcaaaaaaaaaaaaaaaaatcctcacgttctagatttcagaagataagatctctagatttatgcgatgcaaatcagatgtacatatatttcaagagaatacaaaaatgtctctattcccaacatgctagacaggacaaagtttttagatttggcctggaaatactgtgacgtctctgccacttttttttcaagtacacatcatatacacaggaccacagctttgttggattctcttgaggtgtagtggacggcggtaaaaaaaaaatagtggtgattgccaaggaaaatcatctcccactactacaagttaagcatcttattgctccccttttttccttatcttacttacacccctcttaattaatactattttacataaatctcatgttacagtaatcttaattaacactaatcatcaatactatataataccccaccttaattacttcttgacaggcaaaagcatgttgattaggatatggtgcatgcattagggttctcatcgctgaacatggaggtgatctggcttccatctcccttccctctgccaccagcagct

SEQ ID NO: 7959 - DNA, 1666 bp, Oryza sativa
  unsure (1)..(1666): unsure at all n locations
acgtacacctcgctcacacctgcagataagtgcattttcactttttcagaatgctaaaatttcagaattttcagataggtactcccccgtcctggaaaaaataatcaaatcctagccatgaatccgaacaaatatatgttcagatatatagtcaggatttaatattttttaaaatggagggtgtatgaggctgagctagatggatttgtctgaagaaaagaggagaattaattctgtaccatcaatggcacgcagagtcttcctgatcttgtgctcgcagccattgcagtccatcctcacatgaagctctgttattcgcggcgtctgcaggtacagttcgagtcacaggtacattagcacatcgatcaactctgaattgaacagtgtgtgaaacaaaaaagaagagattcttgaggttaattctaggaattactgcagtcaccgacctctgattctgcagccatcactgaagttgatctgaatgtgtatgttttgttggagatagcttcctgaagctcgaggatcctaatggagagagctcctaattaagacctttgttgctaggcagcttggagccatggaccatgcaagtagttgcacttatataagggattggagagatggaatatttagaggggaatttgtgtgggtcacccaaagaatcattggaaagtgaaaagaggggccctgtgtgttactccatcccggcatgacctcctctgcttttccttatgttgtagtcgtacccgcaagtgggttcttctaggcaaggcaaggttttctcagttctggtgtctcatttgccccaaggtttctcggccctgttctttagtggttttcagaattaaataggccatttctcttttgttattaaaatacataattttatcttggtttctattaatatgtttttaactgctaaatggtgtattttgtgtgaaactttttatatagaaattgttctaaaatatcaaataaatctattttctcaagtttgaaatcattaaatctcaattaaccatgtattaatgtatttctcgttttgcgtgctcatacttaatctttatttggagcaagttcaaacagggccatagttcatactctcacatagattccaatagtatatagtaacaaaatctaaaaagcgaacttaaaaaccagaagctctttcataataaatctctagctccgacaaatagtttcagattctcacacagattttaataatatgtacttataaaatctataaaataaacgagaaatagaaaagttagaaaagtctattttttctcagattctcatcagtcgtttctcagaatctaataaaatctagaactgatgtcagccggggaacatttcagttatatcgttttctacatatgaacatcatcaacagtacgtagatgcaattattgccatgggataaccaggaatccctgctttcaatcgatttccatgggactcgatatactactggattatgtttcgttttgggtatttccgaatgcatatggtgctatatatgtggtctttgtcggaatgttaagtttaggccaaaacattgtgcgatcagtgagaatcatcaataactcacagtagggagagnnnnnnnnnnnnnnnnnnnnnnnnnnnnnnnnnnnnnnnnnnnnnnnnnnnnnnnnnnnnn

SEQ ID NO: 7960 - DNA, 1031 bp, Oryza sativa
  unsure (1)..(1031): unsure at all n locations
cggggggcggtcggctgcgcgggaggaagaggaggcggaggaggaggaggtggaggagtacggagggggatacgtgaggatgccgcaggagccggagggggaggcggcggctgcgggggcggggtcgttcctccggcttcccgagtcggcgggggcgttcgacgagctgccgcgggcgaggatcgtcggggtgtcgcggcccgacgccggggacatcacgcccatgctgctctcctacaccgtcgaggtccagtacaagcaggtccgcttcctcccccctcctcctgctcgggttttcgttttggggtggggtacgggttgcgcgattcggtggtgaggcggggttggattcggcagcgtccatggtgcttggcattgtagtgttgttgcgtaaattgatgtttgatggtttgtttcgtcgatgcctgcgcgtatttgatttccaattgacttctgaatgtgtttttcccttttttttaatgaaaagaaaaaaatactacctgattttgtgcggtttaagatagagtgagcctccaccgctgctagaaaacgaaaagaaaaaaagaagaagaagaagaagaaggggtccctttctgttgtctgtgtagcaactatgtcaatgagtagcttggtggagcttgcacgaaagagtggttggtactttgtttcactgattcggtggggtatgaaactcaggcgacctgatcattaaattttcagtgcaaatgcaggcgaattctttgttttttttttgggggggggatcagatacagtgctgtgcgtgtgactgtgaaatttccatgttattttcacgtgaatttagagttgactacctatgcctatctgtaattcattttttttgggtccaaggaagtgtactgtttgaacttcttgtaatgttaggttccaatttggtggatgcacatgtatgctttgttacatggaaacataaaacccaagtcaaggaataacatnnnnnnnnnnnnnnnnnnnnnnnnnnnnnnnnnnnnnnnnnnnnnnnnnnnnnnnnn

SEQ ID NO: 7961 - DNA, 861 bp, Oryza sativa
  unsure (1)..(861): unsure at all n locations
ttgattaaaaatttagacaagtacttaaaatggttacagaatttgattttttagatgaatggtatacgtacgcaggatgcctgctggctctagtaactcgttcgtatacgtggatatgttcagatatgaactttcggccgcctacagcggcgcgcgatcgtacgttgccgaccatcacatcatcctctcatctcgattgagttagatgctgtgatattttacgtctggttgctagctaaagtagtggcaaacatatgcatgtcccgcacatgcgcaaatcgcaattgattcgcagacgattgcatcatgtaacacgcagaaagctttgggtttgaactgatgaaggtatgttcacaagctcagtgttgggcaggcattctgttttttctctctcgagaaatcattcctctaattgagtacgagagatttagtaaaatatgcttcgattatttaatatcctgacttagtattttttttaaaagatacataggaagacacacaaactcacttcatactcacgccacaccacatacacacgtgcacgcgttcaacacatgattagactagagacttgaaggacctaaagccttcggtgtgcgggaaacgcacattacaacagaacacacgtaagtgtgtatcctctctagccgttcgttcaaaattattgggttcatgcggactattcaaaattttgattctatcataaatttttaaaacaattacaaaatcataatcataagacaagtactattttcaaaaatgaattcaacatcatccataacactcatcttcttttctcannnnnnnnnnnnnnnnnnnnnnnnnnnnnnnnnnnnnnnnnnnnnnnnnnnnnnnnnnnnn

SEQ ID NO: 7962 - DNA, 464 bp, Oryza sativa
aaaggttaaaattttgaccatgcagtgaaagataattaaactgttaaatgcagatattcattactgattggtggctgtgcccagaactgtaccttcgacgccctttccaccatcatgaatcctctagacttgatattcttctagaatcaagggcaaagcaaggtgtacaggtatgtgattgttttatggtgttatcaatcagttcaagcgctaaaatcatgttcagttgtgcactcgtatatattattttgccgctttgcagtatttatttgtttgtaacagatttggtagcatcaaatgtttaactggtagctgtctacatgagatgataatagacaagtgtatgaagtttaactttgcagatattggctgtatgcattttaaagtaagtaatgttctgtatttgtgaagatacaagctgcatgtcgtgctaatagaggaagaatgtaattctccaaaaatac

SEQ ID NO: 7963 - DNA, 641 bp, Oryza sativa
ttctgaacgtcaacttgttcggtcaatccctgttgattcggaaaaaatttggacgtggaaccaaaaccattggaaatgttatattcttagctttccatccatataaagaacgccccaatccgagcacgtatgcgatctgggcgcccgttttagtgcatactggtactggactccgaattgcactcgaagtcgaccttgtttgggcctccaccttgacttggacgtcctcgatgatcgtttatgactctaagtccttctccaagtgtctcattgtcccctccattgttcctaatcacaatataatcattaggtagcaatctattctcaaattcgtacaaagaagaatataggaacgagctcaccactaaattcaattgttgcgcgcgagctcttgttatcggtcctttagtgaccggtggaggattgttgttgtatgtatccgaaatagtgatgtccgcatcatgttccttctggtggcaagcgcgccaatcagcaaggcaacgaggacaaggagactcggctgcggtgaccagcagggttcagccgtgctgtgcatgtatactcttttctcatttttgttctataactctaatcttgtctttggcattggcagggattaattgaaaaccctgaaaaaataa

SEQ ID NO: 7964 - DNA, 790 bp, Oryza sativa
aggatcggtggtggtcgccggtggtcgcctcgaggtggtgggcgccagatccggtctccaggtggttggggaccaccggatctggaacccccgggctccgactgttgcctccttcacacttcgccaaggttgccagtcgtcgcctccttcaccatccgagctccttcgccggtcgccgcctccttcaccttcttgacgtacgagctcagatccattgccagcaagtcctctttcacccatgtattttgtcttgtgttgttcatattgttccaattgttgctactgtgattgatgattctgagtcctatggtgattgagattcttgtgattttgttttgtgattgggacaactgcgatggaattgtgacgatttttttgatttgtgaatgccaaatgcaatcggttgaaatgaatgtgatggtaacctaggaggacggtgtttctcttttttttgccccccttttatcacaccagtgacggtcccaattagttgggccgtttgaggtgactctcacctgtgacgggttttggttgggaccagtcagaggtgactctcacctgtgacgggttttagttgggggccgtttgaggtggctcttacttctgatgggtgttcaccccgtcacaggtgactcaagtcatcagtgaccactaatctctgaccgggagctgaacccgtcaaagttgagggtttgagcccgtcagtgctgacctgatctagtgtagtgattatagcttcaatgacctccatgaggctgtgccatggcgcgattgtaaagtggagggggtg

SEQ ID NO: 7965 - DNA, 261 bp, Oryza sativa
gctgtcctgaattagttaagagagttgtggatgatatgatatgtaaaatgtaaatgaaaaatagaattaatggatgtttattaacggaaaatattcctcatacatggtgtttctctgtttagacccacatgcgttttgtaatgtcagaacatagggctgattagccgcacgtaaaacatgattaatataatgtgctaacgaaaaataaggaactagccaaagccaaaacacagtttagaacagccctctagtgtactatac

SEQ ID NO: 7966 - DNA, 797 bp, Oryza sativa
ccgaggaggagagagcagcagccgaccacgccaccttgctttgcgctgctacctccaccaaattaatacccccccccccctccttccacttcactcccactcccatccccatcaccaccttccccctcgtctctctcactctctcctcgccatggcgctccacctcttcctcctcctcctcctcgcggcgagcctcgccctcgccaatgccgccccgccgcccaacgacgagggcgccaccaccatcgtgctcaaggacggcaccacctgcaagctctgcgcctcctgcgacaacccctgcaacccctcctactacccgccacccccgccgccggtcgtcacccccacgccgcagtgcccgccgccaccttcctacccctccggcggaggcggtggcggaggcggaggcaccgtcatgtacacctcgccgccacctccctacagcggcggtggaggcggcagcagcaccggcggtggaggcatctactaccccccgcccaccggtggaggcggcggcggcggtggcggctggcagcagggcggtggaggaggcggcgcctacccgacaccgccgccgcccaacccgttcctcccctacttcccattctactactacagcccgccgccgccgttctactccagcggctcgtctgtcgccggcgtgtcggccatttcgtcggcggcggcggcgacattcacgctgctcctcactgggctcctactgtggtgagaactgagaatgggatagatctgctgagttaaacctatgtctttctttacactaggtgggtaatttg

SEQ ID NO: 7967 - DNA, 5481 bp, Oryza sativa
gcggcggcgacattcacgctgctcctcactgggctcctactgtggtgagaactgagaatgggatagatctgctgagttaaacctatgtctttctttacactaggtgggtaatttgattgtggtttctgtaatttaattttttattttttattttttttacttctctctcttggtgatttatgtatcgatcaggtataagaaaaaattgtaccaaactgtaaaacatgggcaagtaataagcaccagtacagttgtactactacaaatagatggatctgctgattaaattttttcgtgccaaagaaatactatatgttcactttggatcatctggttgtgtgtcggtaacaatgtgcagccacatgtcatttcaagccagcttgtctctttacaaatgatagattgttctgcaaatttttaccggtgattgctttgcatcagcaattcagccagcaacttctgaacagataatgtttctgatctgagcagcaactaataggcactttgatctgagttagtcagaaggatcaacactgtttcttctttatcgttttatttatggtttaatcaagaaaactttctctaggagtacttgaggccaaaactctaccagcaagatattgtcaggaacaaaatgtggatgctgataaatctgaacaactgacgcaagaagtctctagttctggaacgcacaatctaattgtaataactctgcgcaaacgatgtgcagtgtgcgtacaacagtgtgtttcccagaagcaagagaacactcatctcatgcatatgcatccaagaacataaattattgctcttatccaggaaaaggcgaggatatagaggaaaacaacaacttgtacagatcatcgatgttgccgtgtacacgcagaactactatattggagctttttaaaaggtttacgtgtataaattataaaaccgaggagaaaaataaacaaaaacagaaaaagtagctttatttatagctggaagctcgatgcatcattttcagtttcgagttactgaaaagagaccgtaactagaaaaagtgatagaacgaaagtggtaaggttcaaaaggatctcaaagtgggcaaaagtaaacttgtgcggcgtgggttcgccaacagggcggagcttgatttattcggatcttctagggctgacaaacattggttcctgctttgtttctactagaatcattaacggtggcctaagggcaagttttataataagagcaggtacaataataaaccgtatgagatccatgtagaattttttgctgcgctagagaagagaagggaaggtagagagaacgggcgggcagcccgaggtcatggggcccgtagcaatggtaggaaagtgataccgtcctcgcgtgcgtacatcccgctgccctcacccgcggccaccatagtcctcgtatgtcctccacggccgccgttgttgcccgcgtccatcccgccatcctcgcccgcctttgctgtggccatcgacctcgtcttacgcggccaccgctgttgcccgcgtccctcttaccgtcctcgtttgcatccgttgtgaaatctatcctcatcctccacagtcgccgccgtcgctcgcgtccatcctgccgtcctcactcgtatccgctgcgcccgccatcttcatcttccacggccggcgccatcgcccgcgtccatccctctgtcttctcctgcctccaccgcggcaaccaccgtcgcctgcgtccctctcgccatccctgtcttctgcggctactgccatcgcctgcgtccatctcgtcgtcctctccctccatggctgccaccgtcgttcgcatccgtcatgccgacgttgccatcctcaacattgtccgtcttgtggccctcgctcacgtcatcgcgactgttgaccttgtccaccgcggccatcgccacctcttgcgcccatcccaccctcctctctcgcagctgctgtctctcgctcacgttcgtcgtccttgtcctccgcggctgccgccatagcttgtgtacactagatcgtcttcgccggcatcgtcacccgtgtccaccgcaaccgccaccatctccctcactctcacctgcgtccatgcatagggacactgccccatcctcaccggcaagaagcgagaacaaagagaactcggaaatagaaggatggaacaataaagaaaatagagggaaaagatggtgaggccataaaaataaaaaaaatatttatgttacagtaagcatatgattctctattatatatcttagctataatgtttactgcagatgatgtgcccacctattacagccggcaattggctttgttattgatcttgctctaagagagatgggtgctatctctaatcttgaccgtatcatcgactcataaatataaatgcaacatgtacactactccaatatttatttgccagtctactcttactctcttttcttttgtcttgaatttggtgtagaggttgtctagggtgacttattatctctattctctctcatctttttctctcttccacctcactatgtaaacttatgtggcatccagaagattgtggttggatgcttataaaaatttacttgccctaagcttttatcaagaagtccaattaaagattgcaaaaaaaaagaagtccaaataaaacaaatggaacttggtgacattgtattcccttccttccaaaataaataaatttaaaatataataaggtatttcacattacactgaatttggatatatctctatctaaatttactatacttgaaaatttcacatcatatattaagttgatttattttgggacgagagagcaggcagcagcttgcaggcagaggatgaggcgctggttgcaggtttgcagcacgtcgaataatagctatccttgaggggattcggtgagttgcacaagtttggacggccgctattgatattgcatctgaggcctcgtttagatctcaaaatattttgatcaaatatttgaacacatacatgaaacattaaatatgggaaaaaaattaattgcacagtttacatgtaaattacgagacgaatcttttgatcctaattacaccatgatttgacaatgtgatgctgcagtaaacatttgcaaataacggattaattaggcttaataaattcatctcgcaatttacaggcggaatctgtaatttgttttgttattagtccacgtttaatactttaaatatgtgtccgtatgctttaaaaactttacacccaaagaacttaacacaccctaaaccagcagacttgggtgggtctagctctctctatgtcaaattatcagatggatgtggaacaaaacctcgatatagatatcacgaatagtacgtggcctatacacctcaacaaaagaatcttgtctctaagcaggaaaataaacaatcgatagatcgattcgttggcatgaattatctgtaaattttaaaactttattttccacgtacaactcaaaccaaatttggggagaagaatcggagtcgggagataaagcacagtaatatcataacttaacaaaagtgaagaaaaccttatataacagagaacaaatcgaaatcagataaactgagagatatgaaacatcctttgtgacttccatccagtaataatcagcaagaaaaacacctgaactccaacaagaaaaatacccgccgatttatcacctaaagtttggcttgggtttaaacctgtgtttgattgtaaaggttgggaaccttctacttcggcatgtaaaatgggacagcacattaacgtgtaaattaattaagtattaaaaaaacatgaaaatggattagtatgttttttaaagtaactttcctatatattttttaaaaataaacaatttagtaatttggcaagtatacgcacggaaaacataggagtggaggttggaaactagaagaaacactcagccacctctctcaaccttacaaactggatgacttaagatgttttctttttagtacctagcagtacatatcataagataaattgggaaattttgatttcatgttggccagcatgctggaggtgtgtgtatttgaccactagacttttcggcttgtgttgctccaaacgacacatctacatattagaaggaagggttctgaacccataccttcgaacgaacctagtgtgaactgaccttccttccttctctcctcctccatatttccacggcctccttccaaccactgcaactatataccctccttaactgacacccctgattcaggtggtgtttgggtgtccctctcacaaaaaaaaataagtttctagggagggactcacccaaaaaccccctcacccaccccctctgtctttaattcctcacattgatggactagtcattctcatgtcatgcgccaataagcatgctcatcttttttttttttttgagaactagcatgctcatcttgacgctgcactcctctagccttcctttgaactggcatcggttgtactctgctgtcttatataattggccttcccaatctagtccttgctgaataggtgctaaattggcattcagtgctgctagtgcctggatttttggcccaaatcacaataatgtttttctaccttttgagatggaacaaatacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcaggagggtggctggcagacgcacacggcggcggcctactgctgctgctggccaacgccgccggcgacgttattcctgggtcgcttcctccggggcgcggaggcggaggagttgtcgttctcgggcgaggaggaggagctcccggcggcggcgccgacgttgccgtagaggccggccatgtcgcggtcggtgaaggcggcgggcacggcggagagcgcgtggagggagtcgccgcggaggacggtgtcggcggcggcctggcagaggtcccagtttcccgtccacatgagctcgatggcgccgctcagcgacggggatggcgccggccggggcgcccacgctgctgaacctcttcagctgatccttatcgattgagagctgtacgtattgtaagctaattaattaaagttaatttctagtagcaactgtgcagagaggttagggttcaatcgatcgatcgccaggtcaggtgtgtggtgatt

SEQ ID NO: 7968 - DNA, 2717 bp, Oryza sativa
ctcctcccccaccgccgccgcgtcgcccgtagccgccatcaccgccgacgccgccgaggcaccgcgggccttgcagagcagagaagggagagagataaggaagggagagaagagaggaaaagaaagatgatgtggccacactgacatgtggggctatgtgggtcctatgctgactcagctgtcacatcggataaaatcggattcaaaaccacctaagaatctaaagcgaacggttttgtaagttgagggatgtcatatatttttgcggttagggtacgattctgtgactcaatgacaagttgagggacctttggtgtactttttccttctcttccccaggaccacattctcagaaggcctatggaccgcagcctgaggcctgccaactgctcgcgagccgctgcttatgggctgccgtgtacttctagccgcggcttacacgacagcccagtcgaaccggcctctacctgttttggagctctccttttttttttcctatcttggataagagcatcaccaatagcatcttaatatccggtaatttaaggatttgtattgtcaaaaatcttttccaactaattccctaatcacattcccaatattttctattttctatcccgcaattgttgttctccacatctagggatgcactttggctcccaatcacgtgagcgaacgtccttttagtttttgggaaaccaatcttaaccaatctcttcgagagataaaaaatttatgacctcaaattttatttaggattcccataactaaaattttgggatagatttttgagatgacgaccaacagattacctataatctttcccaaaaaattgtttttggtttcctaaatgaaaataggaagtgaaaaaactcctccctttaacagatagcctaaattcaatccccaaaacttaaaaataggcaattctgttaaactatcaatagaaaattctatttttttcttacacacgtagaaagatcgctatctcccacgcgcaggcatggaaggagagagacgggagtgcgagattaggagcaagttccgcgcccgcatataaacggagcgaggaatcgggagaagggaactccaaaactcgggtaggagagtagaggatctgttggagctgtttttttatgctcagagaatcattctactccattcccaattatgattttgaggaatttaatcgaaaaaactactacaacaattccctactctccctctcaaaactcagcattcccttttcctttatattctcgctctccacaagtcagatattgttctcgatcccaatttccgtctcttaagagaaactgccactcgagaagacgagcaggatggtgacgctagatgggcgatcacggagccagatgacacgatctaataaggcacggatgaagggaggtccaccttttattttagggaattaaatatagaccatctattggaaggaaataagtttttaattgataagtcttcatcaaataatctcaaaaagaaatttaggaaagagatttttagacataattacagtgaaatggaagtcatattgatcttttggtcatttggagaagacatacattctctttaaaaaaaattaaaatcactgacgatatcttttctgattaagaataaaaagaagattatcgagcatatagattttatcttgaattttattcgcacgcttttaaactgctaaatgttaaaaaactttttatatagtaatttctctataatattagacaaacgcatttttaaatttaaaataattaaatctaattcacttactaatagttttttagtttgacatacatatacttaatctctatctttagcaggctgggccatagaccatttctgttaaaaaagggaacatactctttatgtcacatgaaaaaattaacctatgacaaaatgtgacatcttacaataaatttagatataagtatatttaaatttattatactagaagtatcacattttgcagagggagggtctgggagaacaagctagctactccgcagaagaaaacatgggccaatttttatagcacggcagcaggaaccttctggagctaaagctttctcttctttttttttttttggttttatcttcaccaagtgctcgtcgctgttgatatacacccgatgtaactattcatcttttgttggtgaaatatcgccaagccacttcacttcactgacaaaaaaaattctcactctagctagctagctagtgtcacttccggtcggtgcaggcaagcaaaacgtgcacaattcctgcagttcaacgcgaggccggctagatagctgaaatatctgcagtcaatctcgctgcatgtacttactaggtccgtttcaaaataattaaggtggtgtttggagccagagagttaactttagtctatgtatttagacactaattcagagtattaaatatagactacttacaaaactaattacataaatgaaagctaatttacgagacaaattttttaagcctaattaatccataattagagaatatttactgtaacatcaaatagcctaatcatggattaattaggctcaatagattagtcttgcgaatcagtccaaaattatggatgggtttttattaattgtctacgtttaatatttataattagtgtccaaacatccgatgtgatagggacttaaaagttttagtcccatctaaacagggtctaaacttga

SEQ ID NO: 7969 - DNA, 1090 bp, Oryza sativa
aatataagcgattttatttggatgtgacatattctaataaaatgaatctaaatattaagcctgtccagatttgttgtatcaggatatatcacatttaaccaaaatcatttatatttaaagacggagggagtattacacagctctcctgcacattcgagaaaaaaactgtcaagttatcattgctactttttactaggagaccgattaagaataaaaaaagctatcaaatatgtgaagactagatctaaaaaaatatctaaatgtataaaaataattactagatatacgtataaacatgaaatatattcccaccaaatcttaagtttagtctcaactttatcaaaaaggaacgaaaaagacaaatttatggtgtcatgttactgtccagaaatttatctttttatcctccaaataaagttgagttcacaattaagatttgatgggaatgtattttatgtctatacctatctatctctactaatgtttttacaaatttagataacttttaggttcggtttttaagggttttttacttttttgatgatttcactacatattttctcatacaagatataccatcactactggagaaaccttctttgcccggtcagccaaaaaccacaatagtcccggttccaataaaaaccgggactaaagatggtttttagtcccagtttataagcagaatagaactatgtgttttttagtcctggttggtaacatcatctttagtcccggttcatgtgctatctttagtcccggttcatgtgctgtcatgggctgtcaggcccctaggggatttttggtcccggttggagactctaaccgagactaaagatcttatatttagtcccggtttatgttaccaactgggactaaagattagtccaggttggtaacacaaacttggactaaaattcgatgtaccatatataatccctatgacttatcctctcaaactcctcatcttctatttttactctcttattcttttctttgccttatcctctccttccttcaagccttatcctctccttcctgccttctctcgttgcagatcgagcggcggcggagggcggcaagcgccggc

SEQ ID NO: 7970 - DNA, 2716 bp, Oryza sativa
  unsure (1)..(2716): unsure at all n locations
ccgactccgaacatcaggccacttagctggaagtcccttctcatcccaaccggtctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttattctcgatgtgcctaataattgattttggtttaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccttctccatttcatcaacaattataccgactctctccccctcatccgccatgcccatggcctgctcctcccttggttgattttcctcattttgcatcgatggtccaacaacatcccttgcattgataggaccctctacatcttcggtttgcattgagacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaactaactataaattgactgaaatgttttctccgcaggcctatcgatacccttagatgtcattacaaaatctgacagatcaacaccatctggaccaaatctaatatttccttcaccatgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaatttatactattatattctatgctctggatctacacatatgtgctgtgtgctacagatatgctaaaatatatggaactaaaactaaaacgcaatatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttataggggggaggcaaaaatcgccctcccccagggcggcaagggggccgcctgcaaattcccatgccccctcgccgcccatttgcaggcggccccccgcacagtacaaaatcgccctagcggagggcggcaagggggccgcctgcaaatttcgttaacggccgtcgcccgagagcgaacggccatccgccacgtcattttcgccgccctctgggatggcgatttttaaaaatcgccctcccagagggcggtaggcgactacttccgtcaattttcaaaatggaaaattatttttgtataacttttaataaaaaaattaaaaataaaaaaattcggtaaaagagcagtagtgaatggaccatatttctatctggcccacaacttcatgttggaccatatggtaggtggagatacaagttaaaggcccattccgtgtcatttatctattggctgttgggttataactgcaggataaatgtatatcatgatatatcatgacgtcaccagacctgaaggacttcttttcgtcgctactcccccagtaaaaaaaatcaatctaaaaggggacaaatctaaatttgttgtcttacaagaggttaggttgagttttttttttgaacggagggagtggttattttggcagatttgttcagtactcgtatcttcttttaagagagaannnnnnnnnnnnnnnnnnnnnnnnnnnnnnnnnnnnnnnnnnnnnnnnnnnnnnnnnnt

SEQ ID NO: 7971 - DNA, 4224 bp, Oryza sativa
tgcggcaccaaatggattgacacatacgctcaggcaggcaggcacataacaactgacgtgcacggttgtactactaccatataaatgaaccatgctcttccaagtaccaaataacccgtacagccgtagtattaataattcgtgtaccgcgctgggaccagtgtatggaccatggtggaaagaacttggcctcaacggctcatcgcctactcgttggtttatcgccggtcagggttataatttatttttttattatagttttatttactatattgactaattagatttcttgtggtgaaaccagtccgtcgggttatcctaaacttagtccgtcgggttatcctaaacttagtttgagtgctcgttttttttactggaaatactgccagggctttagcccagcagtgtgattttcatttattaataaaacatttacaaaatgttacaagaaagaggagaaaaccatataaagtttataaccaattaacaacagattatttaagggggtccttcattctgcagagatgcagaagaattttatttataaagagagacttccaagactgaaaggttggctgcatattcctgaaaatgaggccattatgttgcttccggatgagccaagaagaagatctccagaaaaccaggctgattgaagtgctgagtgctcgtatttatgactaattatctttaaataataggtgacatacccgtcgacaacgagacaccaatgatatctttgttaatctcaaaatatgccagcgcagtctttcaaaggtgatcatagggttaggtgtgcgtgtatgcccctcattggggtgagtgcgcgcgttgtgaacgtctgcatttgtcctgtgttttaaaagaacaattataggacaaaaacatgagggataagtcaattttacacctcttaagtattacgtttgtttaaaatacacccctaaatattaaaaccaggtagttgacacctttcaactatcaaacgattattttacatccctaaaccaaactagagtggtttttatccactgaaactgtatgcagttgaaccaaggaagaaaagagtgggactcacctattagtgaccccttcttccaccctttccctgtctttttcttgtttctcctgatctctcctctctctttctgctaacgcactcaccagccgtcgctagtgggctcctccctgtgggctgccactagcctcctcctcgacagacgtcattgccgagctccttcttgtggctaaggcaagcttgagcgtctcctccagtaaactagcacatgcgactgcaagctcaaacttgagttgtgactcctcaacccctatgccgcagtgacggatgaagaaccccttaccgagcgccccccctgccgatgtcctcctactgtcattgctcccatccctttgcagggagcttgggtaggagacagtcagcgagttcgacgaggagaggacagtggagcttgagtaggaggtaacaacataagcattgtgaagcagagaatcgaagcattgcaccttggcctcatcgacatcaaggaggtgacactcccaaatctcaactagacgccacaatattcagatgctgtggagggtagagcttgggtaggaggtcgccaccggagctctgctctgctccgagcttggccaaggagggcaggctcatcgttaccccaccttttctcgacctcggtcaaaagagggcgggcttccgtcgacctcgttgtcggccacctcttccctcgagccatgccaaaggggcaggttgcttgtcaaactcgctgtcgacctcattttcttcgagttcgctgagggtaaactccatgttgtcgtcgttggcgggagagcggagggaggaaggaggaagaagaagaaggcggcgcgcgggaaggggtaaatagtgtacccaaggcccaggctagccatctcgaaccaatccagccagcaagacgccgtcatctttcctcacgcccgactcccatgcggccacaccttaattaccttagggtttagggtgaggatctatttagtctaaaaattaggttaggattttgttttgttctcgttgtttaatttgcttcgcaatttttaggttatcatgttaaaaatgttaatttgtgccattttagatggtatatggtttataaagctataagtagacatttgctccacgcaaatactatgtctgattttttttatttgtcgttgattagattacagcgtcatataaaaaagatagagggtgtatatacatcaaaccgagtttatatgcggttggtcctcctacggcgagacatgtaatgtttaaccgttgcaaagggatcaagggtaatgcatggaaatcccgtaggttgttgtcggcgtcgctgtggcagtggcaccggccggtagcatatatctgtagtctgtaaatacggagtatatatttgttctctcctcgcatagcacgtagttagctcaatcctcggaggagtacaaatctacgataaatgtggcatgtttggtgctgctaggcaattcctcacccacccagagacgcaccaaaccaatcacgacacagaaaggacggcgcgaggtttaatcctgcacacgacacgacgacacggcgcgtcctgcctgcttcatggtcccccacgcattcgcgtctcccgtcatggagccctcgtgcccgcgcgcgagccgacgaacgcccacgcgcgcccacacggacacggaggcattgctgttcggtgaagacgacgacgacgacgacgatgacgaccgaattcgatcggctacgacggcccgcagacgccaccgcacggaatgaaggtggtcgatcggatcgcggcgcacaccgctcgccgttaatgcgagtcgactcagacacccaaccatcaccagccccggcctccacccttccttaaatgcgacgctatccgtgcacgctcctacaatgccgttttgtgcaaatgcacccctccttgtgtctgcatttgcgccctgttccgctccgatgtcctgtgcagtaggggtgtactagtggtacaagctaatactacttgctccatgtgctaattttgtgggtaatgctggttctttgagttactaaattagagcaagtagtatagttcactactagttccaaatcatctatagccaatgtaataatcaattcatacaatagttgtttactatagtattaagcaggtacaatagaaggctataagccagctgcaaacatattttaaagagataaatgaggagagagaagagcagcgggctacagatttgtagccagctgtagcacggactccaagacacagtgtgtctatgacaggtgggaccagctattaataatatagtactccctccattccaaaatataaggtacaaccactcttaacccaaagaccaagaaatagttattatcaccttgtagtttggatcatcctaataaatataatgcatgtagccaatagagttagagaatatgagggtgaaggatttaaaaaagtagtaatttaatggagaattgtcatagttaatgacatgtatgcatgtatgccttatattatgtaacatctaaaaaaagtggttgtgccttatattatggaatggagggagtatgtaactattgtatgaatcagctattagattggctatagatgaattgaagctagtagttggctatactattaaacttggtctaatatatactcccatctatcatatacacattacgtcttatagtctgtattgtagctgactacagatctatagcccgctgctcttctctttttttttatctctttaaaatatgtttatagctgacttgtagcctactattgtacctgctcttatgcgagctgatcccgttgtgacacatgtgttaacctgcttgtgtcatgaggaaattatggatcatctgtctgttatccatttctatgcggagatttcatcagcaaagtaccgatcacgcaatgaacaaccggtacagattgtacaaggaccttctaccgattcaatggatcggaaaaatgtgacgaccgtactttatttttcagcttataagctgatgtcagaatttatattttaaaacttaaatttagagttaatttttctagaattttcttttaaatcattaaggagatatataaattgttatttataaattatattttaatcgctactaattaagtgttatggtttataattagttataggcaaaatgataaa

SEQ ID NO: 7972 - DNA, 956 bp, Oryza sativa
  unsure (1)..(956): unsure at all n locations
nnnnnnnnnnnnnnnnnnnnnnnnnnnnnnnnnnnnnnnnnnnnnnnnnnnnnnnnnnnntagaacactactgacgaggcctcttacccctgtccctcctaccctacgccctaatgtgcccctgggagtacgtgagtcggtccgggggtacgacacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggactagtcctaccggtgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtaagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaaaaaaaatgaactaatctctgggttgaactgtaccgtgcgaaaccggtgctgtaggtcgcactgctctgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcaacttctcctgcatccggtcgaaggtc

SEQ ID NO: 7973 - DNA, 754 bp, Oryza sativa
  unsure (1)..(754): unsure at all n locations
nnnnnnnnnnnnnnnnnnnnnnnnnnnnnnnnnnnnnnnnnnnnnnaacatgatgcggacatgactatttcggatacatacaacaacaatcctccaccggtcactaaaggaccgataacaagagctcgcgcgcaacaattgaatttagtggtgagctcgttcctatattcttctttgtacgaatttgagaatagattgctacctaatgattatattgtgattaggaacaatggaggggacaatgagacacttggagaaggacttagagtcataaacgatcatcgaggacgtccaagtcaaggtggaggcccaaacaaggtcgacttcgagtgcaattcggagtccagtaccagtatgcactaaaacgggcgcccagatcgcatacgtgctcggattggggcgttctttatatggatggaaagctaagaatataacatttccaatggttttggtcccacgtccaaattctttccgaatcaacagggattgaccgaacaagttgacgtccagaatctgttccggtgctgcatcaccgtatttgggcctttgagctgtgtatcgtgttggaacccattagggttgcgtcaagggttggttgcacgaccccaaactctatatatcagtacccgccgtcacctttagggtttggattttgcttagattattctgtcgagaacaattttgccgctagatcggtttgtaagacctcaacttgtgagcttaatcatttatctgcaattttggttgtattcta

SEQ ID NO: 7974 - DNA, 4215 bp, Oryza sativa
  unsure (1)..(4215): unsure at all n locations
atcagaacctttcagaatatcgagaaccctagtccacatcagaacacatgcacacgccaccgcatggttcttgtggtgagctatgcgagaacgataaaccactaggccttgatctgtcgacttcttgataaaaaacgaggcaccattcatcattcaggccaactgaagcatactagatccccttttttttccgtaaattttgggtatgccggtgcccacccgacacatccccagggtccacccctggcttaagtagagtactgagagggtacatgtgggaccggccaacagaaatggcaaacaggaggaatagaaacgggaaaggggagaaaaaagaaagaagatatgttttcggatacaatatgctgtaaagggtgtggttttgtgataaaagattgctgaacttgtgaattttgcgataaatatgtctcaaagcttggtgttttgtaataatttactgatatgctagtggacggttgaagagatgggtttgcagtgcttccactagcgcttttcagtgttatttaggtgaggtgataagtcctaagaagagaggttggagaagggggcaaaattaaaattttctattgtatttgttgagaaaccagtctattgtattgattaacacacaagcaaacaaacacataattgtgaaacacagaaaatatggacaagtggaagctttatttcttctagatttaagtataagctgcaagagaagaagaggaagtgcccgagatgggtcaacctcaccttggaccttcagagccctatttatacgcggaggaggttggcggcttgcgatgtaagttggtttccatggcaagcttgcttctcccgcaagctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagttctacttcgagaaggggacatctatgggtataaatacaagccccctaggaagagaggggacacgccacgagggcacaagatacacaagccaatgcaaaccaatatgtcaccagataccgacatcagagattagcctagacaaacccaatccggtgcctacggaggccgacaagagggattagcgctatctctgatctcgacgagttcatatttgaggaggaagacaactctgccgtcgactacgtgttggttatccatgccgccaaatcgacgaaagctagataggttatccaaatattgtacttgtgtgattcagatgaataagagcaacaccggcttcggccaacatgatgtagggctattacctgtcagataaggggcccaaacatgtataaaatccttgtctccatctcttttacctcaatctcacatataccctggtaccgacgatctccatactatccaaataccgtagtcgcgatctcaaacatcgacagtgtaagggtatacctgagaggctatacccgcctacagtatttgtatagtatgagaatcgttggtgcaagggtatatgcgggattgaggtaaaagagatggaagatggtgatttttatacaggttcgggtccttaactaacaggtaataaccctattcctgttggccgaaacatgagttgcctttatttgtcgaatatgaacttggcgagattggagttgtgttatattgacctgtcttcacctctgttagcctatcccctctacttccggggagtcttgtatttataccctcgggtgtccccttgtccaagtaaaactaggaaactaagtatggatacgatctgagtagtccttttatgcctaagtagaactttgcttctccttccttatctagaacacctcccatatatgaggcttttgtataagacttgatatatggtgggcatcgccaagcctaacacaaaagttataggtatgtcttttctataacactgacaatactctatatgttgaaaaattgaaatgatgtgagaactatgattgacatgcttgaagtaataaattgtagatgatgtgacatagttgcatgagttttaaatgctctatataataattgatagtggatgatgatgtttcatatacgtatgttgagctttgaaagtagtgtgtacaacaatatagaagatgtagatatatctttggaagtggcattattgagttttctctctttcctaggctttatatcctgcttcttgggccttgactaggctagcttctcctgttctttgaacagctattcccgattggaataagtctattttaccttcctcaactctttgtgttgattgaatcccctccctcaaccgcaataccgagtataacatcttctccatcttcaaaaaccgatacaaatcgagtccctcaacggtttggtgaccacgtggcatgttgacttggtcttcatgccatgtggtgtctacgtggcacttacgtgtcatttagaaaaataaaaaataaaaaacttagtgggaccaacatgtcaatcaaacaaaaatgtaaaacatagtaggctcacatgttagtcttctctccctttacccctatccactcaacagaagcttgatcgccagcacagtccccttctcgtctcctcgaacatagcccggcaccagatctagcctcttccccatcccatggcgactgcgggaagaagggttacagggagggccgagcccgacagagacaacgacagtttctcctctcctctcttctccctactctctctctctctatctctcttccccttttctctccatccatctcttcgagcggagaaaaagacatcgacgatagtgatgggggacggtaggctggcgagggcctcagctgcgcctgtgatgtagctccgtcgtatcgcccacgacctcaactgtgctgcccagatgtacggtgcagtggagctacgctagtcgattccccctggcggcatcgcggtccccggagagaggccgatgggaagagatctggcaacaaggagcacatggatagagtagcgctgcttggtgggggggggggatccggcgactgccactctggaagatccacgccctttggaggctggctcaatgaggactgagactgactgtggcaggaggtgcacatccaagcattggaaccatcacggtagcgtatggcggcttggtagagctcgtcgtcaccgggatgggaagggggaaatggaggtcggggatgggagtgaagggggaggggacaagaggagaatggatgaccccatcattgtcaaccattatcgcgcttgcaatagctaccgctttcaccgacagccatcgagctcatctaccgaccgcctccgccgttgctgccccatcctcgccgaccgccaccttcccgtggacgagctagagagctcgccggccactgccgacgccggagatttggggaaaagagattgacacgtgggcccgctattttttatttttttcactaacatgtgggtcccatctagtttttttttattctagtaccacgtaagagccacatcatcatcacatggcacgaagaccaagtcaacatgccacgtaggaaaaaaaaccaccagccaaaccgtcgatggacttgcactagttttcaaagatagaggagccattatatccggtactatggttgtaggatgtgattcaactagttgatannnnnnnnnnnnnnnnnnnnnnnnnnnnnnnnnnnnnnnnnnnnnnnnnnnnnnnnnnnnnnnnnnnnnn

SEQ ID NO: 7975 - DNA, 11639 bp, Oryza sativa
ttaaaatactctagataataattgctagtgggtgatgatatggcacacttgcatgtaatttaaaatgctctagataataattgctagtaggtgatgatgtgatatacttacatattaagtctttaaaaattattggacatcaactttacagtaagataagatccggggttagaaaagagggagatatgatagatctattccttcattgtcccttgctcacaacatattcttgggccttaagtgggccaaactccattaatctttgcacagccggccggttcacggttcgttggttcacaaagtaggcaacaaatcatcattgattaacgatcttaaggctgagttctttgtgttggaaactcaccttccatgtacgtaaaacttaacgatttattagcattagcgtatgattaattaaatactccctccatctatttttggtagacatattttcaaatctaaaaaaattatttttgattggcatatttcaatccaacaacctatcctcttaaagattttttcggatttaatgtgtgactccattttaccacaaaagattggttacatgggcatcgagaaatataaatattaatgaatcgctggtttacgaaaaataattagtagcatgtttaaataaatgataagtagaattacttatatttggtctgtgtgccaagatgaaatatgactatcaaaagtagacgaagtgagtattaagttttttttaaaaaaaataatatgctttttaaataatttccgtataaattttattgtaaaagtatatgttttagtagttcgaaaaatatgcacgtgaaaaagagagagttgagttgaaaaattcaactaaataactcagcctacgaccttatttagatgggactaaaacttttaagtccctatcacatcggatgtttggacactaattataaatattaaacgtagactattaataaaacccatccataatctttgactaattcgcgagacgaatctatttaattaggcttaaaaatttatctcgtaaattagcttttatttatataattattttttaagtagtctatatttaatagactaaattagtatctaaatgatccaaataccacctaaagttccaattcaagtcaggttcttaaacgaaacctaacaacattgtttatacttttgtttttgtcctgtactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcaggttggttcgccatgccggcgcgaatgtccatcacatcggcgtcgcgtcgtctccgatgagtaaagctagtcggcggctgaaacaggaagggcgccttaacgtacgagaggacacaggtacaaattgttgtgcttttcaaatttgggcctagtttagtttctaactttttcttcaaacttttaacttttccatcacattaaaatttttctacacacgtaaacttctaactttttcatcgtatcgtttcaatttcaatcaaacttccaattttaacgtgaattaaacataccctggttcaactcgtcagcatggcagggttttactctttgaaatccgtatatctccctcgctttcatttcttctcgcttacgttttcttgccctttggtatggttatttcatatcatctgaaattgactttcgagattttgaagaaaacaggatgatcaaacatatatgcaagaccataaccatatagagatagttcacgatttttttaggaaaaagtacgaattaccctcccgaactatcgttgttaaccgaattaccccataaaccacaaaaccggacattcctcacccccaactatgcaaaccggacgaattacccctctcgacacaatccgcggtggttttggtctacgtggcgtacgcgtggcagtccggtcagcattctattcattaaaaaaaatgtgggacccactctcttctctctcttactctcactctcactctatgtcatctctctctcacgcgcacagcggcgaggacgaggggccggaggcggaccggagtatcgtactttttcctcttttttttgtttacgagcagttggtttgatagccagaccggagtatcaattcatcatttcattgttgaatcgggccgttcaattcctctattggaattagaaggatgatctgggctattttgattataggaattctataagaaattataggatttcaattttcataggatttattccatctcttccaaaataaatcaaaatttttatataagaatctagagggagagattaagtaccacacttgaaatagcggaacaggggacagaaaatagaaaatcgaaggaatacttccatggatctaccaacatactccatccatccataagagttagacttatttcatattttagtgtttccaaataaattatttctagtctctatacatccatgacataaattgaggggtaaattaaatgttagattagaacccgaacccgaggagctatattaatacttattggttgcatgcatgcatacactcattggtccttgttacgtgcaagatgagttaatttttctttgatcttgatgataaaaataatagtgtaacttttgtgaaagttgggagtataatacaaagatttattaaattcacaattaataaataaatttgctgaaagagggagactagggagacgggatgttgttagggtgatgtgagcttttacgatgctcgtgtcataacgatgttagagcaagtttaatagtagagctaactgctggccataaatcatctataacttaatagccaattctacaatagttacatataaacatatactacacaatcaatatctggtcccacctattactacacaatcaatatctggtcccacctattatatacacatgcgtcttagagtctgtactgcagctgactacaaatctgtagcccgctgtcttttctctccttttttatcttcttaaaatatgtttatagctggcttatagtctgctattatacctgctcttagcagctatttctggttgataactatttataccgcacatgatactgtcgataccagaaatgatatcggtaccatgataccaagatatcaaaggtgtcaaggtataatggctatgggtagacgtcgatctacctttgaaagggtcacttagacattgatgagggtgaatagataatttaaaataaaataagtaagctaaaatataaaccaggttagattttcttagactaaattctctatatacccttgaaaacaaacacaatccctttcatacccttgaaatttaccttatccattcgatacccctgaaattttaacttgatcctcttccatgcctctgcagttacattttccttcgtttcactgttaagtttggttgcaaatatcttttatgcccttgatgatttatgtttgaatataaacttgaaaaacgattgaaaattttgtttgagtacacgatatatgcattttatgaaaccaatgagactaaataattagagcataaaattttgccataaattttgaaaataaaacaaatgtaataaattattttttctatttaaaattttaataggacaatgaatttttttatcggggcattcatcaaaaaatatcataggcattggtagtcctatcttttctatggatactcctcattcttatgacttttttaaaaataaaataaatacatatttttattttattatctaaaataaattttatcctaaataatgtatctcacaacaaacacatatctataatagtctaatgcgacaaacttttatattttcaataatgtaattcataaatttctatgctcattcaaagggtaaaatggtcattgttggtattacttaacgacattactagaaatataattcccagcaatggcgcagaaatactcctggtatattatggttatagatttcatccgcaagcgcacggatataccattgtagcattttacccgagagtattccaaaggtatcgtatttgtttatcccgtggaaagattatagtagagagaatcgtactaataatttatatattacttgtaataaccatagtctaagcagggggttaatataagcagagggtagagtgatacacaagcataagactattcactctcatattaaattatccgagctaagtggaaagaaaatagaaaagaatatattcctatacttctagtatacataatatacatacatcctagctataagattaactagctaatacccttattccgatgccctcctggtacttcgagaagccaccccctactgccgagtttcttacgacagcccatcatgaccatacaaccggggctaaatacgaaggaataccctccccagggaattaactaaggactatatacacgcgcggaggaatacccgtaccgagctgtcaccatcagcggcccacctctcttccgcagcatataaccccaaataatgctacctagtaatctagacaccacgcctaaactaccaaatactactctaatatcatcgtcatgacatagaataattacataagcaaacattatacacgtaccgttgcatctcccagataagctagaagtataatcaacataactcagatataaagtaaaattggtattcatatactcaaaaagtattacaacaccagagttgtataaagaagaatattctaaataaagtacaagtcttacaaaagaagaaaggagagctactggagctatacccgaactcttccgaagacttccgaactcatacttctattctattcctactccactagcttgagaatactaaactaagtttgagagagtatgagagagcttgcttgaggtgtgtggagaaagtgagaagatgagctccttaaataggctgccaatgacggttgtggcagttggaatggtcggaattgccctccaaccgtcattggggagcgatccacgccgtccagaagaaaccctgcatccaacggtgccagggaggggttcggctgaaccaggggctgggccttcctagcctattttcagtaggtggcctcctcttttgatccctgtcacagacttgtggattttggtaaaattcaacgtgtcatttggctgagttcttggcccattcatctgatttccgacatcatctgattgattgatcgtctgttttgattttgattctcctctattttatgtttattctctgcaagaggttagtaatcctagtgctaatggaatatttattattctaacactatttctcctttattttggtagtattgactgttgaaactgatcgttaacgactgtcaatagtcatttctatataaatttgatggtcaactgaggggaagggtatggaaagcatcaaaatcaaatttcaagggcatacaaggaagtaagcaaaattcaagagcatataaggaattagctaaaattttaggggtatacaagggattaacgaaaatcccttatgtacctataaattctcacgtaatcccttatgtgcccctaaattatgccttatcctctatgtacccttgggttttcatctttatcccctatgcgtattacatgagttgactaatttttcaaaaaatgtttatatcacccttgtgtctacttattgcttagagttgattgaagaaaaacacccttctcaacataaaagttgattcatttataaaaacaaacatgacataattactttatcataaatttgataactaaaatttagatttcttttaaataagtttcaaattagatttgatgaaatttgttcaaaatttttactgaaatttaaacccaaataagaaacaattttggtttttcaaattccgaataaaacttcttgtgtatttcatttttttttaaaaaaagcttgaaaatttatattttgttttggaaatccggtgtcaaatatgtcccttttgatttttatcatagattaagattatttttataacaggacttgtttttaaagtaggtaccataaagtacgggtaatatagtcattttgggataaatctaatggtcaattcatagtcaactcacgacaagggtatagaaggataaaaaaatctggagcgtactaaggatgaagtaaaattcaggggcatataagagattgagtgaaaactcgtgagtatgtaaggaattttctccaattgtttatacgcttgaaagtgtttgcaaaggaaaatggaacaatcgaatcgacatgaaacaaaaccaaaatcgctacagatcaatgacagagggagtgggagcgggagcgtatcgagggatgacaaaaacactatggggtcgaagaagggctcggatttaacagacgacaaaaacgttactaatgtgtaggtaaagataacgaaaaaattagtttgaaatggacgaagtaattgtttttggaaaaatataagcctttcaaagctaataaaaactttgataatagaagttactagcattaacgacagtaggcatgatcaggattcaggattcctctctgatgcttagcacagcccctgtctgtgccctctcacctgtttcttcacctacccaatctaacatggagtactgccttaacccaaactctcccaattcccctcttcaaacaactacgccgcctccatgagctccatcacggtgcttcgctggtgctggcgccttgttctccgctcttccccttgtcttcttcgcgctctatccttcaccaccgcctccgacaaccctatgctgcctctacaggcgacttctccatctccggcatccttctcgccaggcggacggacggttggtttgcttatggaaggtggatttgttggtgagtgagtgaccatgcagtggaggcatcctccgcgggggctaaggtgaggcagattcgccggggacatggagtcatgcgtctgcgcgtgcgcgtggccaactgcgcctaccgtggtggcactcttcgccaccggttatgaagaaggggtggctgaggcgcctcatgatgtcgatcccatggtgagacatcagaccggaataccatctctagagcagcagaaaattgttagaaatctgatgtcttagagagaacaagtctagtgctatgataaacgtggcagaagtaacacttacgaatcaactgttgcatgcattcttaacattcttcattatatgctacactaaacatgaacagtcagtcatgttatccatgtctgcgagttcagtttggcattgcatataacctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaggttcattcggtaaagtctacaaaggaatgctggatggtcgatgccctgttgctgtgaagcgatacatacatggaacccggaaagaggagtttgccaaggaggtgatagtacattctcaaataaatcacaagaatgttgttcgacttttgggctgctgcacggaggaaaatgctctaatgatcgttatggagtttatctgtaatgggaacctgaatgatatccttcattgcagcaacacaaatggacgtgttcctttctctttgggcaaacgtttagacattgccattgaggttgctgaagtgctctggtgcatgcattcaatgtataatcccgttctccatggtgacatcaaacctgctaatatacttgtggatgaaaatctttcaccaaagctatctgattttggaatagcaagattgctttgtgctaatggggctcaacatactaacaatatcattggatctataggttatgttgatcctgcattctgcatgaatggaattctaaccccaaagagtgatgtttacagctttggagtggttttgctggaaatcatcaccagaaaaaaagcagtggatgggaccatcacccttgctcagcgtttcactgaggctgttgaacaagggaagaaggtgatgcatttgtttgacgaggacatcaacaatacaaaaaacatgaacttcctcgaagatattggcaagttagcagttaaatgcttgaggagggaggttgaagtgcgtcctgaaatggttgaagtagcaactagtctaagaatgattaggaaagctctagaggaagaagagggaaatctgattcagcagaacataagtgcaccaagcaactcaattccttcaaagaatgtgaagtcatcagcacagcaatttggcaatctaaaaatctttaaacaagaggaaattaagcttatgacaaaaaactacagcatgaaatttagggaagagttctgtgaacggctgtacaatggagtcattggcacaacacatgcagttatagtaaagcaagtgagaacatcttcagaaagtgacagaatgatgtttctgaagactatgagcatactgtctcagaagtatcacaaaaatattgccaatgttgctggcttccacttaggggattccatttcagagtgtgtgtatgaatcttgctgtgatttatcccagggaaatgacggccatgtttgcttctgtaaccgaaacctttatgacattatctgcaccagggaaaaactcccccttcatctacgtttatcaatagccgtccagtgtgcagagggcctggttcatatccattcattgttagctgaaaatcctgattcacattctacaggcctcttgggaaacttcaggtcgatcaatatttttctggacaagaacttcgtgccaaaagtcttcaattctaatttatcaacatttcttgggctttcagtcatgcagaaacataccgcctctgtcgatcgtcctaatgaccaaagatcacaaatatattatttagatggaagggatatttctggtcagctgttcaatcccaagtctgatgtttatagctttggagctgttcttttggaactcatcacttggaagacagtgagatacatgtctagtggaagagttcacatgcttaccaaagacttccttgatacttatagaatagaccatagtgcagcgatatcttttggcaagaaggtttatgatgagcaaggtaagtgttttattcacgaggcaattgctattggagttgagtgcttacaactgatgtccagacgcggccaaaaatgagtgatgttctttcacgtcttcggaccatctctgcagctcagagtattagaagcaaactcatcatggctacacaaacaaaaggttgcacctcttagaccaataaatttgcacatttatcacatggaacatagtgcagtcaaacttctaagattttaaccactattgtatgaaaaaaatgccttacaaaatactacctttgcagcctttgtaattgtaattcaactacaagtttctcacacattgtattgctaatagctacaaaaccatggtgtgatatgaaagcaacttaaaatacaatctaatggaccattttaatatgactaggcatatatgtaatttgactaacggtaaaaacttacaaattttgaagtgtttacatggcttacaaaatcgaacagatgggtacctccataaacattttggttttaagttttttacttggtccataataactcccttgggtttcaaatttactcaaattaaaatggccaatgaattcggtaatagaaaacccattcccatttagcggggatgttctttaaaatgtattattctcatatcaaattttcaggtatagcaatactcattttaatcgaaattatgatagatgaatttaaatgtgcaccttgtttgcaaaaatataaatattattgtgctaagtacttaagtagcacttccctctagccacaaatacttggacgttttagatacgatccagtcaaaattttaaaactttgatgtttaaaagttttattttaaaaacattaaaatgacatgtgtagatttgtctggttgtccagaaaggtacttccataatctcataaacttgtattttactacctccattcctaaaaaaattcctttttagctatgaacctagactgtgttgtccatgtttatagctaaaaaggcactcttcagaaagggaggtagcataaaattattgttaagagatgcactttaaagacattaaaaaaggtcaattttcaaatgtcaagtatcttttactggatggagtacaactaacaaaatacgaattttgtaagcagcaattaacttaatctattggattttattcttttggtttctccaatacagctagtggtgacaacaaaccaaaccaacatgtagcccctccccttaccaagaagtttgtcaaaactccaccaactattgtatcgatcattcccctgaacatattggagaagataactagcaacttcagtaatgatgccctaataggagagggcccagacgccagagttttctttggagagcttagtgatgggcagaaatctgcaataaagaagcttgatcctaatgaaaaaattgtagtgcaggtcatggatgcatgtcttgcctttcaccttttgagttgatgctctttattcatgagtacttgaagcaagggaatgccttctcaattccatgtgtcttgcaggttttgaccatttcaagaatgttgaagcatgacaacattgtccaaattcttggatattttattgaaggggaaaatcgtgttcttgcttatgagtatgcaccaaaggggatccttgcacgatattcttcatggtaaggaataacaaaagatttttactttgacatattcctatcttgcttgcttactgtattatgatcaatagctgaaataatatgatttttttactacattactttatgtgttgaattgcttgttgcattactcaagagggtgtcagaggagcccagccaggaacacctctatcatgggagcagcgagtgaagattgctctaagtgctgcaaaagggcttgagttcctccacgagaaggctgtgcctcctgtcatccacaccaacatcaggtccaacaacatatttatctttggcaatgatgttgcaaaaataggtgacctcggcgtctccaagcagctttatcctgaaagtgataatgactactacaatacccgactatatcctctgcgcagttttggctatgatgcaattgcaccagagtatgcaatgaaagatttccatgcttgagtttcttacagtactagtgcctaagcttggatatgatatgcattatcctactgatatgttctttccttcgttggttcttgttaggtgtaggaggacaggacagtaaagtgtaaagagcgatatctacgctttggggctgtactgttggagcttttaactggtcgcaaagtagttgattattcactt

SEQ ID NO: 7976 - DNA, 655 bp, Oryza sativa
  unsure (1)..(655): unsure at all n locations
taaaaaaattcctttttagctatgaacctagactgtgttgtccatgtttatagctaaaaaggcactcttcagaaagggaggtagcataaaattattgttaagagatgcactttaaagacattaaaaaaggtcaattttcaaatgtcaagtatcttttactggatggagtacaactaacaaaatacgaattttgtaagcagcaattaacttaatctattggattttattcttttggtttctccaatacagctagtggtgacaacaaaccaaaccaacatgtagcccctccccttaccaagaagtttgtcaaaactccaccaactattgtatcgatcattcccctgaacatattggagaagataactagcaacttcagtaatgatgccctaataggagagggcccagacgccagagttttctttggagagcttagtgatgggcagaaatctgcaataaagaagcttgatcctaatgaaaaaattgtagtgcaggtcatggatgcatgtcttgcctttcaccttttgagttgatgctctttattcatgagtacttgaagcaagggaatgccttctcaattccatgtgtcttgcaggttttgaccatttcaannnnnnnnnnnnnnnnnnnnnnnnnnnnnnnnnnnnnnnnnnnnnnn

SEQ ID NO: 7977 - DNA, 1567 bp, Oryza sativa
ccaccaccaccggttggattcttgtgcagcggcgcggcgcgcgtacaagcggccgtgcacggtgaacgagacgggagcacgcagcggcggcaggggggtcagtttccacccggaggaggcggaagctgcgtggaggtgtcgactcgaacgcacgcaaccgtgcacgcacaccgctagatcggactcatcaaccccggcgttttccacatgcgtgcgcacgggtactctcgctcgggcggccgctgtatgggcggcggcgttggccccgcgcgcgtcaactcagtagtcagctagctctcgtggctggatcggatcggtcgccgccttgcataccgaccgttcgccgtgaggagagatctgcgttctgcaattctgcacgcatgaagtagctacaagtggggagagggaatagttaattggggtgatataggttgatctgcaacgacggacacgagcaacggcctgatgcatatttccgcgggtatccacatgcatgcgtgatgttgaagtgtttgtgtttagcttaactgccacttgcagcttccgtccattttgggattgcatgtctgtgtagtagtactccgtggtagtactagtactagaatattttggttgttggggaatggcaaattaaagcacgagttgtggacggttgaaacacggtcggtccgaactctgaacatgccgtgagcccgcgacgcggcgtgtcaacactagccaacaatcactgtatccatgcaaaatttgtcacttgcctacccaaattgtacctgtgatctgtcgaagctataggttgtacccttctgtagtactgatcaaaagcaggttttcctcctccagaaataataatcacgtcgtaacaatactaaaagagggaggatgcactaatctttctgccacagctgcaggtatcctctctctctctctctctctctctctctctctctcacagtagctctttacacctcagagatccatcatgatacgaacgagcgatccccgccttccagaagacacattgcacatggggggcagtcaagcaaactgatcaagctgagggcgcagacaacagaacatactacggagcagccaaaaatgacaggccggccagccaccgctctgcccactgccctgcactgcacaacaacccccaccatcccaatcaaactcagttgaggctcagccccacgccgtggtgcgtgtaaaactggtagaaatcgccgaacgggctgatccgctgaggcttcggccggagtaaggtggcgatagtggtagtggggttggtggtgcggtgcctgaaccggaatctccacgcatgcctgtgtcactgtttgtgtgatggtcatacctgtgtcactgtgtgtgtgtgtgacggtgcgttgggcccgcagctcggtcaaacgttgtgttgttcggtctgtttgatggtcggggggagcggacggacggtgcgtttggttcggtagattagtctgtggatgtagggtaaaaacggtacggaaaaaggaggaaagcatattatcgttttggtttttattttttttaattggaattggaaaccttggaa

SEQ ID NO: 7978 - DNA, 3374 bp, Oryza sativa
  unsure (1)..(3374): unsure at all n locations
nnnnnnnnnnnnnnnnnnnnnnnnnnnnnnnnnnnnnnnnnnnnnnnnnnntgatcaagctgagggcgcagacaacagaacatactacggagcagccaaaaatgacaggccggccagccaccgctctgcccactgccctgcactgcacaacaacccccaccatcccaatcaaactcagttgaggctcagccccacgccgtggtgcgtgtaaaactggtagaaatcgccgaacgggctgatccgctgaggcttcggccggagtaaggtggcgatagtggtagtggggttggtggtgcggtgcctgaaccggaatctccacgcatgcctgtgtcactgtttgtgtgatggtcatacctgtgtcactgtgtgtgtgtgtgacggtgcgttgggcccgcagctcggtcaaacgttgtgttgttcggtctgtttgatggtcggggggagcggacggacggtgcgtttggttcggtagattagtctgtggatgtagggtaaaaacggtacggaaaagggaggaaagcatatttatcgttttcgtttttattttttttaattggaattggaaacctcggatacgaaaacgaaatcaaatattatcgaaatcgaaaacggagataaaataaaccggcgcgaatacggtaacgaaaatttatcggaataaaaaacccctcaaactgataaatccaattctcaagtctcaacggtcaacaatctatctattatatctataaagtaataaaaaaagatcctccacgtccgctctcatggtctagaaattctcacattaataaaaaaaaagaaaaatagaactagattaggattagtattagttaaaaactgaagaaaggaaaaaaaaaaggcatactaagatacttgaatcggacagcagtcaaaaactttaaaaaggaaaaccaaatcatattatacactggaaacagataatgttatgagaatccgcgtgttcacaccgcttttagaaacattgaaagacaaaccagtactaatcaaactctgccggttccgaattctattgttcgctctcacgcgctagaaattctcacattaatcgaaagaaaatataaggaaatatagaaaagatcaagaccgtagaacatattttgcttcagattatacgttgtagattgctttcgtaggatccaggaaacggacaaggtttctttcgatttagaaagggtgaatagtcagttcagtccttcaacttttgctcagaggtcgaattagtcctttatattttataatgtccaaacaggaccctaaaaattatcatacggcttaatatagtccttatacccacttaaaacgccacatggacatgccacgtcattcgtgcatgtaagataacatttaaatgtccattttaaccttcaattttctatcaaacaaagaaaagaaaataagaagaagcaatcataaaacaaaaaatgttattttttttatctatcaatgctacatatttttgccaatggtcaaaaacttttttttgtgtgtgttttctcaatagtttttctttatttcctataaaaacataagggtgtaaaggacatttaaatattgaatttacatgcatagatgatgtggcatgtacacatggcatgtttagagggtctaaggaccatattgaatcacacaatgaacttaaggtatttgtttggacaacacgaaatgtcagggactaaattgatccttaagtgaaagttcaaggatcatgttgggtattcacccatttagaaaggaaaaagtacgaatcacccccccccccccgaactatcgcggtcgtccgaattacccccctgaaccataaaaccggacattattcacccccaactatgcaaaccggatgaattacccccctaacccaatccgcggtggttttggtctatgtggcgtatacgtggcagtacagtcagcattttatttattaaaaaaatatgggtcccacctgtcatactcctattccattattcctcttcctcttctctctcactcttcctctctctctcttctctcactctcaactatgcaagcagcgggcggaggagctgaggcgagccgcggaggaggcgagcgcagtggcggaggaggcgaggcatcggcgaggaagggccgcgcaggggcgggcgcgagcagcggctgggtggcgagcggcggcggggtgcggcggaggaggcatgtactatcttatcccgagcccaaccattttcgtcacgacccaagctggcatgctgccatttgccactgtgcacgtctgcatcgtccgccaacgagcacgtacgacgagcttacctagctagctgactgctcgagacgtgcgatttttactcctcgcggtaaacgattcttgtgaaggccaggtctccggcgctccatgtagccaccgctccctcgccgatggtagtatagcatggtggggggtttagtgctctcccaggcgcagcaccaggtcgggatcgccgcgagtcgccggcgcaggcgcaagtggcggagcaggccgccttcaggggaagggatcaccgggcgccatgcgagagcctggacgaggcgaggaaggcgcacgcgcgacacgtcaagctcggcgtcgaccgctcgctgcggcacgcgcggccgctcctcgcggcgtgcgcgctcgccgccgactggcccgggagcatggcctacgcggcgtccatcttcgcggcgctcgacgaccctgaggcgttcgactacaacaccctgacgcgcgactactccgcgtcacccgccgctgccgcccccgccgccgctctgtccctcgcctgccaccgccgcctccgcgtcacccgccgaggccgacgctgctctgtcccctgcctgccgcccatgagagagaggaagagtgagagagaagagagaggaagagtgggaggaaaacaggtgggtcccataacttttttaaaaatagaattgctgactggactgtcacgtaggctaaaaccaccgcagattgggtcgagggggggtaattcgtccggtttacatagttgggggtgaagaatgtttggttttgtggttcatgggataattcagacgaccgtgatagttctggggagtaattcgtgctttttcctttagaaaacgtatcggacactaattttgaaaccgtgtgagacactaataaaagacagactaaaaaaccatcatcgtcagattcatgcaatctgaattgtacacaaattacatgccatggtaatatataaatagtacgccagaaatcatctctccacaatccaccgcaacaaaaaaagaaaggaaaaaaagattgagtactatttatgaaactctctaccagccaaaaagacatcaaaagggatccgacttttagcgatgaaaaaattggg

SEQ ID NO: 7979 - DNA, 10179 bp, Oryza sativa
  unsure (1)..(10179): unsure at all n locations
nnnnnnnnnnnnnnnnnnnnnnnnnnnnnntagagtatataggaatacaatttaaaaatagctaaaattcggtattaaaaataagaaatattgaaagaatagactagagtccatacaagcatacaatttagaattaattaaaattcggaattaaaaaataggaaaactaaaattagaagttagagtccatatagaaatacaattttagaattaactaaattcaaaattaaaaaaagtaagattgggagaagagtcatagtctatatttgaatacaatttataaataactgaaattcgaaattaacaaataaggaatactaagtaaaaaaagtctagcgtccatataggaatataatttagaaataactaaaattagaaaaaagaaatattgaaaaaagaagtctagagtcaatataggaacatagtttaccaacaactgaaattcaaaataaaaaaaataaaaaatattgaaagaagagtttagagttcatatagaaatataatttataaataaataaaaatgaatattggaagagtagtttagaatccatataggaatagaatttatgaacaaaggaaattcgaaagtagagtccatataggaatacaacttaaaaatagctgaaattcggtattaaaaataaggaatattgaaatagtagactagagtccatacaagcatacaatttagaattaattaaaattcggaattaaaaaataggaaaaagtaaaattagaagttagagtctgtatagaaatacaatttagaattaactaaaattaaaaattttaaaaaaagtaagattgggagaagagtcatagtccatatatgaatacaatttataaataactgaaattcgaaattaacaaataaggaatactgggaaaaaagtctagcgtccatataggaatacaatttagaaataactaaaattaaaaaagaaatattgaaaaaagaagtctagagtcaatataggaatacagtttaccaataattgaaattcaaaattttaaaaataaaaaatattgaaagaagagtttagagatcatatagaaatacaatttataaataactaaaattcagagttaagaaaaatgaatattggaagagtagtctagaatccatataggaatagaatttatgaacaaaggaaattcgaagtttaaaaataaggaatattaaaagatgattcttgagtccatatagaaatataatttataaataactatcacgtatatacaatacaataaaaatatcacacatttattagttcaaccaagaatttaaaattatgttgttattttaatatattttaataataaaatgtgaaaatatttaaactattgtataagaaaaaaaatctaacaatgctagcggcgcaatctgcgcgggtcgccatgttagctcatcataaaacacaatcatataggtccaattgttaagtctcaacagtacatcacaaaacgcaatgtacggaataaattatctatgtttaagagagtaacactgttgataaatcccaatacatgaaaaaaatattcttatgtaacttcaaatttgaataacaattatttttaaaaaataacagccaaacaccatggtattcactattcagtgcttaaaaaataatccagggtattttagtcacaaaatttctacaaattccaagaaaatttctggaaagttttcgaccgattccgagtttcgacggaaactgcgcttatcattttcgatttcgtttccgagaaaatatttccgaattcgttttcgtttccaaaaaattctgactgacaaattccattttcgaaaataggttcggaatccgaaaaatttatgtaccgtttcacccctatctggatggaagatgttgctcgattttttttgttgtgtatggttgagagatatggtggatggggcagtccagaaaagaaaatattctctcaatatgatggttgagtgaatcctaccaatttagtcgtatgaatgtaacatcctggcctagagcttaataggattaatagaatactcatatcaacaagttgcaacttcttttccggaagccaatctccaaagaactccaggcctagggcttaataggattaatagaatactcatatcaacaagttgcaacttcttttccggaagccaatctccaaagaactccagggttaggataaagtgtgcagaaaagacatgtgttggtctgtgagggcagtctatgacctatgaaagctatcagatgtaagtgggcctggcctgggggaaggcgggacgttacaatgaagccatgcatgttttggtttggggtgatgtggtctattttgataggcggtggttggtttaattttctgttagcaagcttcaaatgatttttttctcctaaaccgtttatctaattcgtgatccgattacatcattatatttattacaattaaatatttaaaacaagatcgattatattttgataaaaaaattatatcacaaataggcccactaaaaatgttggcttatcccatccatgttatactcttccaaaaaaaataaactgaatcattctatccatacaaataaaaaaaattaatcaccatatccaactaaacatgaatggctatatcctatccacacttttagctagcagcttccctgtagtttggtcggtctcacccggcacgacggcacctggggtcgggtccacgcatgttgcacgcacaaaggtgccacgacctttgcaccactgccgatgtcttcttcatcagccatcaataagagagacacactgtcgatgggatacccatggacttataatataggtattggggtacgttggtatgataatatacacaatttaacatcaaacaaacaaatgggtaagaattatactggtacaatagataacggttgatttataaaaggggcatcggcccagactcgatggcggtgtggcacgggtgaagccgaagggagggagttgcggcttgtcctagactctcaactcaactcatctggttctcttaggcttgcgctgttggtttttgttttgggctattggatttggttacttgggcctaatttttttttaggtttttttggttttttttagggggttgttctctgggttaaaatcagagtaattacagtcaaacggagaggttagggctaatttataaacggatttgtaaaatgttgtcgccatattttatggctgattacagtcaaattggatgctctgtgctggatcgttgttcttgttcacagtccacctcaagtcctcagcatctctaccgattctctctttgcttttttactttatatgtgtgaatctatataggtaatatcaactagataatcaatcattttgaattatttctagccccttacttatggtgtaagtatattaaatttacaatgtaattacacaatacaaatttttactattataaaaattgaattgaaaatatttttcctggtattttggtacgtcatccgtgtttgggtcggtttttaaatttgttcgcttttgaaaatgcatgtccgtgtttgagttggaattaaacacattttcttttgaaaatacaaaagaagttatataagaaatctctttaaaaaaactcgcatgataacttgatatgaaatactggctcctaattgaaatacgggctcctagttatagctcatgattttcttaaaaaatatccaagcgaattcccacgataaattttatcctagctaaaccatataacaataataaaattaaaatagcatttacacgttgcaaagcacgggtattttttctagtatatataatttacaatgtaaaaaaatcactgttttttatgaaaatcgtggtgccataatataggtcgtggaggaagacaggcacagccgtgctgctggctgtagcatccatagttccatacatgatgctagtacacgggaagtgcaggaaagatgaaggccggaagccagtgtaggatgtatacggagtatgctgctgcatattcacctgcgtcgagcccttgacgattgatcgctaggaggaggcgtataggacggtcaatatgggataggagtatataggacgaagcttacaagcgaaggcattgggggtcggagaagaacgcccggggaaagaatggcagagcacgacagcgcctttgctaactgctagattgtgaacttttgggccggatcctttccctttatcagcggccctttttctttgcttctggcctaattagctagctggtctctagattgcatctttacttctaccgcaatctattcatgactcatcgtagaatcagtatagcgctggtttatttcatgttgcgcacatacgtccaatctgtacgtagtagtagcagctaggcagtagtcgatcgacaaatctttgcaaacatcgaacgacgtacgtaatgagctgatgaagtaaaagcacggtcggaatcggtagtatctcttctagatgatcatatttatcatttattatactactaagtgtcgatattaatacgatgtagaaataaattaaaaaaacaaaatttatatatagcccaaaacaacaacgagaacaatattcttataagaaaacggcgctcgatcaatcaagaatttccgtggtcatttttaccccaaaaaaattatatataacccaaaacaacgagatcagtatccttataagaaaacggcgctagatcaattaagaatttttgtgatcattttcaccccggctgatgggctgatggcagccagaggctttggtccacaataatcgaccatgcaatgcatgccttaaatgctgcaggtgatacgtacaccttagttatataacactacttcgatgatgctgacggctactaatcatccactatcacggctaggctttaattaatcattgtaacgaaatggccgaacatctccatacgtcacgtcacgtctggtgatgatcgatcgatctcatttatcagttcattcacacgtcattatccatgcattcgactactcgagagtcatagtcatactgcctccgttctaaaatactccctccatcctataaaaaaccaacctaacactagatatgacatatcctagccctacgaatctggacatacatctatccaattcgttgtactggaatgtgtcacatccaattctaaatttgtttttctcgacggagagagtataagtgtaatcgcgggtatctgtgcccaaaatttaacggttcatgttatttaaaaaaattatgaaaaaaattagaaaattagttacacataaaatactattaatgttttatcatctaataacaataaaaatactaatcataaaatattttaaaataagacgaacggttaaacgttgaaaattaacaatgcagaactatatttattttgggacggatatatttattttgggacggatgaagtagttgttatatatgcccgcctttttaatttgttcaatcttgtgtactaataaactcggccgatcaacgacaaaattgttgaagagatcactcaatctcgacaccggcgaagacagaaaaagaaaaaaaaaaacctaaaaataacttgtctcttttcttcactaccaaaaataattgtttggtgaggtgatgacttgagtcaacctcttggttaagaccaatgccctacggttttgctaaaaaaaactgatgatatttttttcctggttgatgctaagtttttagaacatactacttatgatggattttcagataagcccaatgccctaagcaaccagatactccctccatagttataaaggaagtcgtttagaacaatgtttaagttaaaccttgggaatataaatcataaataactctcaagttgttgaatttgaaaatgtaaaaattatatgaatagatttgtcttgaaaaatactttcataaaagtatgtatatacatatacatacatacatacatacatacatatatatatatatatatatatatatatatatatatatatatatatatatatatatcactttttaataaactaggaaggtagctcacgcattcgcacgggcatgtgctgtacgtaggataaatttgagaaacttataacggcggtataccagcgaaataatatctgcaacgtttcataattatgttttctcatgaattttcttcattagaattgcatgatgaatttaattgttatttataaaattacctattggagattagggttggtaacttacggtataaaagatggtacctaagacatatgactcttgaggttccatagggaaagagaaaaaacttaagttataaaagacattacatacacaaccatatataattaatggctctattgatttatattgaaaaattgataattagtttattaaacaaaatatatgaccctctattttaaaccattatttctaaccattggatatgtagatgatctaacatattgtgcagagtccaactaaccaaattattcgtcttccctcactatggacggtgaacttgttaattcgtgtctctggcagcatgctcgcatcatcatacttagaagaaaaaaaagtgcccctgcatgtatatgaataatacatgtaactatctcagaccctatttagatgggactaaacttttaagtccctatcacatcggatgtttagacactaattataaatattaaacatagactattaataaaacccatccataatcttggactaattcgcgagatgaatctattgagcctaattaattcatgattagcctatgtgatgctacagtaaacattctctaattatggattaattaggcttaaaaaattcgtctcacgaattagctttcatttatgtaattagttttgtaagtagtctatatttaatactctaaattagtgtctaaatacagagactaaagttaagtccctggatccaaacaccacctcatgcccctcttttcatcttagaaaaaaaaattatatacccatgcatgcacaccgggatgcaccggctagccctccaatttgtttactccatagacagtatgttccattgttagtgattagataatttataagtacaaataagtatttgaaatcattttttattagtaaaatatccataagggcagctctgtagacccctctctccttcttcttttcttggtgtattagttggatttgagcaacgtgatatacgcattttgggctataagttaatgtccaacttccaagggattaaagtttcccaacccttaacgccaaacacagcataagatcgttcatttatccttaaaagaagatcatgtcttttatcaaggcattgggattaagtaaatagcatccacatacacattgagagatataattaagttggttgtgagtcaataggcccattgatgctattattaaggttaaggttaacggtttataggttatttgattttattaaaaaaagtggatattttgatttttaatgagaacttttatgattttttatggaatggatgtgggtccaaaatataataattttattagcaattaaatatagttggtatagatattaaacttttgatttaataaaaaaatacaatggttcaaacagatcataaattgaatatataatttaaaatttacagctattgaagattctttatttttcagtaaaacataccgtgatcaatatgtattaggtatattatctatgtctatatttgcaagtgcatgcagtctttgaaagtacgatgaaatgaacttactaatatagaagatattagatacccttcagccttaacttaattaccttagaaaaaaaaagagggaggtgagtaaggaaaaaatcacacagaccctttttttaatatttttagctagcttgcaatgggcatgaaatagtgcctaccattttccacttcgaaatttgtgttacataattagaattttttatgttcgtggcaatttattatgtctgctacaatcatatatataattatatacttaaccatcactaagtataactaatgttatttttctcatctctcaatttctagcacctcgatgattaatctggtggaaagttctctctctcttttgtttcttctttcataaagccttaccaccttaatttttgcttatgatattggatctatatttgatctaaattttcagatcacatcatcttaattgtgtttatagctttttttggatgattaactaaagatgcaaactatacaaagtaacatataagattacaatgtttagctacgaaataaattcattttgtactatgtttctatcattatcatacaacatttctgcagtaatattttcttatacatggttttatctaattaggttagttgtgacttatttttctcgattatcatcaattgctatgttaagccatacttcctctatgcatgacacgatcaaatttcctttttctgtttgtttaggtaatgtcaaactttatttgtgcttattctttgatgtttcatattttaatttgtctacagtgaacatataaaaaattggtttcgatggactgcaacacggcattacggttagtctggaagattttatcagatgaatgatgcctcgctttcttgtagtgagctacgttaaatgatatggtgttttttttttcatttgagtcggaatctctctcgtgcgaacggaacatatatgtggagtacttgttgctgactcatggatagcgtcatcaataggttaagattaagattggatctagtgattgaaaatattggccctaccaattaaagaaaagaaataaatggttagatgtttttctttttttcttataatttattttttcataatttattagagtaccacatggttgtttatgagtgtttttaggattgccacatggtgacttaggagcgtttataggatctaaatttaatatttgtttaagatatgatgcttaaaaatttgctcttaaaacatttatattagaagtctaagctatttatacgtatatgtatcttgaattgtgcatttaattataaataacacaataattcaaaaagaatgagaaaaaaaagtaacttgaatctaaattcagaaatccgattattaattttgatagattaagtgttagctagaaaataggaaaagataggtgaaaaataggagagagggaagagtcaggtgggtggatgaagtacataactaatacgtgtgcacacattttttttcataaagatgtaatgattaaaattaatggaattatctgttaaagttcaatagttaaattagagaaagaaggaaggaaataaggagggatgtatgcacgtagttactgtgaggagaggaggtccaggaggaaagggtggaggagaagatttttgatgggttttgggattttttttaaaaaaaatgatagatctaagagcattaccaacagtctacctatatgattcccaaaactaattttgagggattttagttcaaaaatcaactctaacagatcccatactctcctacccgagttttggagttcccttcccccggttcctcgctccgtttatatgcgggcatgaaagtcgctcccaatcacgcaatcccacctctctccttcgttcccgcgcgtgggagatagcgatctttctgcgtgtgaaagaaaaaaaaacggaattttctcttggtagtttaatagaagggcccacttttaagttttggggattgaatttaggctatctgttggagggaggagttttttcacttcctattttcagtttaagaataacaaaaacaaatttttaggagaaaattatagataatctgttggtgatgctctaacggtgtaaaatattaggtccaccgtattaactgaaaatcgatgtgtagatgtttttcttttttctcataatttcttcgatttctctgatttattgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagc

SEQ ID NO: 7980 - DNA, 2393 bp, Oryza sativa
gattgacgaaaaccaagcagctttcacggtttttttaatcggtaatgaccccgacgtctttttttttttgctccacccctgacggcagtatagatctaatctaacggtaataacaacgggtccatcaatttaaataaaaattaatggtgagattaggctgtgccaagtggcggcctcggaacgtttataggagcgccacgtggcagcttgagagcgtttgtatgaagtttaatggacttttagtatataataatagatatttttatagaaacaagagatcaaagttgtgttttggagaccgtgtcgctgtccaaaacgacttcctttattagtatagagggagtatgattttgcttgttccttttcccattggagaaacatttacaggtaaaagagaattttttttatttttaattttttttattaaaagttttacaaaaataatttttcattttgaaaattgacagaagtggtctcctaccgccctctgggagggcgatttttaaaaatcgccatcccagagggcggtgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttaggcctatttggaatgttaccgtacaaatattttgttagtgccaaaatataagcaagttttggcactaccaaatatttggtagggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttatgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctacgccctaatgtgcccctgggagtacgtgagtcggtccgggggtacgacacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggactagtcctaccggtgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtaagaggaagagctggcgaacgcgcccgaagaggtggcgaacgcccctgcggagctcgcggaagcgccggtcgtgcctgcgaacgcgctcgaaggcagacgaggtcctgg

SEQ ID NO: 7981 - DNA, 3618 bp, Oryza sativa
  unsure (1)..(3618): unsure at all n locations
ttacgacggggtgatgttttcgtacaaaaacataaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgtaagataaatgaaataattgtaagaactaatacaaattcgacgtacccccacgaagtagtcttggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctggggagagaggtaaattatatggctcgatgaagtaagtatcataaaaatttagaaatgaacaatccgaactcacgagtggtcggcagggaggacggtcggctgcacattgcccggaaacacctgcctaagtccgaactgtctcatcacacgctgcgggcagtgaggctcaacgaaaatgtcgaacaccatcggcaggatggtgagccagtaagccgggtcgcgtgtgcacaaggacgaaagtcctagcggtgctctcgcagcgacgacctcttctgtgtacggctcccagatgacgtcgctcggctggagacggtaaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccctacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcactcccgcgtcagtcttcgtgcacgcctcacagagggcatggtacgtggctgctagcacggcagaaccccagctccactgcagcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactttgttgatcgcaaataagcatgtctgataataacaacttatttacttacagtgaattggagcaaccaagccttgctaggcccgactgtagagtacggaggaagggtgttggccggtcctaggtgtggaacccgcacgacctgcaggcatgcaagcagtgatatcctccttccacccaacaacaccgtcaacgggaccaactggtgctcccgccagcggtagcccgagcaggtacgacacgttctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtatagagcaaatttcaaacataagtacaacacaaagcaaagttgagttgaaatgtgaacatacgcgtaccaaggaacgtgacgggggtcgacacgcaaccactcgcgcgacgtgcgtggacggaaggtgccgagctatgcaccctcgactgctgacaggaacgagcggtggttcctgtcaatcccacggttcaacagcgccggtgtgtcgtacgccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtattttgtccgaacacacatcacatcacaacagcgttttatttcctaaatcgatagcattgttacaccatggaatcgcctgctgcgcgacgacgccttggcctttcgcgcctgcttgttgttccttcaccatgtggtcgcctaccatcacttgcctgtccagatggactagcatctgcgccgcttggaacttctgcattcttcgggcatttcttgtaagtatggccgcgcagatcacacttgctacagcgtaaagtcctcccacctacttctgactcatccatatcatttctgatgcgtctagtttggcgtcgaccctttttcacccttaacttagatggatctggaacataaaaaacttgggcactttcaaggccggttttggntggttaaagaaatnccctttgnnagaaatcncccccccggggaaaaaaaaacccccccccccccccccccaaaaaatttttttaaaannnactcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtatacctctgccaaattggttgtcattatgccataccgagatccatcggtgtcgaacaatagagaccacttctccttaggctcattctcaatccactgagtgaaatttctgatggccgaccctgacctccttctcattgttggtgggtcctcatgtaatgcaccaa

SEQ ID NO: 7982 - DNA, 853 bp, Oryza sativa
  unsure (1)..(853): unsure at all n locations
ttattgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagcacatacactaattaaaatctttgtgattagctggctggtttgcaatcccattggatgagtttctagaagaaaaaaaaactatcgatttttttttcataataactccgtaataaaaaaaagttctaaaactactggattgacgaaaaccaagcagctttcacggtttttttaatcggtaatgaccccgacgtctttttttttttgctccacccctgacggcagtatagatctaatctaacggtaataacaacgggtccatcaatttaaataaaaattaatggtgagattaggctgtgccaagtggcggcctcggaacgtttataggagcgccacgtggcagcttgagagcgtttgtatgaagtttaatggacttttagtatataataatagatatttttatagaaacaagagatcaaagttgtgttttggagaccgtgtcgctgtccaaaacgacttcctttattagtatagagggagtatgattttgcttgttccttttcccattggagaaacatttannnnnnnnnnnnnnnnnnnnnnnnnnnnnnnnnnnnnnnnnnnnnnnnnnnnn

SEQ ID NO: 7983 - DNA, 635 bp, Oryza sativa
  unsure (1)..(635): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagagctgtacgtaattgtaagctaattaattaaagttaatttctagtagcaactgtgcagagaggttcatgccttcaatcgatcgatcgccaggtcaggtgtgtggtgattaattatattagttgcatgattgcatctgtgttgatcgccaggtcaggcggcggaggcatgcgatcttggccatggcctcgtcggccgcggacgccgcctctccttctccagctcctccagcacgtcctccctccgcctcccctcggccgcgagccgccgcctcagccgctccatgctgccgccctcctccgcgccgccgccgttcgcgtcaccggccgccgcgcactcatcttcctccgcgtcagcctcctgctctagctcggcctcgtcgnnnnnnnnnnnnnnnnnnnnnnnnnnnnnnnnnnnnnnnnnnnnn

SEQ ID NO: 7984 - DNA, 567 bp, Oryza sativa
gatccccttttctctttccctatggaacctcaagagtcatatgtcttaggtaccatcttttataccgtaagttaccaaccctaatctccaataggtaattttataaataacaattaaattcatcatgcaattctaatgaagaaaattcatgagaaaacataattatgaaacgttgcagatattatttcgctggtataccgccgttataagtttctcaaatttatcctacgtacagcacatgcccgtgcgaatgcgtgagctaccttcctagtttattaaaaagtgatatatatatatatatatatatatatatatatatatatatatatatatatatatatgtatgtatgtatgtatgtatgtatatgtatatacatacttttatgaaagtatttttcaagacaaatctattcatataatttttacattttcaaattcaacaacttgagagttatttatgatttatattcccaaggtttaacttaaacattgttctaaacgacttcctttataactatggagggagtatctggttgcttagggcattgggcttatctgaaaatccat

SEQ ID NO: 7985 - DNA, 692 bp, Oryza sativa
aaataccttattatattttaaatttatttattttggaaggaagggaatacaatgtcaccaagttccatttgttttatttggacttctttttttttgcaatctttaattggacttcttgataagagcttagggcaagtattataagcatccaaccacaatcttctggatgccacataagtttacatagtgaggtggaagagagaaaaagatgagagagaatagagataataagtcaccctagacaacctctacaccaaattcaagacaaaagaaaagagagtaagagtagactggcaaataaatattggagtagtgtacatgttgcatttatatttatgagtcgatgatacggtcaagattagagatagcacccatctctcttagagcaagatcaataacaaagccaattgccggctgtaataggtgggcacatcatctgcagtaaacattatagctaagatatataatagagaatcatatgcttactgtaacataaatattttttttatttttatggcctcaccatcttttccctctattttctttattgttccatccttctatttccgagttctctttgttctcgcttcttgccggtgaggatggggcagtgtccctatgcatggacgcaggtgagagtgagggagatggtggcggttgcggtggacacgggtgacgatgccggcgaagac

SEQ ID NO: 7986 - DNA, 407 bp, Oryza sativa
catcaaagaacaagcttgcataggcacaagaccaaaatttgcagtatcatagtaacttccaatcgagaattttattctcacaataaaaggatacgaggatgaacaaggttcggagatagacagcaaccgtttcctggccacggcgccagaaatagttgttcgtatttcttaacgtcacagatagaatccgcaagcacacagaagataccgatgtagcacttcacaggaaagtattccaaggtatcgatttccacaaggaacgtgtgtgtcagctcttcactaggttcatcgaaggacacgaagctaagataggctaagggtaaagagggtttactagtgagagacagtgtctacagaaagctcaatttaatcctaacgtggtacgttgttcgctgcccagcccgctg

SEQ ID NO: 7987 - DNA, 23969 bp, Oryza sativa
  unsure (1)..(23969): unsure at all n locations
ctgcagccctcatcgataattttgaaaggttgagcaatagaatcaataatattgcgatgccttcaactaactctgagttattaaaaaacgaatgtattgttgtgcctcttcctttggatactaatgttttgcaggtgtctgagaacaaccaaggtaatgaggaagagaagaaagacggggatcaaaaagaactatccatagctccatgtatgcttgaggaatgtttaattgaccaagcgcctataatttctaaagatgagaaaaaaggcaatgataatggtgctacaactactcaaggtatgcatagttatgatgtgccaactatgtccactacttatgctatattagagcaacccatagtggaaacaactgttgaaatacctctgtcacaaaacaatttgcttgaagtttcttgtgataaataagagttgtgcgatgcttcacttatatccatgccacaactagtgaatgaacatgttagttctatggtagagccaccatgtgttgagtttaaacatgttattcacattactagtgagaatgaagagcttaaattgctatattctttaaatactcggggttatattcaatttgatgatctttgtccactcaactgcttagagaataaattatttgctagatttgaattgccatgtccttctgatgtgatttttcatgttattagcaattatgatagtaaaggagaatataatgtgcgttgagtatatatttgttcgaatttgactacacctctttttcatgatggaatatattgtctagaggactgcatgcgtatgtaattctctatcaagttcctctagttgtttaaataagttacaggttggtttgcaagaaggggagtgttgtgttttttcaactacaaagatttcaggatccaaccatatggtcatcaaaaaatgttcctcaccggatattgtgatagataaagataagttcaatacgcgccatgacaaggtgaaaccgaggacggtttccaatcaagaaggggaggatgatgaggacacaactagcacggatataatcatgactaccttatgtattaatcaaccaaagctgcatatgttttatattagatttacttgttatatatttgaacaaacgttgctacacaatgagttttcgtttgcagacgtacttgcttgggcgaaagaaaagagaccgagcagaaggaatgcatggatgattaaagaagttgattggggaccaaacgaagaccttctccaagaccactttcatctcaccacgtcacttttggtccatagaagacaatagataaagttctacacattttggattcggattcggacctcctgacatcatcaacttcaaacggacctagtcgctgatctagaacgaatttcggggcccatgagttcttgtttgatagtttttggagtctactttcagatggttttggtcccaccttttctttcttttatcttcacccctgctatcttcgagaagcatcccagtaaaaccttctcaaccaatggagcatcaatctattttccaactaactgctccgcggggcaaatcctatgagccaccttcttcatcgaagccaatttttagaactgtctatgagattcattccgagttaatcagtatggtttaggaaaaacctttttctagtgttgaccaggaaaatccttaccatcatctgcgggaattcgagcaactttgctcatgccttaagattcggcgcatgaagcaagaaactgtgcagtggaaattgtttccgttttctcttcaagagagagcgaaacaatggtacacatctaccgtagggtgtgtgcaatcaatgactaggagaaattacgagacaggttctttctcgcctttttccttgtaacccgtgttattgctcttcgtgtagaaattctcagtttccaagtagataaataaaaaatcaatcggtgcagcatggtccagattcactaatttagtatagtctggaccaaccttgtctatacccgatcacctgcctgttacagcattttcacacaggtctggataaggagtctgcattccatctaaacattaccaccagaggatcttttatgcacaaaactccatcagaaggaaaagtaattctagatcgaattatggaaaatgcatccttcaagaatcagagtgaggaaccactccttgaggtatgagtatctagaattgaggaatctttggccgagtctaatctttaaccctccacttcaaatgattcggctgagaaaccttcacccgagccatcgcatgttgagaatgaagaaattcagactccaagatgtgctcccaagttcgaggatgatcttgatgatgattatggaaacaccctgaactattttagcaaaaagaaacaacatattcccatgccacctcccgatccaatagagtttcagtttctaaaagagacagttcaggagttgacatccattatgagcaacgaatgactaaaggaggcagagctttcttccgaagtaattcggataaataccgctcctcgaaccattccttgtcatttataggggaataatgttggaattatttatagtccaacaatcggtgttaacattatttcagaatcttctgcattcgcttacttaagcgataaggcaacaacaccgactgacaaattcttcaagcaccctaacgggagccttattgaaggatatgggattgttcaagatgggcctatcatctgtgacggcaaagaggcaatcttggatttccatgtcatcgaaatccaagaggtcgatgttctcatcggattttcaatcgagaaacttctcatcaatacccctcgattgggctgcctcgagttctctttaggggggcggatacattctcgttaccctttgaccaatcgaagtacactctaactccctccctgaagatgagtatgcagaggaagtaagagcggtgatgcctttcgaatcaaccgaatcactcgttgaagatgatgtcctagacttcatccaagaggatgatgattccggtgaaactcttgatcttcccagctttgaaccaccgcctcgacctccgctagaactcaaaccccttcctcaaagcctgcgctattctttcctacatggagacaaagaagcttgcgctatgctttcctacatggagacaaagtagcccctgtcattattagtgacaagctttctgaagacgagaccagtcatcttctttccgtgctagaaaagcatcgctctgttctaggctattccctcaaggatctcaagggaatcaatccagttctttgcacacatcgcattcccattgagcccgagagctcgccatctagggagcctcaaagacggtttaataatgcgatgagagaagttgtgaagaaagaggtattaaaactcttgcacaccgggattatttatcccatgccatacagtaagtgggttagcccagtccaagcagtgcctaagaaaggaggaatgacagtcatgcaaaatgctaataatgagctaattcctcaatgcactgtcatgggatggaggatgtgcattgattataggaaactcaacaaggccacaaaggaccattttcccgtacccttcattgatgaaatgttggaacggctggcaaatcactccttatatttccttgatgggtattcccgttatcatcaaattcccatccatcccgaagatcaaagcaagacaacgttcacatgcccatatggaacctatgcatatcgaaacatgtcatttgggctatgcaacgctcccgctttttccagaggtgcatgatgtccatcttttcggacatgatcgaagaaatcatggaagtcttcatggacgacttcttggtctatggaaagaccttcggtcattgtctcttgaacttggacaaagtcttgcagcgatgccaagaagaggacctagtacttaactgggaaagtgccattttatggtccgtgaaggggttgttcttggtcatcgaatatcagagaggggaatcgaggttgatcgggctaagattgaagtaatagatcaacttcctcctcccgtcaacatcaaagggatccgtagcttcttgggtcatgctggcttttatagaaggttcatcaaggacttcactacaatcaccagaccattaactaacctgctagccaaggatgctccctttcattttgacgacgtgtgcctaaaatcctttgaaactctcaaaaaggcacttgttttcgctccaatcattcaacctcctgattagacgcttcccttcaagagtatgtgtgatgccagtgatttcgctattggcgcggtcttgggccaaaggataaaaagcatcatgcaatctgttacgctagcaaaactccaaccagggttcagctcaattatgctaccactgagaaagagcttcttttggctctttttactatcaataaattctgatattacttagtgggggccaatgtcataatctattctgatcatgcggctttgaaatatttgctcaccaacaaagatgttaagcctcgtctcttgagatggatcctcttaccccaagaatttgacttagaaattaaggataaaaagggagtagagaattctatcgcagatcatttgtcgagattgcaagtcactaacacgtaggaaccaccgataaatgactttctacaagatgacatgctgatgatagtacgcagctccgacccatggtatgcaaacatagtaaactacatggtatcgaagtacgtaccaccgggagaaaaccaacgaaagctgaaatacgagattcgttgtcacatctaggatgagccatatttataccgagtttgctcagatggactcttgaggagaagtgtaccaactaaagaaggacacaagatcatagagagatgtcacgcaacaccatatggtgggcactatggtgcattccgcacacaagccaagatttggcagagtggattctactagccaacgatgtatgaagattccaaggattttgtcagacgttgccagagctgccaacgacaaggagggatcactactcgcgacgcaatgcctctcacatacaacctacaagtggaaatattcgatgtatggggcattgactttatgggaccattccctaagtctcataattgcgagtatatcctggtggcagtcgactatgtgtccaagtgagtggaagcaatgccatgtagtgcaacagatgccaaacacgcgaagaggatgttctcagaagtcatttttcctcattttggtaccccaagaatggtcataagtgacgggggatcacacttcgtcgacaagaccttcagagaacttctacgcaagatgggcgccaagcataacatcaccacactctaccatcctcaaaccagtggccaagcagagacttcaaacaaacaaatcaaatatcctacagaagacaatgcatgcaatgggggaaggatggaaggataagcaacaagatgctctttgggcatgccggacagcccacaaaacgcaaattggaatgtcaccttaccagatagtctacgggaagacatgccaacttcctatagaactggaacacagggattactaggcaatccagaactggaacatggactttgaaggagctggagaatagaggagaatgcaattggcagacctagaggagaggagagaaaaggcatatcacaactcaaagatctataaggagagaacaaaacgctgcacgataagcgggataaaaatcaagaaatttaagccgggagacaaaatgctaatgttcaattcaagagtcaagctgttcggacatgggaaattgaaaagcaaatggaagggttgttcgatgtcatcaacacctcatcacatggagcaatcacactccgtgatgaatcaggtaacattttaaaggtaaatggccaacgttaaagattttccttgaaccggatgaaaatttggatgaagaagtggatattatttagctaattgactatgaaccatgatgatctcatctaaaatttgcttagctctacaaaaaattgcattttcgttttctccttagcttagtttgtgagtgtgaaaattttggaggctgaccgggccgaccagggttcgaccgaaccagggcagcgcccgattgcccccaattttcaaacctggatctcctcgcttgtgacaacagtagaaacccggtcagtcatgcgatagctacgttagatcaatctagagttcattaaattgaacttgtgttcatcttcctctctactccactcttctccattcatccagctcgtgtcttgagccaattccatgcccaaaaacactcaaatggctaggaaatccctgaaacactttggtgcatccacctcccacacctttgatctcaatagggaacattctacggcaaaccaacttgtgccactgcatgatctgccgctagaagaagtgtcacgcacggaaattcactagtaatttccgaactaatttatgcataaaatcctcgtccaggaatcagccgaggtacacaaactgacaatttaatatacaaatccatcataataataacgttacatacttacaaaagaaaagaaaacagcagcggaattaacggtctagcgatggcttcagctccactcctacagacagctcaactggggtataagccaaacgtcttctccttctggatcctttttcttcaactgaggtttgatgattattgcaagaatgagcatatgacatactcaacaagccacacagcaaatatgcaagtgcacaaggataccaaaggatggcataatatagactcatttgcaaaagcagcatttagcaaagatttaagagaagtaaaacagtagagtactttaatcattaattttaatcaacactgaacaacacgcccatgctgctcaagcccaaccattctgaacaaccatacccggctgtacagatctactctaaaccaggagctacagctgactgctattgttgcatcatatggttgaggtagcgatgaaacgcttgccagtcagcttgctattgttgcatcatatggttgacattttcactccctctcaaaaccttgctctcaaaattcattgaaagttttgcaaactcgcctcaaattcacacaatttgctgcaaatttttgtaaggtagcggctagtggggcccacatgccattactagccgttatccatgcactatatatgcagctcggctgggagagggaagtcacaccactttaactcattttcactccctctcaaaaccttgctctcaaaattcattgaaagttttgcaaactcgcctcaaattcacacaatttgctgcacttagtttagacactttgcatatacaagtttgctttagttcgctgcaaggttaatcggcgggtatttgcttaacccccgtccgagtagtcttgtattcttgctctttgctgtagctatgaagaaatgacttttgggcatattcaagagacgatcaagctcacggacaagccgacacaataagctgagtacaccttcttccgcggatgaatccatggaggaggcgtacgttccaccgaggctgtacgacaactccgatctcaacctcatgggcaaccggaaaatgcaagcctatcatatgctgaaagaccgaacgtgtgctctgacctgagcatacaactcgaccttctgaaaaggatagatatgaatgttgattttcataatgtttggtgtgctatagtttgggataaatttgcatgtgtagacgagccgggttcccgcttgcttaccatgcagtaggcgatggtgtactttccggttattctgcaaggaatatcacctttcttggaaagaccttagcttacatctaggctttgacaaaacatgcaaagttgatttcaggaacacatttcctgattttaacaagtgtatgttttggcaaagtattttgggtctctcatcctgtagaaagcttagaactaataacatccataatcctaccttgaggctgttgcataagtggcttggtttaatgctgtttcttagagctgatatccagatagttcgtgaagatgtactagtcctattgtatgccatggttagaaaaatcaaagtttcacccgttcaacccatgatcaagcaatggttagaaaatgtgaagttgtctggtcctgttgagtgtatttctttggtgactcgtttaacatgaagagttgggactctgcttaatatgcaagtatcttgtattcctgttacccactcttatgttaatgaggcctatttggttcaaggccacatactcaaacatggtccaaatgattctcttatgtttcccggctatacaaatgagattccgttacctaatccggagtttcatttgtataactgccgagaactaaccattccactccaagtggagttgccttgagatgtcccacgcaggataacgcgacgaatggcaagaggagcacctcaagaggcgtcttcctcttcaccaccagtgcagatgtatgaaggcagttgggacccgactgcggatgccccaggttagacccaagttccacaacatgacgctggaggttcatcctggcagagtgccagcgacagccagtggcatgtaccacaggagctgcactggggatactcatgctcctccagttcaagtggtccatctcgatcctctcggatgcgtcgctcagtctcctcttaaggggatctgggagaactcacccgaggatggatacacttgaactgcaagcggggaacatgcagcacacactggaggatcatgtggtgcagtcacgggagtggcagcagtctgttgatgaacagttcgcaaacctcaaccatatgatgcaacaatagcaagctgactggcaagcgtttcatcgctaccagggatttgatccccgccatgagccatagcaagaaacaagcttcgggggagatgtctctccccccactaaggtaacttgtatcacattgcatattttcctttcattgcatgtttcaatttctgcattgcatttataaacctgaaaacaacataaaaatttgcaaaactaaaaataccaaaaagataggctagatttattatgctaggtaagacatgcttagttcttcatgttgaaatgatgaatagttgctctgttttatatctctcatatatgggtttatggttaagtactctctcaaaatttgaataggagtagccaacaattatccgggaacctgaggtaagtgagctgcactttgctgatctgagtctaggttgttgcgagatatgagatagcaaataagagttgctatgaccctgctctaagtttgacttgaattccggatgttttattttccaaaatgataaatttgaaagttcctcaattgatataaattcctaccagagccaaaaatattcatattgattaagccatatacattttggttacttgtaattccattgaactttgtcaaatctttgtgacttgtgtagatacttttcatgctctatgatcaagatcatacacccacatatgcacacatatgctaagcttctacactggaagatagcatccatatcatccaccatatccatgttatcattatccacaaataagctctccagccatacttcctttccaaagaaaaatcctttgcaaaaatgaaagaaaaaaaaaagagggaaaggtatggctatgagaaaaataataaattcttgctctcccaaaagtggagcataaaaaaaaagaggaaaaaaagggaagagaaaaagtagccataccgtctctatgaaaattaaaggatattttggaggaaaagcataagcacaaagaagaagcattttctttatccacattttgttttctatcatattttccaccatattattcacacacactttgcacgatcttgatcttgagtatgattagtcatctattttagtccaagtttttgacttagtaataaatgtgaatacaagtatgccatgtttgatccctaccaagctccacatatcaaaccttagagtaggaatcaaagaggcaaatctggtgaggaatccatattcatacaatttgagtgatctagagaatcatttgaggaacttggctttcttttgcaaaaaaacatttgaaaacttccggaataaaagttgaataaagactgggtaactagcgctctaattgctgttttgtctctcaaccgctcaagacaaggaaaggcagtgtctcatgggaatcaggggtaagggtaagccaccgtgccaaacttatttaatttgagagagagagtacccataccatgtatctgtatctttaagatatacaacattgtagcaactcctgatcaacaaccaagtctttattcctttcgtccttttctcgggacgagcaaaggttcaagcttggggggtttcgttgacggtcgttatcgaccagtttcgaccgtcaatattaccaattaataaagactagttatgcttgcaatgcataaattccaaataaaatatctactttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgcgaaccggtgccaggccggttcggccgaacccctggtggaccaaatcggccccacatttagctgttgggttccaacgactagtttggtggtggtcgtgcaaacttttgccaaaaattttattttattttgctcgcaaaaattcatttgaagaatttgcttcaaattcaaatctcaatgtgcctttgaaaattcaaacatgctctgatgcaatggaaaataaatatgagataataactaccaatttacctgttggcaagggcgacgtcgtttcaggtccgacgagcacgaccgtacctccgacgcatttaactcgatgaggtacccggttccggaggtacatgaacgggtgtcttctccttaacccgccataccttcttggtattaggtgcgggcagcggcctcttcgtaactgggaacgcaggtgaaccaacttgtattcccggcttcttggatgtcggcttaaggtgctgacggttcctcgtttcttcctgctctaggaacttcatcatgaaagcgttgaggctatccgtccttctgggttttactttgacctccttatgggtttggtccgttcttgatctaccccgtggagcaatgctccatccttagtctccttgtggatgattcccgttgttgttgttcatgagcatgacgttctcacgggtttttggacaatccatcccagagtgaccggtgttgccatagacctcacatgttgtgttaaagtccagggccttaacggtgccctgcttggcatccttctcattgttgtccagtctcttcataaggagagacaactgagcggtgagcatttccgtcctctcgatggtgcacatgccgcgttgacgggtttggagtcgttcctcgctccaacccatatttgagacttcttctcaatcaggtcagtgatatctctgaccatctttgagaagggtgctccttcatcagcagcgtccagatgatcccgggacgagggggttaatcctttgaagaaattttgtaggatgagtcactcgtccatcccatgatgaggacgggcggtgacgcattcctgcagcctttcccaagcttcaagaatggttaatccctcgtttgctgaaagctggatattcttccacgaagagcattggtcttgcccatccggaagaattttgaatggaatgccgttgagcgcttattccgggttttcaccgttgcacggttgatgtagaaccactgttctgctctcctgaggagggagaacggcaacagttggagtctgactcttctgacggtatacgtgctatagctttccaggaattgctgcaaatgagcacttgcatcctccttaggctttccacagaacaggcaagcctgcgccatcgttaatttagttggtcttcaaatcaaagtcaccatctcccctgctgacttgggttccaattggcatgttactagcagagggagtagtgaacatgaaaagtgtcttctcagccatatcgtgcaattctggtggcgcggaattggctggtctaattgccgatagagtaaccttgaggatgaacgacacggggtcggcttcacttcaccagtgactctagatatgaaattggtcggcagatcagaaccagtcctgtactaccctgttttcacataaaagagaaaacaaacaaggtttgcctacaaaggacaatgactatatatagaggtaaatataaaattattagctagtagtaaactcttaatcatttatcttcccctgcaacggcgccagaaatgcttgttggtatttcttagcgacactactggaaatataattcccagcaatagcactaaaaatactcatggtatatttatggttacagatctgatccacaagcgcacggatataccattgtagcatttcacacgggagtattccaaggtatggtatttattttatcctaaggaaagatatgataagagagtactatgctaatagtttttatattacttatatacatcaaagtctatgcaggggttaattcagttcaaagggtagggtgacacacaggagaaagaactaagaactactctcactaaaatatagtctaagctaagttgagaaagaataagaaaagtatcattcatgtacttctactatacatacatctttagtctatacttgctattatacagtcatgcaaccaataccccgtacccagtgtccttctggtgtttcgagaagccacccctgactgtcgagttccttacgacagcccgtcatgaccatacaaccggagctaaatacggaagagtaccttccccagggaattaacttaggattatataccgcgcggaggaatacccatactgagctgtcaccatcagcggcccacctctcatccgcagtatataaccccaattaatggtatctaataatctaagcaccacgcttatattactaaatactactctacatccttgcaaccgacatagagcaaccgaataatcggacactaaacccacaccaatacacctatctggaaagctagttacgtgactatattgcttcaagtataaagtaaagtcggcactcaagtaatatgaatggaataaattaccgaacttgtataaagaagaatattctattaattcagtaagtcttacaaaagaagagagaaaagctactatagccatacccgaattctcctgaagactcgaggactatgaagactattctatttcctactccactagcactagaactactaaacaatacttgagagagctcttgatcttcttcttgaggtgtgtgtgggaatgaatgagaggaggggtatttataagtggagaggtgccttgggagtgtggagatgctccaagcatcctatgagcatctttgctctcctcttgacatgtggcatgatgaagcatcctaggagcatctttctccctccttgtgacatgtgtccacggcggttatttcaggtagaaccgatcacaaccaccatgggatgtggataacttccagctgatgaagaattgggctgatcgggctggctgctggttcggccgaaccagggggttcggcagaaccctggccgagcccaatcagcccaccatttggcatgtgtttctcccaatggatcctcagcttagtggtatgaattatggccttgtttgctcatgttaattctgtattattagcccatctatccacaagtctgcttctcgacagcgtctgattgatcattcgtctattttctgtcgattctcctccatttatatgtgcttcttctgcatacatgttagtagcatagtatatagtggaagtagatattttatttggaatttatgcattgcaagcatagctagtctgcattaattgggtaatattgacggtcgaaactggtcgataacgaccgtcaacagcttttatcttgttcttgcttgtttcttcgatttgcttgaaggaataaggttgatctgcaccggcaagatcaacaacccactgagagatgtatcgatcgctaaggtgcaacacaacaacgtctagtacggttgtagtcgggtcatcaacgtttctcccaaatcgtacttatcatcaactcaccgaaagatcaggccaacaatagccttgagtgtctcgagtggagctcagggttcatcatcatgacacttggggatttattttgaaaataaaacttcttttgggacttacttctcagttggtttcatcattttacctaccaaggcaatacaccaatatatattatcaaaccatttatatatgtgtatgactacttgttattatattgagctttgctaaattatcgtgactcgtgttagatatctctcatgctctcgtgatcaaggttgcacaattaccacattatccctataaaaaaatgctaagcttctactctggaagttggtaatataaatttccatcaccatccaaaaataaactctccatccagtttatgcctgcttcacctagagactccttgaaaaaaaaatagagaaaaggagggaaatgtatggctatgaagaaataaaactttgctcttccaaaatatggagcaacattgaaaagaaaaaaaagagagatattgtagccatgcaacctccaaaatattgaaaggagaaaattggagaaggtatacacaaaaggagaaacattttctttatttctttttcccatccaccactacaatattcattccacacaagttgtgcaatccttgatttgagagtatgattgactatcttcttgagtccaagtatttggctttgcaatatatatgatgcaggtatgtcccgatttatccctatcaagctccacatacacagccttttaggctagggataaagtttggtaaaatataccttggcaaggatctacataaattgcaaaatacttgagtgatctgagataagtcaatatgaggagtatagccagctttgcgaaaattcatgaaaaccccgagagtacaacaaaagaatacaagaaggaccagaatcgagactgtttcgtctttcaattacctaagatggtaagctagacacttctgaagctcacaggtacgagaattgttttgaataatttatgtgcttgcattatatcttggagaattttatcttacatcttaacctttaacctttactcaggaacaagtaaagagctaagtgttgggggtttgttggcggccgttaaatgccaattctatgccgccaatacctgcataaaacataataaatgacacatccaacatagtggtagggtttaattctaatctattccatgagtgttggtgtatatttggatacagaagataaaccaccaaagttgggaggaaacctagacttaagagagagaatacttttatctatccaagagtgggttttgaacttcatcgaattatcagaaaataggcccatgttcctggaaatagataaggtagaaggagaaggagtaacaagccaaaatctgggcctgttgggccagaccaaggttcgcgctggttcggcccaaccccaatctcagccgtccagactgaggtttggcacggacgctccagatcttctcctgatggtggttgaggggtacttcagacatttcgcgttctccaaccgtcattacctgataaggacatcaccttctcatttcattcacacacactccaagtttttgagttgaattgtaagaggccctattgtactatattgtatactagaattagggagagagtagagtagtggaagttggaggaattccggagttgtcggtaatcctctacttatttttttactctattaattactctgttttaatcgaaatatcatctagagtaattaagatttattatgtgagagttatttcttagttagttcctaatcaatatacgggatcatttattattataatcgagtaaaatatagtgtttgctttagtgtttagctaacgctaaagtagtttttaactgcgtagacgtggtgtctgggtagttaatttctggtgtttgcttcatatcccacattaggtttgaggtgggtgtagaggtgatgacagccctcaaatacactcatgtcctccctgtccgggtactttgtagagccatatctaggagcagcgggctggccaacgcccgaagtaccgcgttaggataaaattgaactctctgtagacactgcctctcactattaaatcttctctacccttagtctatcttatctttatgtctttggatgaaccaggtgaagagctgacacacacgttccccatggaaatcgataccttggaatacttcaagtgaagtgctacatcggtatctttcgtgcgtttgcggattctatctatgatattaagaaataccaacaatgacatcattaataattggtcccacttgttatacacaccgtgttttttagtccgtgttacagttggctacaaatctatagcccacttctcttctctctcatcacttatcttctccacataataagctnatcctcatctcatagtctattattgtacctactcttataggattataggattccatgtaactcgagtatcttcctctctccttggcgttaaggatttgccactcttaaaatttgctactggacccacatataatagatacatgagggcttatatgttatagaaagcgagtggcaaataattaaatgcctcggcaaaataaaaaaaataaatgtcacaacagaaaatgtcccgtctagtctcctctcgtccttgcgccatctcgctgctgaacaagggaggggcgccgatctccatctggcgagcagaggaggagaggggatcctggtgagtatccacatcgtctttctgattcatctctctctcccaccgggactacttttgtctggaatttgcttgcgttcgttaaccctagcttctcttctagatctagaagaagctcttctcttaatttcagagccttgaccttaatacaagttacagtttgtttgttccccaaaagtttgggggttcaattgaacccccatgtcccaagttggatccctggcttttcggtcgcgatctagctagggtttattttgtctgggcagcgttgagttgcacggattcgattttgttctgtgaggggtcctgcgattgctgctatagtagggttaaagttctaaaacttggactggttcatgaagagaatatatagaggctttaatcctgtgcttaagtttttctactgcatgttggatccgcccctgagcccagcaatgattatattagttagtagtcactattcaacactttattagattattccagtggatttgaaggatgaattaaattgaacatcaacacataattatgaaatacagtgataatccaaatgtttcgtcatcacaaacaaaaaagaattggggagccactacataacaaaaaaaaaggtatcaaaccacatatacttagcatatatctattccattcattgtcatactggatggtatctagctatgtgccaactgcttagatctgtagtaaaattcggaacatcgccttgctcaccatggatcactactggcaatgcattcaacatttaatcacacatgggcattggttgtgttcctcattcaatttgccaaatgaaattcccaccatagcttacctgaataatctaatatcagaaccaattgggatgtgtagtagtgaaattcaaggcaatcatgattgctggacagctgaagccatccagcataggcctgtttcacttagtatgatagttgtgtcggaattaagtactcagatattggaagcaaataaactgtttttttttctccagagggatgaaaatcaaaacatgttagttcaattttgtgtgtatgcatgtaagtggtaaatacaataatcaatgccaacatgaatgattcgattagttagagtgccacttcttgctggtcggaaattgcttggcatgataattggtatttatcagctaataaatgaagatatagttttcattcaacaatcaatatttcaagtattgttgatcgtctgatccaaagcttatcaatttcgtgttgatgtggctctgtcagatggctttgtgtagtcagatggcttctttacttagaatggtgtagttagcatcactggtagtatatactaattagcagtagtatatacttgtttttatacgttgtattatcaatatatgctacattcctcgacaaagatgtactaccttttttcggtcagtatatactacatcccttaatcaagcagtatatgcttctttttttgctcagttagtatatactagaagctagtagtggtatgtactgttttttagctagaagtggtatatactgtttttaagttagtagtggtatatacctttttttatgttagttgcagtatatatcttttttaaagtggtatgtataagtagagcagtatataccttttcaagtcagtagcagtttatagaagtacattttttttagttactagcagtatatacttttcttaaggtagtactccagcagtatatattgcttcttacttagtatagcaggatatgaatttttttagtatatgctatttttaagttagtagcggtaagtttttctttttactgttatctgaagatcaaaagtatcgataaattctgtaagatgcaaaaggcagtatgtattgagatgagaatatgaagaagagagccgttctactctatatataaactaaaccatacgctgaatacaaacaagaacaaacaatccagccagtatatctcattcacttcatgcatacagcatctaaaaaagcagaatattcaatacgagaagcacaaagctctgttttcttttctgagcaatatatactcgattctcagaatgctttaaaacaaaattcagctagcaaatcacactttctaaacaagggcattttcccatggcgcaacacatactctctgcgctagctgttgcagggttgaggtaagcaattgagtcattggagtcaacacgcgttcttggcgccggctggcaaccatctgcacgcatcaattagacttaattattgaacgaacggaagaacaaatttggattgccatgaaaagaatgcatcacaatcaaaataaaataaaataaaatccccaccgttccgtgcagcgtcgggctgcctcattagtcttaattgcttgctgcatgactgcatccctcgatctggagtcattgggtcagcggcgaaactaatatgaagaagtcgtcaggtgccctgctgttggaactagctagcaaggctgtcgtcatcccgtcggcaacgaggtagatgaaccgctgcgattggatgagctggcgcgccgcttgggaatatgcagtcgtcattctagatcgacgttcatgatctacacatcgaaaaataaaagtcagctgcatgagatctacattaaacgaaagggaactgttgatctgcaatacaagcagagaaagtaggaaggattacatgcctggaaacagagcctatggatccataccatagatcacctaggaatctctgttgaacggcttgtagagctgtagatgggttatatgtgtgtgctctgatcaactggtaatgtcgagggagatcgatgtgtgacacctcccgcctgggaatgacatgggagagcaaggcgagacatcgcccacctgcgcctgcgatgggaacgccgccgacgagattgagtcgtcggcgctgccgactggagacgagggtttttcttttgagattgagaacgatggatttatacgatccattcggtaaggacgtcagttctgtttatttggaataattaacaattatgggaattatttattttcacaaaaatggaacgggttcgtattgatgcacccattagcagggacagggaaactcaatcacgcaggtttggatcaacggtggatgagagcaggtgtgtgtgtgtatatatatatgtatatatatatgtacacatacatatgtacatacatatatgtacatatacatatatatacatatatacgtatatatacacccctcccctagaataactattctacaccccccatctcccaagggtcaaacccacctcccccacattccctagggcccaaaaaccccctcccacctcggtcaaagcgtcctcccgccggtcaaacccgccaaccactttgctgttctcgtcttgcaggaatcatgcagtaacaggacggtcatcgtgtagtaacaagataactttctcgcagtaacaacatcaaaaagtagtcatgatggatctagttttgttaagtgtttttttttgaacgtcatggtgcaaacggattagaaaaacaagatattatgtgagagatattgctctataaagattgagatttacctctttttagtcctcgtctcactggaacggcgtagtaacgagacgaccaatgtgtagtaacacgactgctttccgcagtaacaacatttaaaaaatagttatgatggttccagtttcgttaagtaccttttctactgatgccatgatgcaaacgagatagaaaaataagacatgacttgtacgttactgctctctaaagattgagatttagattttttttagctctacaaaaacattattaccatagtgtcactgttactatgcatgttctctgttactgcaaatttcgccatatcgttattaccaaccgtgcagtaacaacatataaattttgcagtaacaacacataaatttggcagtaacatatcatgttactacccttctgggataatgttactgccgaatcatagtaacgaaggtatgattattacagcaacataactgatttgttctcacacaatttgaacatatatacaaagcatgcaaacaatattttctattcacataacatcatgtggtgaattggttaggagagtttgccatgaaccatgagatcataggttcaagtcttaatttcaccaattttttttaaatttttctaataaaagagagaagaataggaggaaaaaagagagaatggagggagagaaaaacgaagaaaaaaaatagaggagggcgctaggaggagaaaaagcgaagaaaaaagagggctctgcccgggatcgatcgggaggaggagaaaagagtgaagaaaatcgagggcaagggaggaggaggagggcggcgccgggagaaggaagaaaaagaaaaaaaaagtagaggaagaggcgccatgatcgggaggagaaaagagcgaagaaaatcgagggcaagggaggaggagggcggcgccgggagaaggaagaaaaagaaaaaaaaagtagaggaggaactgaggaagagggcggggctaggagggttcgagatcgggagtgcgaggaggacgcccgcgcgatcgggaggcgggccgtgcgtggccttggagggagggatggatgggctaggaggagggaggagattggctatgtgggaggggggtgtagaatagttattctaagggggaggtgtagaatagagctgtcctatatatatatatatgtatatgtgtatatccatatatgtatataggtatatgtgtatatatatgtatatacatacatatatgtatataggtatatgtgtatatatatgtatatacgtatatgtctgtacgtatatgtatgtatatacctatatgatgtatacacatatgtatacctatatgtatacacatatgtatacccatatgcatatgtgtatatgtatacacatatgtatatgtgtatatgtatatatctctatatatatatgtatatatgtatatatatgtatatgagagagagagagagagagagagatagagagaccagtattttagaaaagttgacccttttgctattctgctaggagaaaaaataatcttgggcatggaagggcgctcctcaaatgaaatatcatcagctgaagctgttttggtgggagcactgtcttctggtgttaacgtacgaaacacagtacagtattattcattgtattaaaaaaatcttaaatttgattttaatcttgtttctttatatatgtggtttcaaactgtacagattgttatattcagtcttcaatttaacctatttcttgtccctttttgtttagtactaaatggagaaaacctaattggtgttatctcaatttgtaggcgccaacgtggtttgtgctcaagatcacattcttgctactggctttctgttttactgctatgctttctctagcattcttttcaagtgacttcatgattattgcacatgttcttttgcttgtgaccattggcacggtgctatttgtgcttctcaacaggtttgtctctccgttttctctacctgcatccaatctttacagtcgtcaggatgaatattttgagttatttttattactgtatcaatctttacaggtttctggcagaaactggtctggtaccagttgaacaacagatgaaggagatgggtattcataaaatagaagctacagagaaggacaagggaaactaagccttttgcttttattgacatagatgacagctcaaaatattacatcattgaacagtgtccttttgtacagactgtatatgctcattcaggcatggatgtaaatttcaggctgacactaacacattttgatgaagctacatttatctaggaatataccacttttaggaatgcttgtcatcctcctttgatttgctcttcttcctcttgatgtaacagaaacatgagcagcaggggaactgaaacaagaacttcatcgtctgtttattcacaccaataccgtgtttgtggaagtgttattgtgtttatgcagaacggatttgctcccaaacccttacatatatagtatgcattgattccttgcttagttgcttatcagaagagagttgaaattgtggcccccgtccttgtcagctggggcttttcacctgcctgcacttatactttgtttagagggtttggttttttatggaacattatatcaatcatcaatcattccgtcagttgtattgtattgttatatcaagggcaacgtataactccctaaaactgacatagaagtcaagatcttttgaggtcttgaagttgggcaagctttcgtgcctctttgcctctttgcaagacagaaaggatattgttttcgttctggatgggttttctggtgcatattctttgtttgaagaggagctttgtgctgtctcgtacatttagattttagagagaacttacgtcaaaaccaaatacataagcattgtaagtacaagaccattagagctaacaaactgtcagggaagtccttaaattgtgctaaaattttctggttgttcatcggttttgtgacgatactggtatttttgtcgaagccggaattcaaaaccttcatctacaccagcaatacaatatgaagtgcaagaccttcataacttgtatccatgcgcttccttcagattattagcttggagttcaccgacctttagggagggaacaaaagtaatagccacaaactgtttatcatcctatgacaaatgattgaaatgcataacaaagaaacttatgtggttgataaaaaaagagtaaattgcattagcgacacacgaacttatcaagtgagtgtaatctagcgcaataacttataaaacttataaaacgcttgttttggtatacaaacttgtttgctgaccaaaaatttgctcagcaagattgatcttgttgatttgaatgttgcgtaaatatgtatctcagaagaaaatcagtatgtcacttagacaaagatctgttcaacaaaatatagaatatggcgtaatgattgtataaagattaaagaaataaaaaaccaaaattaatgcaagagaaaattccctatgtagcatcaaaaaaagttgttcttcc

SEQ ID NO: 7988 - DNA, 4964 bp, Oryza sativa
taatttatttatgatgttcaactcagtaaaattagccttgccatgctattttggctttggttcatacgcaccagacaagttcatgcaccagcgctttacaaattcattcactagattaaacccacctggcaagttcgtatattgctgatgcaatttactctaaggagaaaaaaagtggtgagaaatataaaatattaataagtcactgtacttcattgtgtctgctagttacttttgagttgtaaaaaagaaattttcagttcgcttcctcttaatgcattttggaacctttttatatctcctcgatctttgttcagtcttttgcaaaaaaaaggaaaataaaaggaaaacaaaaaaactatgcaaatatggactaaagtaagcacctatcggaaattttcatattagattttctgacgtgtatatatgtcttctacataattagatcaagaatagcaataaatattgtataaaagcagttgcataagagaccgctctaaccgtactacaattgtaaagcatagcttagtcaaattttaaaaaggaactaaacaaaaatgaaggtttgcataataacaatttagttcatctttgtgagttattatttgagcaagccaatcacctatatcccttgtcaatattagttgtaaagcaaaccaaggttgtcttgctttccttttacaaatcgaatacaatgagtaaaacagttacatcaaagttattattacttggtatttacatgtatacagttaaggccatgtaagcactttcttatcacttattaaaaaattgtcagcaaacatacatagcttcaataagcatgacttctaaatgaatcatagtagtctttgcccctccatgtatagtgtcaaaatcagtaataacaattatatgtttaaattaggagaaaatactaacctgatacacccaacatcagtgacatatttgccacaggagtagaactttagactgaacaaacccattctgaagtttgcaatagtacttgtgatgaccaatatattatgggtgcaacagacatgaacaatactgatccaaatggaaacaaaattcacgtactccaaaatgattttatcctccttttcatgaatggttcaatggataacggttatgatgcatcagtcatatcatgactgacattcttgtattggaaggtacaagtagtacgttcattcagtaaaagaaaaggcaccaaaaaattcgccaacttacagttacaccagcgcagatagtttcgggctgttctaggcttctagcaagcaatgaagtgagacactgccattacccttaatccagtgacattacagcatcactatcttaaagggatgttagctataaagatcaaaacgtgacattatgactacaaagatgtcatcagaacctaagccctttggtacattgtcaccagtaatcccgacaagagcataatccatctttgaagtgatggaagcgctgtaaatctctgatgatgatttctctttcagtgatcttggtaatgaacttcattgctgtatggcaatcactacagacccggagattctttattatatggatcactgatcttgggactgaattcattagagcaaaagcaacagcaagcttttcactatggattcgcaatgcagactctttctcttcttcatccaaatcatgaagaacagaacccgtgtttggtacatagcctgcttcttgcattctttcaagcagtttctccaaataagaatagatttcaatgtgctgtgggtgactcttgtcgccaacataaaacaaatagattttacctttcaactcaaaagagctatacccaggaggcttttctattcttcttgttttgaccagaagccttatccgttccacatctttccacattctagcctctgcatatatattagacaacagaacatagtatccactattgcttgcatccaattcaaacaatctttttacagacatttctgcaagctcaacatttttgtgtatgcggcatgcactaagaagagctccccatatagcagcatcgggtttgaccttcatttctttaatgagactataagcttcatcaagacaaccagcacgaccaaggagatccaccatgcaaccgtagtgctccacaccagcttcaataccaaattcttgcttcatggcattgtaccaatatcggccctcatccaaaagaccagcatgactgcaagcggctaaaactgagataaacgttatgtagttaggccttagacctgatcttttcatctcggtgaaaatctcaagggcttcttgtccgcgaccatgcatgccataaccagtaatcatggcagaccatgaaaggatgttcttttccttgatttttcggaaggccctacttgccatttcaactcttccacacttactgtacatatcaactatggaagtaccaacatagacattttcctccaaacccatccttaccacctttcaaatacaaacatgatgaaacttcagtcataatgtaaataaatatttaagaaatcatagaaatgtaaacttatgatgcatatcctcacaaagataatgggcatgtgtatgcaataaacttgtcacaaaaaaatgttacaaacatcacaaatggaggattatacaatttggaacctgcaaatagatttgcattttctagggtcaatttttttttctcgaaaatgcaggagagctgcatttcatttcattaaggggaagaaaaaacaatacaaaaacacaacacaaagaaaaaacaaagtaggagtgcccgagccctcctaccgagacccacacacactagactacccggggagcttagttgcctaggttagccgtcccactaaggagcttttgaaggtgagaagctccagcaacaccccaaagatggccctcattttctatcacttgtaagaccgtcgctactctaggattggcgttgttgaaaacgcagtcattgcggtgcttccaaatctcccaagctactaaggttaccaaggagttaatccctttcggcacctccttcggccagttcttggttgcttgactccaccacctcaggaagcggttggtagagggctgaggcgcagcctcggcaaaaccaagtctcaagaagattgccgtccaaacttggcgagaaaaaacacaagaaatcaaaatgtgttggatggattcttcactttgatcacaaaggggacagatcactgagtgttgcagcccaagctttgctagacaattggctgtccaacacctattattgaaagagactgaatacatgcaaatggatagtaacagtttgtggactacagcggtgcttgaactatcactatgttaagttcattttggaagagattgaatgtgcaattttagttactagagaaagttaaatatattaagttagttacatacaaaaggcacggaacacatcaactataaaacaatatctgatattactaagagaaatagtagtgtgtagaaagcttttggagggctcatgcctatatgtattgttgaatgctagtatattgctatgtattgtaggctcatgagcttctttcccacgattaggaactgaacccttcacaatgcaactaaaatgtttggtctgaaacagcagatccaagcaagtaatttacctgattatgaatgcgctttcctgtctgtattgcccctgcatgcgcacaagccagtagcacagccgacaatgccacagcgttgcatttgattcctccgccaacattcagcatcttgctatacaacccaattgcttcggctgacatcccattctgtgcgtacagagcaatcatcgaattccaggacaccacatccctttccattgtatcaaacactttcctggctacctccaagtcacgactgccacccttagcgtacgagtctagcatcgtgtttaccaccccagcattcctttcgaagccaatctttgcaataagcgcgtggaggctggcagtaacaccacggtcagggacacgggcggaagcagagaacgccaccagagcggcagcctcgtcgaccacagaagcagaatcggaggctatcatggcacggaagagttcgagcgagtggtagactagattgttgcgtacgtagccagatgccatagcggtgacgatgacggggttggggtcagggatttcgtcgaacgccctgcgggcgtccatgggacgggaacagtggtggtacatgtggaggagggcggaggcggaatacgggtcggaggggaacaggcccgagcggagggcgaggagatgcagctggcgaccggcggcgagggacctggcggcggcggccgcgcggagggccgggggcagagccgggcggagcgcggcggggttggcgcggacggcggcggcgaacgtggcgagggcggcgaccgcgtcgccggaggagaggaggtctgcgacggccgcggaccaggacgcggggcgcgacgggtcgacggcgcggaggaagagcgcgcggagggaggaggcggtggtggtcggactcgggacgctgcgctctcgttggcgttggggattgaacgcgggagatgggtgggcaggcggcgtggggagtggatttgggagcgatgtcatgacgcttgctcccgccattgccgagccacagccagtcagtcgccactgctcgcgtgccaccgccgctgcggctgctcgtattcggccgccgtcgtcgctctcgcactcggaacttttttcgtttttagatttttttttaatatttacagaaataatctatggaccaaaaaaattgcagaaatagcccctgccgccctaatggtgggcggcaaggtgacgtggcagacggtggatcgaccacgccgtctgccgccgtcggccaaaattgcgcttagcccttgccgcccgtacagagggcggcaaggggctaattgcaattttggccgcccataaagagcttgcggccgtacttttttcatctgggtc

SEQ ID NO: 7989 - DNA, 27855 bp, Oryza sativa
gggacccagatgtaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtttgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctcttaaaccgcgctttagtaaccctgtattgctctggtagttcaagctgcacaacacgactaggtggagttagaacccttctggtgtctatccattctctgtattgacatctccttggtggttcctaggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttattcacgacattgtcgttcataagccgcttttctctgtaagtattgctcagtactttcggatgcgaaataccagcgactttcttgtaaacaagtggttaggtcgagaacgggattttctgtatcgacccactcgatgtatgcgcaagctgtagtgcgggtctgccgaatagagtagtgttacgaagaataaagcgattgcccatacggaatgaataagcatatgcagataataaaatacctcacggtcatagttaggacacctaaaaaagcgccttcctcgaatatcaggactcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatccgtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtttgcaccggcggtgcgcctcccagctgtgaggggccgatgacgtcctctgtcgagcctgaagcgaagtcgaagtcagtgatgtcgaagaggaaggtggaaggtaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcttgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatatacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgatgacccggttgatgtcgtcgacctgcatggttaatttgttcgtaaatattcataaaatttgacgaagagaaagacatgaaaacataaaggaatggtgcgatgcagggtactcacagcacgagcgaagtcctggtcgcggtgcctgacatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaatgacagatgttacaaattattgtgaacaggcagattttaatgcaacaacgaaaagcgtagtgcaagatcttaccggtgaacagcagctgggacggtagtcggaaacggtactggaaagggctgacggaagccgaactgccgcatcacgcggaaaggggcgtgaggctcaacgcagatgtcgaagaccatcggaaacgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttaacaattaacttaacaatacgataagatcgatgcaacgtacctgacgacggcaccacagagtacccatcgtagggtagtcgacctctggtcgctcctcatacagtgactcctcgtacgcgtgctggtccacctcagggaggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctagcgtagtgcacgaatcccttgtcgaccgcgtgcccgtgatcgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaatactcacggtgaactgaagcagccacctcttcgtaggtccggtgttgcggtggtgtgccaacggctcgaacgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgttcgaccaaagctgctaggagggacctgtccacagtccatcgcttggccgggtccacgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccacacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtaagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcattccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccgggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgtgtcacgtcctgataaattcatcccaaaataaaaatcattttctaaaaggaataatagaattaattaaaattcgaaaagaaattgacaaatactaaaatacgtgccagaaaaattcgaatgtggtccggagaatttttgttaaattctccttggtctaaaaggagccctcaaattttacttgaattttcagagcaccaaaaatatttattaaacaacaacaacaattatcaaagtttactaaaaagaaaaactaaaaataaatccccctcctccctttgggccaagtcgacctctctctctctcggcccgcggccaaagtcctctcttcctccctctctttttccttccctctctctctcttgggccggcccggcccatctccctcccctctccctcctctccccgcggcccactcggcctctccccgcgcgcgcgccgctgacgggcgggcctgcccgccaccctcgctgacgggtggggcccacctgtcatccccttcctcccgccgcccccgtcctccccgcgtgcaatcaataggggggaattattccccgtgattccctccccctttccccccaattttccctccctctctcccttggattcatttggaaaccctcccctaatcccgccggcgccattgatggagccccagagcgccgcgccggtttccttcccctccggccgccctctcccccttccaaccctatataaaccctccccgcgcttctcccgtccgtttccgcctctcgccgcccttcctcctcgccggaatcgagctcgcgccgtcgttctctctctccaccgtcgccgccgagctccggtccgccgccgtcgtcgccccagaccacctcccacctcggcaccgcctccttcggcttcgccgcatcgtcgccgacctcgtccacccctccgtttcgctcgccgaccgccggaactccgtcgaccccgtcgacccgagccgcaccgccgcctccctcaactccggccgcctcctccgtcgccgccgtcgccccggggtgagccgtggaccattgcctcctttcccctttccctcccctctctcggccgccgctccgccgcgccggtggtcgccggcggcgaccatcggggcgcgggcgcgccgcctcccgccgaccgcgccggcgtggccgccctcgggagcgccaagtggctgccgcgtggggcccggccgtcagccgcccgcgtcctcgggtgcggctgacgcgtggggcccactgcgccggccggtgtgagcccgggtgcacccggtccaccgtggaccgtgaggctgccgcgtgggccccactcccatggacccggtccgcgcgccccctcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagacgctgcagctttggaagatccgctttcgtggaggttgaagccgatgtttgggaaagcgagcaaggcaagtcacatcatccttgagcatattgaatcctagtttataaaattattttgatttaaattaatacattatcgctttatttaaattcccgcgttatcactgttttatttagccatgcctatttacctttgttaagacattattattgctattgttattattaccttgttcaccctagaataaacaaaaccccaactagtgggtactctattcatggttccactaatatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggactaagctcgggcctctgttgcaaagcactaccgtacttccacatgtctagtgggtaaggcttagtttgtggctcagtctggttataaacaaaagtacacggatggagatggacgaagtcgggggtccatggacatctctaggacaaatgaaggctacacgagctgcggcccggtagtcgagatgtcatggcacagggcatgtgtcctgctgctaggggctcaatcctgcctgcctgtcccgggggttccggccgtaggtggggttgggtcggtactcttgtttatggctaggatgggttgggaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtaactctaggatcgtctttataaaatggctttgggcaactaagtgacttttaaatactgttttctgcaaaacttaacccctatattattaccccttgtacccccttgcattaatcatgcatctgccggtgtggcttgctgagtactatggttgtactcattcttgctctatctttctccccccttcagtaagagaagctttggagaagaggtcttaggtggagtcctggcttataccccagttgagcgcctgtgaagttggagccgtaggcccgctagtccgctgctgtttatttttgattgtcaggccttaagtgcctttgtaataatgtaaatattatcgatataataaagatgtgccttttgtaccacgtttgtgtggtgtaccccggcttttcctgggacagggattaatacactagcgttcgagagaatgtatttttctcggtcgcgacaaactgacactgtccaataatccttccatttccccttatacgcatgcactctccagggacaaccatctttttccttaacacaccgaacttcatattgcgaccggttcgacttggcaacccaaaactctctatgaagtgacactacaaaatgttttaccgcctccttcatatcttctgctctactataaatcgctccctgaataacctcattttctttgtactcccgtctcacactatcctcttcagagacgatcagcccagaaaaatcctcactagcccattctgctggattaatatccatctcatcatctgacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggctcgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaaatctaaaaccgaaaaaaattcctcgcactcgtaccgtcacatctgctttgccgtctcgtgctgggactcggtccatcatgggtcgtgcaaacatgggccgtgtggtacagccttcgtcgtgaggaataagttcacttgacgtccctcactctgtacgccgagtatatctgatgtcccctaaccgcaatactaaatgtgtatccctgaactatgtaaaacggtcaaaaaaaaaaaaggtcccgaggcagtatagatgcatggttttcgctgaggtggcaacctagtcggcaaaaaaataaaaaaacaaaatatgaggcccacatgtaagtgagaaggaaaaatgcgaggcccacgtgctagcatcatcttcttcctttctcttttctttcttctcttcgcttctcttctcttctctagtcttctcttctgacgccggcggcagatggggagaggcggcctccgacgagtccgcgccgctcgtcctcgtcggcgacggcggcgaccaaccccggcacccccggcacgctgcttggcctcgcgctccagcttctcgcgccggcctcaccatcatcttcctcgtccccaaggagtactcttgggaggtcgccatccaagttgtggttgccctttcttgcatcgtcggtggctccattgtcttcgcctgcacccggcccgccgaaggagtcgaagtgagggaggagctcgtccaccgctagctcatccgccttcgtctgcagtagagggacaacgggaaatgggtgccgcacccgacccgccccgttgccaaccctattgttgatctgttccttgccaccgattgaaggttggagaagttctaggtcaggaatatactgttggcaactttttgttacaagttgataagcgccatcgcagcaccttaagtattgcggtgatcctagagtcgccaaccaccttgatctagcaaagagctaaacatagatgggttttgataactaaaccggctagcggagccgatttctagataactacccgtctcgtgggtaaaatggaaggttttcaggacaaacctacaaagagatgtcgtactctcgcagcggcggcgaacggtttacggcgcaaaccgacaaaaatggacaaactaagagaaaactaaaagcaatatgaaaaacgattcgattgattgatagtagattgttttttttttacaatgaaccggccatgtcccttatataggggttggtcttgccctctacaggccctcctccacgtccaactcggggtagaaacttaaggaaacccgaaacatgccttcccgagcaaggaaacctcgagacccgacgaaacacaatcggactcggtcctaccggtcagaccggccacacaccgccggtttgaccggccctcaaccggcggtctgaccatgttaacaaccaaatttggtagcatttgtatcaggaaaaaggatttggtcaaagcggagttggaggcggagatcgagttcggaaacagagcaggaatcggttggagtccggatcggctatggttaggatcggctgagtctgagtcgagctaaataagccgatatagccgattccgacaatacgacttgtacgcgacatcgggttcaagttgatgtatttcaagataattgccacgcatggatagagtcctaggaaggcaattgtatctattaattaagatattttatgtaaatcccttatagataagtgtgggcaaaagtctgccgcaaagacttgtggtatcttagagtttgttagagataatggttgtgtccggtatgggcatatattgtaatcctcgggtataaatagaacccgagccctatgtaatttttaacacacgttcaatacaatctcggcgcatcgccatcctttttgctttagttttgtttcgatgagttcttgctttcgggttgagctgcatcgatttcgatcttcaacaagaggtaaaattcgttatgacggatcgcattcttaggattagtgcttccatcttcatgatactctaatcttgtttatgtaattcgtcgagttatcatatatcttacataatctttagcaatatcgccatctaaactactatcggccaatatctgtatacagaagacagccaattaggttagatcttgacgttgatctagattatatgagatatctaccattctatgaaacttctagtggcttgattgtctagatatcactcttcttttcatacttaatgctgcatcattcatgtttgatctattaagttgtgtttagaatatcgatctctggcctgctttctagttgccgattagaatagcatcggagtttcagccgaatgtatctgatttagttatatttattctatatgtctcattgatatgctaaatctgccctttatatcaagatattgctgcatctaagtatactaagtcctcgtttgatattctatacttgctttgatatctttatataaagtagtatcggagtattagctgatacacgctagatctatctgatcggctacgctataaacatatataatcccattgttgacatatatttcgatctaagtgatttatactgtctcggcatgatgaccgatctatcccaatcacttgattttaagtatatattgatataaggggtatatatcgttaatatctacagccgatcgagtagatttagttcttctttacttattcatgattgccgatcgatatacagatgacatcggcccaaaaataaatgatatgtcatcggcgtctggccgatcggctatcatttatagatttaaccacagttttcttgtttttatttcttgttgattacaggatcaaatcaactagcacgctaatacatccgaaggcgagctttggacctgcactgaagttaagtagatctcccaggccacgtgttttctatcaacagaccggccaacacacggcggtcagaccggcccactctgaggaaaccggtagacttccaaattttggcaatctttcctattttaatcctaggtgccaaatttgggtgtaaacacatgcccccctgcctttttgatgaacaacgtgaatctaaaagcatagatcatgtttttggtcttaggacgataatccaattaccggccatagtacctcctaagcgtcttgccaaacgctccagaagtatttcttcaagtatttcccgttgattgctcgctgaaaacactccccttgaagtgtctccaaaaaatacgcgttccctcgaacaatgccgcatactcgataaggaccttcccaactaggagaccacttactgaactcccttgattgagtacccaaaggcaaaattgtcttccaaaccaagtctccaacttgaaacaactttgctttcaccctcttgttgtacgccttggccaccctcttcttctctttctctatctcttccaatgccttcaagcacttgtcgatgacttcatcaagattatctcccatcaacgtcttgtaatcttcacttgacaaatcatcttgcttgatataacaaagagaaccaagatttacctccaccggtaaaacggcttcttgaccataaaccaactcaaaaggagtgactttagtggcaccttgtttagatatcctatgtgcccacaatgcttcggaaagcacctcatgccacctctttgggtgttcctcaatcttctttttcactaacttcaacaatgtcttattactcgactcggcttgtccattagcctgagcgtagtaaggagaagaactcaacaatttaataccataagatttggtaaaactcttcacttccttagacataaaagaagcaccttggtccgtagttaatgtttgtggaataccgaatctatggataatatgcttcaaaataaagtcaattacctccgtatgagtcatattcttcaaaggcacggcttcggcccacttggtgaagtaatctgtagcaactagcatgaacctatgcccctttgatgatgaattataaatttgaccaatgaaatccaaaacccattgttaacagtgaaatttggtaagcccaaagttaccattggcttagagtcagtatcggcttcaaagttctagaatcagccgatgggagtcaagtcgccacgatgttgtgttcttggtggagtcggatcaatcaaaggaagcttatctagaagagtccgagttcaagaaggatgcgacatgacaatttatctattaattaggcatagtttgttagtttccttttatctttaggaaagtgtgttttgtgtcctataaggactttatcttttccttttatctttaggaaagtttctttcttgtccagcaaggactatgtacacccggagactatgtaatctatctctcgatcaatacaattcgacgcatcgccaccctttttacttctacttttgtttttacgctccggcggaacttggcacctgacgcggggctgcatcgtcttcgatctccggcgaagggataagtccaatgttccaccggtccaggcaattatatcgtctacgtcggcgtcgttcaaggctgcatcagtacattcgacctcttggattactctggtttggataatatatttgtctggctatttatcatgtctatgttaatctagtcttagcatatcaatttagctctatcggctgcttcttgctttagggtttctgccggtatcggctaaatcgcgttgctagattagattagcttagacatctaccaccctgaaaatcagtcaatggcttgattgtctagatattgtgttaagtttgatctactaagtcgtgcttagaaccataatctctagcctgcttcttgactgcatcagttaagtttgatctactaagtcgtgcttagaaccataatctctagcctgcttcttgactgccaataagggtttcatcagggtttcagccgatgaattatctagacattgcatcggcttgtaaggattgtgtacatattagatttagccgatgacaacaaaggtttcactatttaatctaatcttgtggatttcatgacatcggacctccagccgatgtgtgctttaaccttcggatcgatgcttatttatcatatcattatttgtcgattggtttatactggattatattgttattttattacatcctcatcagccgattgcctttatatcattatctacattggacttatagccgattgcttaaacctatcgctatcggctgatatcggcatcggctattatcggctatcggctagaactattcgatcggcttgtcagccgatcggctcattgatctgctatttgcatatcttgtcagttgcaggatcaaactgactggcacgcccacatctcaacaatctttggacctgcatagaagcagatctcccaggccgatgtgttcgattttttcgtcaacacccatcctcggaacggccatggtttgattatggggttcaacacggcggcgggcgccaattgaacattgccgaaccgttgacaagcctcgcatcctctataatatttgaagcaatcatcaatcatctttggccaatagaaccccgctctcctaagcaaccaattcatcttgtgggccgattgatgagttccacaaattccttcatgcacctctcccatagccactttagattgatcttcatctaagcacttcaacaagacaccatctatatttcggcgatataaatcctcatcaagcttaagcgtgggatctttcaaatattgaatcaaaggaattctccaatcttcttctgcttcctgagcacaaatgtccgaattcacagttaattcggcctccaaattgattgcaacgtgcccccagcgttctgcccagaaccggtcagaccggccacacagggccggtcagaccgctcggagtagctggtcagaccggcggcatgcggccggtcagaccgcccctggtcaccggtaagaccggccgtgcaatgccggtcagaccgcccctggtctccagttttgccaatttcgcacaaagatttaaaatcaagcaccggctcttctaatatcagaaataatcccctcttcacattatagctagatgcttgttgtgccaagtcatttgccctagaattatcatgcctagcaatatgtctaatagcaaaattatcaaaattggcaataatatccaaacatgagttgaggtacctatttagtgatccgtccaagcatttgtagactccggcgacttcttgcaccaccaattccgaatcaccaaaagcctccacgtgtttagctccaaccatctccataacttgtaagccgaacaataaagcattgtattcggcttgattatttgtacaataatactccaaacgaaccgatgcttcataacacatgccattaggtgaaaacaaaactatcaatatgccttgaccttctttgcaagaagaaccatcgaaataaatcttccaaggtataacttcaattaagcaaacttctccctcataagcaatatctatatgatggtccactataaaatcgcatacaatttggcctttcatagatttcaatggttcataagccaaattgtcacgccccaaaacgactctaaaatacatcctctaaattacgcctagaataattaaaatccgtgtgaaagccttcaaaaataaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaaccttaaaagtcccccttccctcccttgggccggcccggcccatctctcctcccccctctctctctctcctctccccgcggcccactcagcctctccgggcgcacgcgccgctgacgggcgggcccgcccgccaccctcgctgacgggtggggcccacccgtcatccccttcctcccgccgctcccgccgccccgcccgcgccaagcgtcgtcgccgccgccaaatccgccacatcccgccgtccccgcatgcaataaagtgggcggaaatactccccgtgattccctctccctttccccccatttttccctctctccctcgcgttcaaacgggcggatttgtccccgcaaatctcgccggcgccattgatggcggccggacctcccgcgcctattccttccccgccggccgccctctccccttccaaccctatataaaccctccccgtgcttctcccgtccgtttccgcctctcgccgccctccctcctcgccggattcgagctcgcgacgtcgcccctatggtcgccgccgagctccggtccgccgccatcgttgccccggaccgcctcccacctcggcgccgcctcctttggcttcgccgcaccctcgccgacctcgtccaccccctcgccgagtccgccaaccaccgaaacgccgtcgaccccgtcgacccgagccgcgccgccgccttcctccgctccggccgcctttttcgtcgtcgccgtcgacctagggtgagccgtggaccgccgcctcttttcccccttcccttccactctctcggccgccgctccgccgtgcctatggccgccgccggcgaccataggggcgcgggcgccgcctcccgccggccgcgccgagtggccgccttcgggcacaccgagtggccgccgcgtggggcccggccgtcagccgcccgcgcccttgggtgcggctgacgcgtggggcccacggcgccggccggtgtgagcagggtgcacccggtccaccgtggaccgtgaggctgccatgtgggccccactcccgtggacccggtccgcgcgccctctcccccggccggcgggggaggcggcgggagcggcgggaggaaggggatgacaggtgggccccacccgtcagcgagggtggcgggcgggcccgcccgtcagcggcgcgtgcgcccggagaggctgagtgggccgcggggagaggagagagagagaggggggaggagagatgggccgggctggcccaagggagggaagggggagttttaaggtttttctttttataaaattattttaactttgtttatttcttaataattattatttgtgctctaaaaattccactaaaatttatttacacattttaggcttttaggaaatttacaaaaatcctccaagccttatttgacttttaactttgcacattttaattgttggaggctttcacacggattttaattattctaggcatcatttaagggatatattttagagtcgttttgggacgtgacaaacctatcccccttaaacggaatctcaaccccgagattcggaagaactggcaaaaagatcgggatgggctgccttcagctcgtcttcacgctcccaagtagcttcttcctcggcgtggttgctccattggaccttgcaaaaacggattacctggttcctggtcctgcgctccatggcgcccaggattttcaccggtctctccacgtaggtcaagtcttcgcgaacttcaatctactctgagtcggcctgctcggacggcactcgaaggcatttcttgagttgtgacacatggaacacatcatgcacgtcgcccaaggaggcgggcagctccaactggtaagcgacttctccacgtcgagcaatgatacggaaaggacccacaaaccgaggtgcgagcttccctttcgtctgaagccggtgtacgcctcgcaacggcgtgacccggagatacacaaagtcatccactacgaattctaggtcacggcgtcggttgtctacataactcttctgccgagactgggccacctttagattctcccgaatggtcctgtccttcgcttcagcttctctcaagatatcggtcccgaacacttggctttccccaacttggtcccacaatagtggtgtccggcatttgcggccatacaacgcttcgtacggtgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcgttacagaggtagatagttcctctcaatcaataaagatctaagcagcggaaaataaaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataagacagttaagtaattaaacaatattaatccaacgctatacaacataccctgttgtataggcccaaccattctgaacaaccatcccggctgcacagttctatctccaaaccaggaatattccattccaaaccaggagctaatcaaatcattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgtataacacaatccactgcagcgcaccttcctggatcataatcacccccttataaacaaggcatggactccccagcaacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtaaatcattagttatcccataaatgtgctaatgtttctaagtagggctaagcaattatatctaatatctagttgaaccaatataaataaagttcaaccagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaaacagaaaagagcaaaatcaccaaaacagcacataaacaagcatgaacaatacatgtggatatttttaatgtgtagatctcaactttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggattattgcgtcagcgggctagggttttggtggaccgggcgcacgggcggcggttcacgcgaacggacggccgagatcgaaccaatccaaaacggacggccgagatcgaacgggtccacgaccggctcacggcggacgaccccgatgacgtcggcaatgacgtcaccgacagcggcggcgcctcggcggaacaaacggctcgggcggcgcacgctcgccggcaaacggcggcactaggacgcaaacgaagggcaccagcacgtagaggacgacgcggcgaacacaccggtgaccaaaacggcggcggaagaacaacgaacgacgacggcgacgaggaggaaacggcggaaaccttcgggttgtcgacggcgacgaagctccggcgatctccggcgacggcgaaggggtggacgaggacggcaacgacttggcgagcacgacggtggtcttcccgagcgacggcgacggctgaaacgacggcggcgcacggctggagcggcggcggcgacggcaaagctagggcacacggtgctagggtttttccgacgacgagaggcgaaggcgaaggtggcaacgggtagaggagacaccgagggtccttttaaaggggctcggaggcggcggcaaaggcccacggcggccggcgacgtggaaggaaagatcgggaagaacgaatccgagacaaactcgaatccgacgctttccaaaacgatttagctaaagattccaaaggagaaaggtagaggagatcccgaggatcatttcccctctatcaattcggccggagaaggaaaggagcggccggatttggaaaggaacggcggcggcgcgaaactagggtttcgggcggcggcggccggaggtagacgatggccctggcggacgcgcgcgcgcgcggcggcggactgggccgaactgggccgaagagagagagaaaggttttgggccgactttcggcccaaagccaaaagagactttttaaaacctttttcaatttaaattatttctttaatgcaattccatttattaaaaatactttcttagctcaaataaatcccagaaaaatctaggaattatagaattaagcaaagtatttaatgaaattttatctggcccctttttatattggaatttattaattaaaactagatcttctcttcaagacttttaaaattatttctaaaaattccatttaaacaacaatttataaattttaaattttcagggtgtgacaaacctaccccccttaaacagaatctcgtcctcgagattcggaagaattggcgaacagatgcggatgagctgacttcaattcatcttctcgttcccaagttgattcttcttctgagtgattactccactgaactttgcagaaacggataactcgattcctggttcttctctcatttgtttccaggatacggattggtttctcaacataagtcaaatcctcttggacttctatctgctcaatattagcttcttcggtaggtacccttaaacatttttttaattgtgacacatggaacacattatggactcctgccaaagattgaggtaattctaactgataagcaacctctcctcttctactgacaatcttataaggtcccacaaaacacggtgccaattttcctttgtgggggtggtggtggaggtagagcattatgctgtggtggattttggatgtgatggaggaaagcagccatcatgttggcctgctgggcgaggatttgggtgaggatggagttggtgtctggtgatggtggtggaggcgggggaggaggtggaggtgggccgccttggatgttggggttgctaccttcgggttggttgccatcaccggtagcagcacttctcctggttgtcaccatctgaaataccccatacagaaccagccaagagagagaacagactattaaagctaatcacccatgactaccaaaattattgaacttattactgatataaaatgggttcattaaggttcaggttgcttaagccaataaaataaaggcaggctccgacacagttataccacacaccggtataaccatgccccacatgactctagcagaaaaacaaatgagaagaacacacgcgcaagcctactaactgctcgtctacttctgcgacgggccagggcggaaggtgagcagcagcgcatcctccgtgctgccaacgccagaggctccctcctcttgcagaaccacgggcgcgggcttggcacgaggggtctcgacgaaacaggtccatgccaaggactgacgaacaagctcgggcctggaggtactcttgcgggcggtgatcttcaggctgcggcagacgcggcggcgcttggggtgacagacctctccctgggcgatcttgagctgacacagctgcgcctccactgcgtctaggtccttcttcagctgcagattctcctgacacagctccaggatcttcatgttgttctcgaccaacccgcggcgcaccatctggtggaagtcgatatgggccgcgtcgtacgcctccaccatgcgcgccaggtgcatgacggtagcgtcatcctccgagctagcatcccggaaggtggcgtagtcgcgggctcctccgcgacaagggtggtagcggtagggcgagtgctgcaactcgtccgggtagcgctggtgaagagtgccgatggcgaggcgtgcggcgttctggcaagcggtggagaaggaatctccacccgcggtgactgccaacgaagtcctctcgggtgagccaatgaggatcactgcagtgacctcccaagcagcgtggggctctgcatcgtcaccctcctgctccgggagttgcttgccctggtagtccactccatgcggataccccaagacaacgcacatgccccgcagctccaaaacgaaaccagtcaggtccagaccacgacggttgatgctgctagccatctacaaacaaaaacaaaagagaaaagcaacattttaaaggttagattttgacgataaatgaagcagcaggacagagagagactagaggattttcacaaataagaaaggatttttatttcgaaaatattgctaaggcttgggatctaaggctcgtcctagggtcaagggggctcttataccaacttgtcacgaccggaaataacccaacgggcgttccttacgtgcgtgcattattccttgtcccaggaggcaaggtacaccaaagttgatacaattcagagtttaacaagcggaagcgtaattaattaatttgttacatgggcggcgaagacccagcacacaagaagacaaacgaaaaacagcggaagactagggcgacgaccacaggcgcttgacggcaggcacgagctagacaccaaagccttcatcatctaggggctcctcttctgggtttgggaaaaattgagcaagactgagtacaaccaccgtactcaacaagacacaaccacaagtgcagaataaatgcaaggcagtacaagggagccataatataggaggttagggtttgccgtaaacagcattaaaagacacttagttgctcaaagctattttgtaaacacggtcctagagctatacaatattattaaccaaggccgtgaacccacacgaacctgccttaacccaaggcctacgatgattcagaccgaactggcaacccgaccctgggtcccagctcgttccaagccaacccaggccaaccattccacattttagttgttaagcaggttttaagaattaaaacactaacttgggtacattgctcggcttgcccataaccgagggcgcggctattcgaatagaatatactctgatcagaggtgtacatctttacccacaagacacatcttcctcacgtgtaaccacgtgccacataccaccacggtatacggacggaagacatgacatagtttccaacccatcctaaccataaacaagagtaccgacccaaccccacctacggccggaacccccggcacagataggcaggactgagcccctagcagcagaacaccggccctgtgccatgacatctcgactaccgggccacagctcgtgtagccttcatttgccctaaagatgtccatcgacccccgacttcgtccatctccatccgtgtacttttgtttataaccagactgagccacaaactaagccttacccactagacatgtggaagtatggtagtgctttgcaacagaggcccgaagaccggtccttatatggccgaggtgctactgtcaaaaccatgcaccccgagcccagcctaaaaccattttgatggttttgaatagagggggaggtgtgaatccaattccacaataatctaaccattccatagtgtccaggtgataagagtattcccaaagtctagagttgtaaaaccacctaattttgcctaattaaccagcgaagcatctacctaaaatcatactagtggtactatgagtagagtgtccactagttggagttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcactttcccaaacgtcgtcttcaacctccacgaagtgcggatcttccaaagctgcaatgtctacacgactaacggaaaataaaagggcttttactctaataaactccatataacaagcaggaaccaagcacaaaaatgggttcttgacttcttaaggaaaaaaaagagacttgaatggtccaattccgagttcaaatggccaagttatggccatttgaagtttatatgctctttaaatgaatatttgcggatttcttcatttaaattttaatttaaaaagggtttattgcgtcagccgaggggagggggcgcgcggactgggtccacgggagtggggcccacgcggcagcctcacggtccacggtggaccgggcgcacccgggctcgcaccggccggcgccgtgggccccacacgtcagccgcacccgagggcgcgggcggctgacggccgggccccacgtggcggccactcggcgcgcccgaaggcggccactcggcgcggccggcgggaggcggcgcccacgcccctatggtcgccggcggcggccataggcacggcggagcggcggccgagagaggggaagggaaggaggaaaagaggcggcggtccacggctcaccctaggtcgacggcgacgacgaaaaaggcggccggagcggaggaaggcggcggcgcggctcgggtcgacggggtcgacggcgttccggcggtcggcggacttggcgagggggtggacggggtcgatggcggtgcggcgaagctggagaaggcgacgccggggcgggagacggtcccggcgagcggagaaggccggccggaggtcgtcggcgacggaggagagagagagcgacggcgcgagctcgattctggctgggagacggcgcggcaagggcggaaacgggtgagggaggcgcggagagggtttaaatagggttggaagggggaaagagcggccggaggggaaggaaaccggcgcgggaggtccggccgccatcaatggcgccggcgagatttgcgggggcagg

SEQ ID NO: 7990 - DNA, 2557 bp, Oryza sativa
cggcgggaggaagaggatcacgggtgggccccacccgtcagcgagggtggcgggcgggcccacccgtcagcggcgcgcgcgcggggagaggccgagtgggccacggggacaggagagagagagagggggggagaggagagatgggccgggccggcccaagggagggaagggggacttttagggtttttctttttataaaatcattttaactttgtttatttcttaataattattatttgtgctctgaaaattccactaaaatttatttacgcattttaggcttttaggaaatttgcaaaaatcctccaagccttatttgacttttaactttgcacattttaattgttggaggctttcacacggattttaattattctaggcatcatttaagggatatattttagagtcgttttgggacgtgacagccagttcggtctgaatcatcgtaggccttgggttaaggcaggttcgtgtgggttcacggccttgattaataatattgtatagctctaggatcgtatttacaaaatagctttgagcaactaggtgtcttttaatgctgtttactacaaaccctaactcttatattataacccccttgtactcccttgcatttattcggcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttccggtttgtctttgtgtgtgctgggccttcgcctcccatgtaataaattaactatttatgcttccgcttgataaactctgaaatgtatcaacttttggtgtaccttgcctcctgggataaggaataatacacgcacgtaaggaatacccgttgggttatttccggtcgtgacacaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcatagacaaagtctctctataaagacatacctcgtttcggcatccaaaagacggcggctcaaatatataatgatatactcctttcctcttgcgtcaaaacggcacaaatgactttgtcttcggaggcaatatataaccgaaaaggctttccggctttaggcgctcgcacaacgggtggagtagacaaatatctcttcaactcttcaaacgcctcttgttgttttgccccccaagtaaaatcggcttcttttttcaagcaaagtataggaacaaaatcatcgattttacctgctaggttagaaataaatctcctcaaataattcaccttatctaacaacttttgaacttccttcttgcatgtcggtgcttcgaaatcacgaatcttttctatctttttaggatcaatctcaaatcctctctcatgcaccatgaatcctaagaacttccccgctgacacaccaaaagcacatttaagtgggttcatcttcaaaccatactggcgcatcctctcaaaagctaacctcaaatcggctatgtgtccttccataccatctgatttgacaacaatatcatcaatatagatctctaagataatacctagcaaatcatgaaagatttaattcattgccctttgatatgttgcaccggcgttcttcaacccaaaagtcatgacaacccactcaaacaaaccaacaaatcccgggcatctaaaagccgtcttgtacatatcctcttccgccataaagatttgattgtagccagcattaccatctagaaagctaatcaccttatgacccgaggcatcattaatcatcatgtcggctataggcataggatacttatctttgggagtggctttatttaaatctctaaaatctatgcaaactctaatcttaccgctccctttcttctccaccgggactatgctagagacccactccacataacgatatggcctaataaaccccgccttcaacaaccgatcaatctcctctttgactcggtcatataacaaaggattaaaatgaagaggtggttgcttataaggcctaaaacccggtttaattggaagccgatgctcaacgagctcgcggctaagacccggcatctcatggtactcccatgcaaagcaatcaacatactctttaagtagctcgattatcttaaccttataatcggctctcatatttttgtttacaaaagtcggccttggtttagttccatcacctatatctacttcttccaaaggatcggccgatgtaaacccttttccaagcttctctacctcatcaaaatctttaacggtttcaccaatatcgttctttgtagactgatattcttgcaccctcttttgtaaccactctaaattagcctctttactcattatacaaatttatatggcttagccgtgctacactagccggctttacagagataggtacaaatttgc

SEQ ID NO: 7991 - DNA, 7667 bp, Oryza sativa
  unsure (1)..(7667): unsure at all n locations
aacaagtaataataacaatagcaataataatgtcttaacaaaggtaaataggcatggctaaataaaacagtgataacgcgggaatttaaataaagcgataatgtattaatttaaatcaaaataattttataaactgggattcaatatgctcaaggatgatgtgacttgccttgctcgctttcccaaacatcggcttcaacctccacgaaagcggatcttccgaagctgcagcgtctacacgaccaacggaaaagaaaaggcttttactctaataaactccatataaccagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaatagatttattgcgtcagccgaggggaggggcgcgcggaccgggtccacaggagtggggcccacgcggcagcctcacggtccacggtggaccgggtgcacgcggctcacaccgaccggcgccgtgggtcccacgcgtcagccgcacccgagggcgcgggcggctgacggccggaccccacagggcagccgcagggcgcgcccgaaggcggccacgccggcacagccgacgggaggcggcgcacccgcgccccgatggtcgccgccggcgaccaccggcgcggcggagcggcgcccgagagaggggagggaagggggaagcgaatcggcggtccacggctcaccccgggtcgacggcgacaacgggaacggcgaccggagcggaggaaggcggcggcgcggctcgggtagacggggacggcggcgttccggcgatcggcgaccgaaacggagaggtggacgaggtcggcgaggacgcggcgaagccgaaggagacggcgccgaagcgggagaaggtccggggcgacgacggcggcggaccggagctcggcggcgatggcggagagagagagcgacggcgcgagctcgattccggcggagagagagagcggcgagtggcggaaacggtggagggaggcacggggagcgtttatatagggttgggagggggatagagcggccggatgagggggaaacgggcgcggaagatccggccgccattgatgcgccggcgaggttagggggaaagtttccgagcaaatccgagggagagagagagggaagaatggggggaaagagggagggaatcacggggaatatttcccccctcttgattgctcgcggggcggacgggagcggcgggattcgcggcggcggcggcgctagggcacgggcgaggcggcgggagcggcaggaggaaggggatgacgggtgggccccacccgtcagcgagggtggcgggcgggcccgcccgtcagcggcgcgcgcgcggggagaggccggatgggccgcggggaagaggagagagagggaaagggatgggccgagctggcccaagagggagagggggagggaaagggaactttttagggttttctttttataaaatcattttaactttgtttatttcttaataataattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcattttgggacgcgacatcaaccgattgttcttccttctcctctacatcaaccggtttttccttctctatggacttacgcctccataccggtggtggtcgcaactcattgaaccttttatctctttgctcttcggcctttttctctcttatctcttgagcccgaagacgttgcaaccttctcttttaagtagccgtcaaatccttaggcatccacctaggattcggttctattccaggaggtaaataatgtcctctattaactttgtttgaagacgatgaagccctcacatcgccctttacaatccggtgctggagcccggtcagaccggtcgtagaccaccggtcagaccggtcgtagaccaccggtcagaccggtcgtagaccaccggtcagaccagccagatgcgtcggtcagaccgacttttggagcgcagtcagaccggcctgaggcgtcggtcggaccgctgtcgggtcgacggtcagatcggcctgatggcccggtcagaccggccgtatggccgcggtcagaccggccgactgcgatgagctggtaccggcttcggattttttgattggggattctccaactttatctccagaaggtattggcacatcatgagaccccactttgatggtaattacttccgaagtcctcgcctccaccttgacgcgctttccttccctcctttcttcattagcccgatttttaccataaaaccggccgttgtttggtgaagacaaacgctcatgaattggcctccttggtcctccccacccttggttgaattgcattagaggcatatgattgaacattggcagcgttgccccccatggcatgtaataaggataaggataacttggtggcggcattggataagaaccccatgacatgtcttgtggatgatgatatggaggtgaatgcgaccgtcttggtgaatgaccaaatcgctccctaggaggtgatcttggtcttttacctttgttgcgaattttctcaccaccttgcttctcatatttctccaaaagcatatcaaaagtcactttggtcttcctcggggcattagaagttgaagctccactcttattctccttccaaacgccaacctccggcttctttggcactatcatcttaggccttggctcgccaatgatcaccccttttcccttagtagattcggcttgctccggccgaatcaacaccttcttatcattgaaattaattgtattcaccggaaaaggatcatgatcaagcttcatcttggagccatcggtgaacttcaattgtccttcatctatggccgattgaacctatcgtcgaaacacattgcaatcattagtagaatgagaatgagaatcatgccatttacaatatactcgacgtttcaactcttcttgagatggtatgacatggcctttaggtaatctaatttgtttctcttgtaaaagataatcaaaaatcttatcacacttggccacatcaaaactatatttaacctcactttgtcgatctttgcgaggagtcggcattaggttagagcaaacaaaaggcttatttttattagtccatgaccattcggcaacatatatatcatgatcaccctcctcctcactatcactagcctcagggtaatcaaccacattaacattaggccttttgtcatatggtctaacaagttttttattatccttaacctggctttcttgagccagagccctttgcatgagttgactaacatcaagaaattgttggctatctagtctttctctaagaggagcaattaaaccattaaaagcaagaccagccaaatctctatcagttatattcaagctataacatcggtttctaacatccctaaatctcttaatgtaatcaatgacagattcattatacttttgcttaaccgatgtcaaatcacataacctaagctcagtttctccagtatagaaataatcatggaatttttcttctaattgaacccaaatatgaatagaatttgccggtaaagaagtaaaccatgtaaaagcattaccggacaaagataaagaaaacaagcgcaatttaaaagtatcactattagcctcaccacattgcgccaaaaattgacctacatgctcctatgtggtcttaccatcctcaccactaaacttggcaaattcgggaactctataattacggggaaacggcacattatcataataatcaggatacggctttttgtaaaccctagcacgattcctagtttcgatcccgaatctatccataataatatcactaattatatcctccatattattaggcccatgttgattcagcggtggatttggtggcctaataggttgtgtttgtggcacaatatgattatattggccttgtctagtatcgggacgataccccctagcaacatcattataagcattaggaacatgtgggggaacttggggattagttgtagcagtagatataggaggatcaaatgtcctaagatgatacaaataactagcattagtcattggatctatccgttgtatcggtataatcgcgccggtctgaccggcccagggcccggtcggactggcgtccagaggcacggtcggaccggcctgagtcccagtctgaccggccgtctggccggtcggaccgacggctaggtcgcggtctgagcggccgtcaggcccggtcggaccggtcgtgtacaccgttccatcggttctattacccgtttgatctaaaaccgagtttaaaaactcgagggtggatgaataggcggttttaaaacttttggctaaaaccgagttttgtatgcggaaacgtaaatgaaaacggttgagaggaagaagctagcctatgttgaggtttgcaagcctagggtggtaatagcacaaataaactctagtatgtaaacttactcaaagtaaatttgcacaaaataaaagagacaggtgacaaaggatttttccaaccgatatttggaagtttgccaacttcctacatcaccgttgaggtaagaccaacttcaccgctcaaaccacgaagccaccacaagcccccatcgtcaaggggtgggcaaggtgggagccaacccacgaagtggtctcccaagcctctctcactatggttgttctttctccactccggagatggcgaacaccaagccactcataatcaacactgggcctcctccacaaccttctcggagaggtcaccgggcaactactccaaaccatctaggaggtggcaacctaggatgcttgccgaggatgatcaagtgtcacactagctctaacaattaagcaatgcacttggattagcttaacttactctctaatacctcactagataaactaagtgcacaagggtgtgtgagtccacatcagtagataatgcaatcgagtaccaaaacattacccatactgctggggagtgggtatatatacccccaaccatcaaaactagccgttggagtcgaaatccccaacttttgtgctctgccggtcaaaccgccatgggatggccggtcagaccggacatttctagccgttgcagtgcattaaatgcactgacacaagggggctggtcagaccggccacgactcggtcagaccgccaacatctcggtcagctggcctcggctctagcggctctggatcaccaagacgagacctctcttcaaattcagggcagcggtcagaccgctatgggagctgcggtcagaccggacaacacactccggtcaaaccaccataagggttgcggtcagactgcaggtcacttttcagctcaattggacgttagtaaaacgacgatatctcttgactcgggtctcggaatttgactttcttggactctatggaaagcttattcaaagggttatccaactcatgaacaattaatccaagatacacaacttaatttagggagaaagggctcacactccaaaggatatccatcggacatacccacaagatgtcgctcactccttttggacatgcatgcccacttctctctttgtttgggacttgagaaaactcatcacacttggataaacatgcccaccaaatgcacctacatgcatataaactaatatggcacaagatcaatgcgttcgcttcatagacccctcttgatagaatgacgcctatctagcaagtcaggtctacaccaaacactaacaccggggaaagactatgaaaacaatattagttctattatatctttgccttgtgccatccaacttggggtcaatgcttgagctaagatcaacactcgtgaccattcgcttgaaccatatttatgccgaagtcttaaccatcctttgtcaagactttcttctcatcacaatcttgacttcattcttgtcaacatggcgatgtccttggcttgttgaccatcaacccattgtgtcatccattagcctcatcatggtgggacctattcctttgcgcagctcaaaggagaacattagtcccaacaaatcggttgtcatcctccacttgatgaccaaccggttgcatatgaaagatatgaatatgtttgttgagtattcattatacattaacaccacaagtgccatatatatactcgtacgcaagctcaagtgcaaagatccgatataaataagaggagaataacatggatatagaacatacacaataaatgaataggatttgcaccccccaaatatatgcatacaaataaatttataagaggggcaagtgtatgcataagtaaagaagaagcaatgaggtttatcctatacacatggagaaggcatgtagcaatgataatgataaacaaaaacacataccttcatgatctccatgttctcaatgtaaaggagactaaataagataagactcaagtaaacattagtctcacacttatataacaataacatgaaaatcatatatatatgaacctatcaaaaggtaggagtaagaagtgatacatatcgctttatctccatgcatttcatccttatcatgattaaggtccatcaccaaagaatgcatatctaccacatctcatcattgggaaataacctagttgacaacttataaaaaagagaggttaatcccataaacattggtttatcatctatcaccaaagtaacaattacacaaattgtttaatcccagatctttcaatcttttctctctttagtgatagataataactggatataacaatatagaaagatgagatgaacgataattttaaatcaagctagagatcttataataaacaaaatataaaataaactcccccttaagatatgcatacatatggatataaaggaacgcatatgcacataatcaatcaagatcaatgacggagctcacactatattttggatccacaagagagaccaagttagaatatatgaagtttaatacatacctctcatcaattttattttcatatccaaatgagactagccaaagaaaagctcataaaaacattagtctcaattaattagatttgtcattaattaccaaaaccaaattaaggcacatgaacttacaatctccccctttttggtgattgatgacaaatccattaataataaccatatttggatatgaaggatataaatcaacattatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7992 - DNA, 3954 bp, Oryza sativa
ccaaaacggcggcggaagaacaacgaacgacgacggcgacgaggaggaaacggcggaaaccttcgggttgtcgacggcgacgaagctccggcgatctccggcgacggcgaagggacggacgaggacggcgacgacttggcgagcacgacggaggtcttcccgagcgacggcgacggctgaaacgacggcggcgcacggctggagcggcggcggcgacggcaaagctagggcacacggcgctagggtttttccgacgacgagaggcgaaggcgaaggtggcaacgggtagaggagacaccgagggtccttttaaaggggctcggaggcggcggcaaaggcccacggcggccggcgacgaggaaggaaagatcgggaagaacgaatccgagacaaactcgaatccgacgctttccaaaacgatttagctaaagattccaaaggagaaaggtagaggagatcccgaggatcatttcccctctatcaattcggccggagaaggaaaggagcggccggatttggaaaggaacggcggcggcgcgaaactagggtttcgggcggcggcggccggaggtagacgatggccctgacaggtgggacccacctgtcagcgggcggacgcgcgtgcgcgcggcggcggactgggccgaactgggccgaagagagagagaaaggttttgggccgactttcggcccaaagccaaaagagactttttaaaacctttttcaatttaaattatttctttaatgcaattccatttattaaaaatactttcttagctcaaataaatcccagaaaaatctaggaattatagaattaagcaaagtatttaatgaaattttatctggcccctttttatattggaatttattaattaaaactagatcttctcttcaagacttttaaaattatttctaaaaattccatttaaacaacaatttataaattttaaattttcagggtgtgacaaacctaccccccttaaacagaatctcgtcctcgagattcggaagaactggcgaacagatgcggatgagctgacttcaattcatcttctcgttcccaagttgattcttcttctgagtgattactccattgaactttgcagaaacggataactcgattcctggttcttctctcatttgtttccaggatacggattggtttctcaacataagtcaaatcctcttggacttctatctgctcaatattagcttcttcggtaggtacccttaaacatttttttaattgtgacacatggaacacattatggactcctgccaaagattgaggtaattctaactaataagcaacctctcctcttctactgacaatcttataaggtcccacaaaacacggtgccaattttcctttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgcttccctcaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagagtcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttgaaaacccttctttggatcaggcaaaatcaaaataggagctgatattaagcgacttttcaactcttgaaaactctgctcacattcttccgacaacttgtacttcacatctttctgaagcagtcgtgtcatgggcttagcaatcttggaaaaattctctataaaccaccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatagagttgatgttctcgtagcttctccaatgcaaggcgaagatgttcttcatgctcttctttggttcgagagtagataagaatatcatcaataaagaccaccacgaacttgtctaggtattccataaacaccttattcatcaaattcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctggcaactcattggctgccattcgataaggtctcttatggatcggagttgttccaggtaccaaatctattctgaactctatatcccttttaggcggcataccaggtaaatcatctgggaacacatcaagatactcccggactataagaatctcttccaaagatatctggttcagtcttgaccttaaagactcagatgacaatg

SEQ ID NO: 7993 - DNA, 2736 bp, Oryza sativa
cggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacaaagcgagatccctgggtaagcgacctgaactccttcttcttgagagacactactcctgatggtatatgcgtcttccggaaagcagcggtgaattcaagccaagtgataggttcagtagtagtcctattcaggcggaagtgatcccaccattcagaggcagggccatgcaactgatgtgatgcaaatgagaccttctcctgatcagtgcactgaagtaaatccaacttcttctctatggcatgcagccaatcactagcttcaacaggattagtggtactagagaaaacaggcggcctcacacgaagaaatcctgctaacttgttctggggagatgcatggttatttccttggttttgctgattctgaaattgctgcatcatcatgtacataagctgtgtctgttgagcaagaacttgggcaagagtgggattctctccattgttgttattggggttgttgggaccattcccgctgctgcgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttcttcatcacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtactggcccggtcacttccctggggttggcgaggatggtagcgatactcagtgtcggccaactgatcacggtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattgatttgaataaagttagaaaatcagagtaaaaaggtaagtaaataaagtaaaccaagctttgcgagataagttaaaacagttggaaacgaggtcacaaattttgtaattttgaataactggtttcaaaagaaataaaagaaagttatgaaatcaacatgctaactttattttattgcagcaagattaaataaaaccatattgtaaaacttttgctggtaaataagccattagtacagtaatggatgtacagtactaataacactggaataaatttttaaatgagaaccattaaaagagattatgaagtgcatgtgccattagtttggtttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcatccaggaatcagccgaggcacacaataacaaattgataatagagtacaattattactctaattaataagcgaataaaatgtcgttacagaggtagatagttcctctcaatcaataaagatctaagcagcggaaaataaaataaacggcgcagacggctccactccacaggcagcttgaccaaggctacacctattcctccactccatcagaatcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgata

SEQ ID NO: 7994 - DNA, 9245 bp, Oryza sativa
  unsure (1)..(9245): unsure at all n locations
nnnnnnnnnnnnnnnnnnnnnnnnnnnnnnnnnnnnnnnnnnnnnnnnnnnnnnnnnnnnnnnnnnnnnnnnncaaagctcaaacttagtagcaggaactggctttgtcatcatatcagctgggttttcatgagtacttatcttgcataccttgacatcaccttcagcaatcacacctcgaataaagtgatatctcacatcaatgtactttgttctctcatggaacatctgatcctttgtaaggcatattgcactttgactatcacaaaatatattaatgcaagacgtaactccacaaagctcagtgtacaaacctctaagccaaatagcttctttacaagcttcagaaatagccatatactctgctttagtagtagataaggcaacagttgcttgcaaacttgccttccaactaacagcacatcctccaatagtgaaaacataacctgtgagtgatcttctcctatccaaatctccagcaaaatctgaatccacataaccaacaagtccatctctagatctcccaaactgcaaacaagcactagatgtaccacgtaggtatctgaaaatcctttgaacagctttcctatgctctttgccaggattagccatgtatctactgacaacactcagtgcatgtgataagtcaggacgagaacataccatggcatacataaggaaccaaccgcacttgaataaggaactctagacatgtactcaatatcataatctgactgtggacataaatctgaagataatatgaaatgtgcagctaaaggagtactcactggttttgcatcatgcatattgaaacgacgaagaactttttcaatataacctttctgactaagatataacttgccagaacgtctttctctagtaatttccataccgagaattttgttcgctgcacccaaatccttcatctcaaattcactactcaattgtgccttcaactttgctatctctaatttgtcttttgcagcaatcaacatatcattgacataaagaagcaaatatatagctgaaccatcaacaactttgagataaacacagctatcatagtttgatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatataaatgtcctcttctaactccccatgtaaaaatgcagtcttaacatccatttgctctagttcataatcatacattgcaacaatactgagtaaagtgcgaattgaactatgcttcacaacaggggaaaagacatcattaaaatcaatacctggtatctagctataacctttagcaactaaccttgctttgtatcttgcctcatcacttggagacataccttcctttcttttgaagatccacttgcaacggataggtttcttctcctttggcaattcaccaattcccaagtatgattcttttcaagcgactccatctcatcatgcatagcagttatccatctattgcaatcatcagaaacaatagcatcagaatatgtagaaggttcgacattaccttcaatttcttctgccacactcaaagcataagcaactatgttcgcttcttcaatatatcttcgaggaggtttaatatttcttttgggcttatcttttgcaatagaatgttttggagactgctgaacaatagaagaatctgaatcttcaataacaggtgcatctaggttaatagcaacattttctttttctggtgcatgccctgaactaatcaagtgctccacctgcacacttgctttctcctgactctcaacaggaacattagtagaaggtttgtcatgtaacataactgattcatgaaagacaacgtttctactaatcacaacctttttggtttcaggacaccataacttatagcctttcacaccagacggataaccaagaaaaatacacttaatagctctaggctccaatttactattatcaacatgagcataagcaatacaaccaaatactcttaagtctgaataatttgctggggaaccagaccataccttaattggagtcttcttatcaatggcataactgggtgatcgattgataagataacaagcagtggaaacggcttccgcccaaaactgtttaggcaaacctgcattagacaacatacaacgggcctttgatataattgtcctgttcatacgctctgctacgccgttttgttgaggtgtgtgaggaacggtgtagtgacgcacaatgccttcagacttgcaatatgatttaaatatcttagaacagaaatccatcccattgtcagtacgaaggattttcaccttcctttcagtttgtctttcaaccatagttttccactctttaaacacatcaaaagcttgatatttgtgcttcaagaaataaggccaaacttttcgcgaataatcatcaacgatagtcatcatgtaacgagcacctccaaaagatgtcttacgagcaggcccccataaatcagaatgcacataatcaagaataccttcagtagtatgtgtagatgtgttgaacttcaccctcttatgcttgccaaagatgcaatgctcacaaaatttgagcttcttgatgctttgtccatctagcaatcctcgcttgctcaattctgccaaaccaatttcactcatatgcccaagacgcatatgccaaagattagtagcatcggaattagataatgaatcagaaactgctgcaacattacctaatatagttgtacctcgcagatggtacaggttggcagatttaatatcagctttcatcacaacaagagagcctttagttaccttcaaaattccgtctccaccagaatatttgtaccctttgcgatcaagagtacataaagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgcacagcttcataggtggcaaaccaatccctattcgagcacatgtgataggtgcatgcagtatcaagaatccactggtcactagtttgtgcacaaccagcataagcaacaagcaattttgcatcagacttctcatcagtaacaactgcggctttaccttcctcttctttcttaccttttggtacatattttccggttctcttgtctttatcctgtagcttccaacacttagagatatcatatccatctctcttgcagtatttgcatgacttatacctgcctctagactttgatctcccatggtagctacttgaacttttatctcttgatttgctgtttgtgttcttctcctgttgcctgttgcctgccccgaacaaccaagccttctgcttgtgaatttgaaccttcagagggtaccatcttcttcatcttttctttggcatgcaaagtatcataaatttctttcaaagttagagtatcacggctataaagaatagtatccctgaagtttgcatatgagctaggcaatgaacacaataaaataaggcctaaatcctcttcatcatactttacctccatagactcaaggtcagcaacaatttccttgaaagcggagagatgatccatcacagacccatcatcttgcaacttgtgcaaaaataacttttgcttcaggtgcatcttactggtcagattgcaaaatattgttagatagatgaagatgaatatatgacatagccttacgatcccttttcttctcatcgttggaccaatcctgtgtcctcttgtcaaatccagaaagcgcatcatcgaggtcttgctgtgcaagaacggctcgcatcttcacttgccaaagtgagaatcttgtgtctcggtctaggagcggtagatcatacttcaaacttaccatgggaattaatactgaatttgctagtaagaaattgatgtaaacctagcaaaatcgcgaaacttggtacacttctcgtgtgcacgtagcgtagatctgaaacttcctggtacacaagctttggtggctgtagcaattttccactggaaaaattagcatgcacagaacgaaacaaccgatctctctcggctgatttttttttcttgaaccgtgcgcttctgtattagggctgctggctgccgatgcttctgctgcgcctgcgctgctcctctgacgcgtcggcggcaggaaggacgacgtcgactccgagtcgacggcaactttgcttcggattggaatcacgagacgacggtgccgcccgagatcgatttcttcgatccgataaacacgccggtggctgggaactagtagattgatccccaatgctctgataccacttgttatgaaaatagatgcacaacggagacacgaatttttacgtggaaacccttgtgggaaaaaaccacgggcgccgaccggcaatgatcactatagaggagataattacaaacgtagaggaataacaatgggaacgtcaccccttcccgtacggtttacaagagtatatataggggataatagaaagacacctaataggaaacctaataggaactcctactaggaaactaatcctactagcaaactaatccgaatatattgtgggcccaaaattcggatcacatatttaacaaaagtggtaggaaggcctactcttaatacactaaccatcccattggatcatgctgaaggtgtagctcctactcgcagctgatgcatgccttatggcgaagtcgcatcgtgctacccaagaggcaaattattgcctgtcgatcatagctattagttcaaagccttttactatggcttcgctaagactgctaaaatttggtatgcctataaggatggcgataattttgaattccctgccagttttaaacccaatttgattaataaagaagggatatcttcatatcaaccatcacccattgccttcttccaaccggggtctccacgggttgtaactcccatgtctcgtatgagttttaccgtccactagtttctacttatcaacttcgcttcgcttagcacccgattggcctctacttcattgacaaaatccaggcgaggggcccagtagccaatgccatagaattcgatcgtttcatgttgatcgagagaccttcactaggcgattgtgaggatttctatacccacacatctagttcaaagctctggtcccgatggtggtggtgtgaatggaagcaacatatgtttaacctgattggaaccacttattgctgcattcttgatcctgattttgtcaagaccaacagaaaggtatccattatatgcactcttccctattttcaaaatatttattcactaacactttcatgcctcatcatcttgtaggttgtttacgtcgatcctcccatcatcagctaaagtgggtgccgcatcgaatacgctcctgcatcggccaatccaaacttgggagttggccctcttcctccttcatctttgctccaaggcccccaaccaaagcgcaaaagaaagaagatattagtgcacctgagttgcagaagcaaaagcaaaagcaagctgccaggcactccattgtctccgttgacttagaagagctcgatgctgatatcgggattgacatcaacagtgccacaaccgatataaaagatgctgctacttcaaatgttgctgccgatgctgccatcaacgccgaagttgatatatgagtaaactgatgctgatccttattttacagcattacatgctacttcaacctctccaatcgcaacaaccttgcattggtacctcctctgcaacttctcaaagattatgacttcttaactaaaaccaatcacaaaagatccaatctttttgtcatgcttttacatgcagtttagaatcccaggtgatcatccagctatcaaatgattttcctccaaattatcaccacatacgtgtataactgcatcatctttttccagcaattcttttgttctaatgcaagagctctgttgtgagctttgtatatatgtaacatattcttgcattacttcagtcagaaactgaccggctaggttgaaagaagacagcagcaaggacaacaccatccttctcttccatgacgatcaaactagaccatccccacgtcatcatttatccgctttgctgcgcggcatgtcaagaacggtttcagatcacttccgctgcccccatggattctgacttcacgaatccatgatgatgatgatgtccatcttattaaaaatttgataatttaacattgttttgttgcctaattgctttaattaacatttatgaggatgacatgtgggaccacctaagtgaatgaaagtgggccatgatctcaaataatcgaaacccattttaaggagtgttaatcagtaggactgctgacacagtgacttggaagttggaacaacatgactgctgcacgagcaacagtggcgcttatgcctcattggcgagtggcccttgcaaatcagcaggaatcttactgtccggggagtgggactggtgaagtgcgttaggggaggacaagtaaggttctaaggttagagcatagccccaatccacaatcagtccaagatctaagaatataggcacatagcaaacaccacaagaaaatacctagaaagtcccaaaatctataacacccgaacgaaccctaggcctccagaaacagatcaaagaaatactttgccataaatcaagatcaggcaagatatatctattgcacaaacaagattgccaaatatcaaatcattaatttaagtgggatctacaggatagcacattaaaagccactggattgcaggaggaggactcgcgctgagctggcggcctgcgattttcatttgctgttcttttatttttgttttctttttgttcgggcatatttgctcgcgtggactgggctgaaaaacaccctagcatgaacagggatgaattgtgtggattgggctggctgtaacttagcagtgacgggcgaaagactcatattgcgtgcacgatcacgaggagacagatgaaaaagatttgtgacgaacggaaaactactaattttttaattagttaagataccttacatgacgtgtagagatgagcatggtatatgagttttcacggatatattttttgtcattctccattgagtgggtgtctaagaatatgtcctggtaggaaaacaatgtgattggctctactggcacctgttgtttagagtttggtaccctaagggtttttttttcctacaactactagtgccaatgtgctagcgaaaatgcactgtacaaatcatggagtgccgataaccacatcggacaatttggcattgctaaaatgatataattttttcaataatagaaagttgtctaacccatgctagttatctcttcaaagtggcttcacactgctggtccactatgtcataatagtggaccaaaatactactatatgctatgtcttgaagaggaacatatctgtgcatacaagtcttgtatacacaccatgcacatcaactaacaaattttatcaaaaaatctggaaaaaaaatgtacaagtacttcttatactattacagtatgtgtaaagtcttaacctcaaatttattatattttagccgtaacaaaaaagataaaaattctgacagttttgagagtacaaatctatcagaattttatcttttttgttgctctctacatataaagaatatgaagatgagattagatgtaatactattaaaaatacatgtataatttttttccaaaatttttggagaaatattttcgttagtatgcatggtgtatacacggtaaggcttttgtgcataggatatattcccatcttagagttggtagctaagcatctcttactttattatggttggtgtactgtatagaagcttacttgttataatctgcgtggtcatttgaaaccttttagctagtctttctttgggtagttagcaatttgtcccatcatattatgtcatttttatttagtataaaattatattggctctgtgctataaggcagaggctgggaatgcaatcaattttcattatctaaaaaattataggcaaattcagattctccattccactgacataagatatgttctctgaatcttcttttcctttagttggagattgtgtgaccgatgctaaaattctcgtgttaggaatttaaattctcaaaaacgccgtgagtgtgtgtagcatactagctagctatcttattcaacttcgtcaaccataagcatcacaaattaacaaatgttggaggtagaaataatgcatgatgacagggaagacagactatatatgccggatttatactcctacaggtacaagcaattcaacaatcttataaagaaatcatgaagagagaacaccaatcttggtcagatgtaaattcagtaacatgcaggatgcggcatgccggcgtcaatttttgggggtgggatttggtgggtgagtgtgcgtgcgttgtgagtgtctgtgttgtactgtgttattcttaaaaaaaaaagtaacactctttgttgaataacatctggaaaaacaaagccacagccgttcctgctagggttaggacttttgcttggagacaaaatagaagacttgcttttaattaagcatatatatatgccttttacatttacttttcgacagacttgcttgttttatttcagaaactcatgatcatcttagaaccgatgctcttaccactatggtcctccagaatctatactttgcctcgtgtttgcattatatttgtcagatctatagaatgtcccgaccgatgtgtaccggagaaagtaaaatgtgagatatgataagaagagggtgcaccgaatatatatgacggaaaaatggacccatttttgttcatgacattattcattcaccagatcatccatctcctagagtacacagattcaaatagtttggatctgttccattgtttcaacaacagctatccacacagattgtgaaaaaatgttgtagcgtgcatgtgcaccaatcatgagagagagagaaggattaagcattttattagtaggtaactccgtcgatcccaaaataactttagatactgcccattttcaaaacgagtttacttttatatcccttacctgtgctcggtttacaaaataataagttaataagtttcatttgttcac

SEQ ID NO: 7995 - DNA, 1083 bp, Oryza sativa
cccaatcaagatcgaggttttttttttttgagagctcatgcactttattaaaagaaagcgttttagaaacacaaagcatgaggtacattaactgctccattaggagtgaaggaaagagctcttttagtaggacaaacatctctggaacaaatgtgagaaatattagagcaatcaaaagctaagcagctgttagtctgagcttgtcttgctgactttgcaaggccatctgcaactttgttgagctctctagagatccaaatgattcgaacttgttgatcctgcagaaaatttttaattcttgaaagaattggtctcagagaccaatgtccggggttttgtatgtagtcctcgttctgcacaacattcactatctcactgttatctgagagaaaaatagggtcttgcagctgaagatgacgagcaatttgcatagctaaaaataatccttcagcttctgctagcaaaggagttcctgcattgagactttgagctttgatgacaatagcattgtgattgctagggttgtggatgaagatccctactcctattttctcttccttccaagaggcatccacataaactcttgttcctgtaggaattttaacaatagaatttcttatattattctcttcagcccgattgaagtcttggcaactgtcttcttccatttgatgaacactttcatatgtctttgccattgcctgcgcagcattgcacacttgttgtggctcccaaatctttgttttgaagttgatatcattccttgctttccaaatctgccaaagcataattaaaagattgtatatattgatgccattagctgaaagataggcaataatatcttgaacagagcctagagaagaaagattatcagctttgagattaaagtcagagatgaaccaacataaacgactgaaattatagagaaagaagagatgcaagtcatcctccctttgaccacaggtctgacaattgggactaacggttttgatcctgtggtgcattctttgagcagttgggagagcattactcagcagcctccatccaaaagttttgactctgggaggcatgtacctgtgtttc

SEQ ID NO: 7996 - DNA, 874 bp, Oryza sativa
ccggcgtgaagcagctggcgacgacggcgaggccaggagcgaggacgacctggtttaaaaaaagggaaaaaccccggggtttggggtttttgggggcctttccgaaccaatgttcggagccatgggaaggacgacggtaaggtggccatcgacagagacctgatcagaacatttctcactgtaagtaaagcaccaaactgtatttctttctctcgtgcatatttttctctcgcgtacgttttttttttcaatgctacatgatgacacacgccgacaattaattagtggcaattgcagatttgcaggtatctgcaggtatatagttataagtcagctataaccacaaatgaagaaaaaaaatatataaagattggtcgttctagtgtaagagctgactttatacatatagtgcacaattgtcacattaaatatataagtgagataaaagaaagagaaggaaaaaaaagtgggtttgtagctactgagtagttctattattgcaaagtcatgatgttatattacaaaatttgcctttaatctttacttattatacaaaaggggtagtacggtacgtgtgatattttcaaaaaagaactattcactccatcctaaaatatagagtaataaacacgtttttttatatttcataagacaaatcgtgcatacatgcatacatccctttcttttaaatttgttttgttagtcctacatcctcaagatatctcctattgggtgcatgtaatatcttgcccaataaggatgcgacatgtgtgacccatgagtgtcgtgtgctctttgctaccacattgctagttgagtaatagtagaaccagcttataagacattgtctccctaactataatatatcattttc

SEQ ID NO: 7997 - DNA, 669 bp, Oryza sativa
  unsure (1)..(669): unsure at all n locations
atgtcagaccaagatttccaacaaataccttctttactgtcttcatcattggtacctgtccaccagaatttcctgataatggcagttaatttatatagaagttttttggagtgtaaaatggtagacatatagaaaatagggatggaagcaaacacagattttattaaagaaagtctaccagcatgggataaagtttttgctttaataattgacagcctggttttgaatttttcaatgataaagttgtaggcagagtttctggctttagtatttagaatgagaggatgaccaagatgtttggaattgttgttcattaaggagacagggaaaatggataaaatatcttgagtgacactgataggataggagtatgagagctgaacagaatagaagatttattccaacctggagtttgacctgattgatggcaaaaaaattgaataatttggaagatgcttctagcttcttcaggagtggcttgacctacaatcataagatcgtcagcatacattgaagagtgagggtgggttgttttttaaaagnaaaatttccccccccaaaggggggggggaaaaaccccctttttaactttagtcccttctttagacactaatttagagtattaaatatagactacttacaaaactaattacataaataaaagctaat

SEQ ID NO: 7998 - DNA, 726 bp, Oryza sativa
cgctcaattaggccactcgtctcgtaaatgtatgttttttgcacatagctttactcatcctgttggccacttcactgaatagagatgaatttgcaatgcacagaattcatcttaggaatgaagcaaaaactgcaaccctcgagaaactggttcctcaccatggaaccctggaagagacaagagcccaactccatgaaaccagggagcttgccaggaaaactgaacatgatcttagggaccgaatcgccaagctccaagattccaatttcgagctgagtggttcatccaaaggtaacattttttcctgtttgacttattccaagctgctatccgtatgtaattaatcaatggaaaatattatagtgcaagttgccaagatcaccgagctagaaaagcgaatcaaagctctggaaaaagacaagggtgaattgaccaaacagagggactcggctctgaaagacatcgaaggtatttgtagttaaaactccagaaccattcttgtcttcgtgcccagtcattgatgtgaaccatttatgcatattgcaaaattaaatctcaggctcaattcgacatcttggtcaacaaaattaagaagcttgaaggagccagggatgaagttgccaacgccgctacaccactcatccaagccatgtttttttaataataatggtctgagtttgttcgatgctattgaaacttcgacaagctgagagctgttttggatac

SEQ ID NO: 7999 - DNA, 676 bp, Oryza sativa
ttcaagtagtcggactcttttaatcggatctgatgataccctgagtagcaatccaggaaactgagtagctcgcagccggccgttgagtcaactacctggtcaatgcgaggtaacccgaagggatctttgggacaagatttgttgaggtcggtgtaatcaacacacatacgccattgcactgtcctcttccgaaccaggaccgggtttgccagccagtcgggatgtaggacttccttgatgaagcctgctgctaacagcttggtcaattcctccgtgatcgcatccttcctatcctgtgcaaaacggcggagtcgttgcttaatgggtttagcgtcttccttaatatgtaaagagtgctcaataacctctttaggaataccaggcatatcagatggtttccacgcaaagatatctttattattttgaagaaaggtgatgagcgcgctttcctatttacaatctaactcagcgcttattacagcagtcttagtgggatcagagggatctagaggaattttcttagtcttggcatcgccttctccgctctttttggaaattaatttcctttttggggggaaattttgcatgtacaccctaaaatcttaaatatataattgttgttaattggaatattagaattgattttaaaagcctagaagagaagatctaattttaa

SEQ ID NO: 8000 - DNA, 22648 bp, Oryza sativa
  unsure (1)..(22648): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacataggttagactccagatccagaaggaactaaatttctccaggtagagaactttgtaatgcttgatcgacatagtgatacaaacatgaataggattgttattctccaagaggtctaagcctgtaaacattttctgtgttgacttagctccggagcaggtccaagcataccaaggatcccaaaacccctcctcgaccgggatcgtttgtttcccatgtttgtcaaattagtttgtttttccgacaaataataatatatattttccataaaatgtcttacctataattttactgcagagattattcatattaaatagattttatatgtggcaatctatttctatttcattgattttttaataataagtttaatgggtaatttgcacaactccaataggaataggtggtgtaggatattttctgttacaaccattaccttccaataggagtaggagtattttttttttcgtgaccagcattgtgttaatattattattcttttcacgtgcaccgtaccctctaaattttaatcctgttttcactactgctgcttgtctggttgtagcgtaagggatgaccttatggccgaactactgctcgcaaagctgcaatgcatccatctgaaccatctttttctgagggctagcttgagggaatgggaatgccaccaacgggctggacatacttgtgccgaaacgactacgtagttaggcctgaaccgctgtgataaaattcgaccggtcatatacattacaacaataattgcaggaccgtctatacttgggtgcaaggtcgacattggtgtgcacgacacagtttgaagacatgatcatatcatatacagatctacatatcaatctatttttttcatgcatgggtcaacatattttagttgcttacatttcatctttatctcacccatgtggacctattaatttgatctgttgatctttatcttcatatcgaccagcccgtttagcacgttgatgcacactctcagcttcagggcgttgatcgggcaacggccatgctcatcgtgctggccatggtgcgactgcactggcactgcaacgggtgttgccgggacagcctgctcgccggggcagttgggtgtgcaaccgtgtgctaccacagcaaagaggaggaggctaagggccagaaagggagcgacgaccgtggaagccattgagctgggatcgagtgagctactagtagtcagtgatcactcaagagctggcttatggctgctctatcttgtgtggcttaggaacggtttgcttctggtgtttgggtgtgcgtctgctatttatagatgagctagcttgctataggtagttgcttgcatgatgcatgcatgtgtgacatgacagtacgttgcttggttttcctggatggatttgcatgcatctgcctgcatgggtcggttggttcttcgagttggcaagataatttcttaattgcaacgttgaattttggcatgcagtcatgcagagcaccaattaaccaatcatctccaattcaccagttgtccattttatcacaatttcttaatatattacatgattacatagtaatatactcccttcattccaaattgatctgcttatagttttttttgagattattactaaatgatctatatatttgtgttcatttattaagtctattcgttatttgtgcattagagtaaatggacattgatgcatgcatccatgcacacaagtatttataacccacatgtaatatcttgatttgctattggctaggaaatagtggggatggtgcatatatggagtttgttgctaaagtaaatatagtataagagagttattagcttttcttggtctttgtgtacctgtgaaatatttagatcaatttggaatggagggagtattagctagtagtatttattttccgtagttacatggattacatagaagttgaaccaaactgcgatgtattatgctgacgagagtctactgattacgcagcaacttatctggcttccaagagatgagctacccagccaaacctcgtttcaatatgaatatcctatatgtcggtaaacttattttgtccactttcagactcaataaaagacacctcgtttcgactttcgagctaagagtaattgatattttattggaagctgcacaggtatcagatgttgcataagaatcagaaaagactccataaatgctccaccaagataacctcactaaggcctacctatgatgggcagaagtacctcgcctctaacgggctaaactaaagcccactctagataaggccccacgggcacagctcgtcacagctaagaacttaattgtgacgggcccatttgtgaacccgataaagaacacctctaacaagcccacatataggccatcataggtgacaacacacctgtaggggtttatagacataatccgtcgaagatgaggacagtcatctctaacggttcccttttttacccatcacagatgaaaaccaccgaacaatacccatatcactctcccacccactcattttcttctctctttcactctctctctctctccctctctccctctctctctcatttccttccaccaagatcggatccaatgcaccggccttagcctccaaccccgagctcctgtcgccaccgcgacctccacctccccctccccgagcacgggtcctcattgcttccatccacgagcgcccgtcactgtcgcctccacctctgcccccaacttctattgattgccgcctcaatccacgagcacccaccaccgcggactccacctccattcccaagctcgggctgcctccgcctccatacacgagcacctaccaccatggccttcacttctgccctcgagctccggtcatttccacttccatcaatgatcgtccgccactaaggcctagacctcttcccccaagatcaggtgaccgtcgcctccatccacaagtgccaaccccctctgcctctgcctccacccccacatccatccacaagcacccaccaccgtgccctcactacaacaaaacaacccaaaggagacatcttatttgtaagatagagacgttttatttcgtctcccacagataactgagacgcttttataaagcgtcgtaggatcgtctctgtttgcaccgtctcaaaattatggagacgctttttaaagcgtacctatattatttaagacgttgctagagacgtgtaaattgcatctctataaaatatagagacgcttttatataggcacgcacatcttaatatatttgatattaatgctttcatctgggctcgaacacaacacctgcaggttacaaagttcatgcactaaccaagtcattaacgtgacaatcttgaaggtaaatagatagttttttttatattgcaactctgcaaacatgcgtcctgtagcagttctcttcttttttaatctaagactgaatattaaatatttattttttttggtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatgtcctcaactaataaagcgtctcaaacatcgtccctattttaatttcatttataaaaaagagacgacttatagaatgacttaagtgaaacgtcttaaaacaatggttttgttgtagtgcctccccctccatccctgagctcaggtcatcgccgcctccatccacaagtgcacaccatcgagccatagtcattgcccccctctggtccgagcgtctaccgctgtctcttcatctcctccgcaaccgcgccagtcaccgcctcaaggacaagcatgacaagcatggtggaaggcgactcaccaccatggcaatggcactaagatccattgcttgcaagttctttttcacccaagtacttttgcatgtagttcacttgctgcttcatgtagttcatgttgttcacattgttgccgcagtgatgattccaatccctgtggttctatttgattgtggtgattgagattcaaggttttgttttttaattgggacaaatgcgatggggacgagagggattgtgatgatttttgtgatttgtgaatgcctaatgtgatctgtgatatcctgaatgagtgtgatagcatcctaggtggatgatattttcttttcccattttccacactagtgatgggtccttactataacctattatagataaaggtaccagtaacaggttaaaatatatagccgttagaaatgactctcacatatgacgggttttggttggggcccgttaaaggtaactcctaagtccgagagatcttcacctataacaggtgactcagtcatgactaaccactaatctcttactagggctaagcatgtcagaggtgatgatatgagcccaatggtgacctgacctgttgcatgtgtgcttgttttcacacccaactaggagcgttattcttagtagaactaccattatactctatccattagagaatatttgttcaattgaaaaactcatgtacgagagaatgctaaagactgcatattgtcttacatcctcttgggcctcctagttaatgcatttgcttgggcttgttgtgtggattagttaaatattatggttctgtgattgctcgtgtgatggatcgtagttcaggacgctttgggtcgttctcaccctcaccacttggtttacgccagtgctcctttcttacacttgctttaaacctactatcgtggagatcgggccaccccttgtgagtgagttcgtgttgtcttttgacaggtctactggttgcgatatagccatgtggaccatcttcttttgagggctatcgtgagtaactcattctggatagggtggaatgggaatctcaccaataggctgcacatacttgtgtcaaaatgacttttttgttaggcccgtatgtgggccagtttgatgaaattcgatcggtcacctcgtagaatttcaacatcgtcttttctcccagtaccagtaactggattagccctgccagctaaaaactgtatggaataaatgaaatacagtcagaaaaatggctcctaatgtgtcaacgataggaaatttccatcataactagctcgtcggagaaaaggaaatttgcctggtgcgtacacgtcaaggaaataattgtcctgacgtggaatggacagtctgcgatagttgcatatcactgataggtttggcggtcagagatattggaatatttttttatgggtacgaccatcaggaaaataagacaccacacctcgctagatagctgtatccatgtcactaaaagcagcggtcgtcagggcaaatctagtttctgatactgtgatcaggtgcatggtccatatcaatgtgcgtaatgcagtttaatttgaagatcgatcaatttttatgcttgcatgtgtgagagaaaacgaacatgtaagccattaaaatatctcagggtaacaatatataacgtgttttacatattacaatctctgaaaaagtaatcaacttacaacaatcaaattaaagtgattcatgtggatgataaaacaaccgcatatcaatctgcaaaacagacaggagacttattcacgaggaatcgtacaaacggccacaataaccaacaaccacaccaaattaaactctggaacattataactgtgtagcttagcaggtgaaatcggacgggcatgtcttgccacacttgttaaggatgaggctgaggtcgactggtaggttgaccctaataccaagtacgttggccttcacggcggtgcagaggcagacggcagcgtcgatatcggcgatccctgatagcagcgagcagcagtcgtcggggccgtgcccgatctccacatcgaccagccccttgagcacgttggcgcacactctcagcttcaaagcgtccatcgggcaacggccatgcccaccgttcttgccatgatgcgtgggcgtcgggacaacctgctcgccggggcagttgggtgtgcaaccgttagctatgacagcaaggaggaggaggctaagggcaatgaagggagcgaccaccttggaagccattgatctgagatcgagtgagctgctagtagttagtgattgcactcaagttgccttggacaatttgcttgggctgtttggacgcgcgcctgctagttataggtgagacagtatagttgcttagcttggtataggtagttgcatgcatgatgcatgtgcgatagtttgcttggttttcctggatggaattgcatgcattagcatgctagctgcataggccagttgttcagagttgacaagataatttcttaattccaacgttgaattgggtcatgcagagcaccaatcaacaaatcttgcccggttcacaagttgtccattttacgcgatatcacaatttctcaaccaattagtattgttttttcagtgttttctggatcctcagagtttaatctccattggttatatactcacacactacgaggacgttttggaacgatttatataattttatactccctcagtcatgcatgcaagcgtgtgcgacgagttgatcagctggctggaaaatttatacataatgcatgcaagtcatgaccgatctgaactgtttactctgagcaaatctgacgtctgaaagggagaaatgagaacaagctgccagatagctggaactccccaccgcggcattagacaaacatggcaagcgagcaatatgattttatctccatgttataatgcgctgagcatgcctttgaatcaaaggatttatgtaaggaatttcataagattcaaatcctataggaaaattttctatttggcacattgattcaaaggattaaaactttccaaatcatatgaaattcctatggaatgacacattgcatgtatattttggaggaaacttagcaagaggtctaacctcttgaaaatttcctttgagtctatctctcttatccgattcctgtgtttttcctatggtccaatcaaacgatcattcctgtgttttttcctatgttttgcaatcatctattttatactttaattcatgtcagaatcatgtatttttcctatttctctactttttttaaccctgggattcaaaagggccctaatgatgagacatagtcctgatctttcgatagatactgataagtcgtttgtggagaactcatcattgatgtaggatcgaacaacaagaactaaggtcctgtttgtttcagcttaggattattataatctggattattaagagtaagctgaaacaaacaagtagattattatgatagattattataatctataagccatattactataatctaataatctcctctggaggagcttttttcagattattgggtggctaaagaccaactaccattagatgccttcaataatccagagaaacaaatagctcacagcttattctatgtcagcttattataatccaacttagagtaatctgatttaataatctagattacaataatcttaagctgaaacaaacggggcctaagccaaccataagagggtgaatagttgtagtacccaaaaccaaaacttttagtggaattaaagataccctcgaatccaatgtagatcggtctgaccggggttaatccgccgtgcctatgctgctggtctaaccggtgttgatcgcccggtctaaccgccctacaattgcctctacctcctgtcgccgccgtcggtctgaccaccgtatacctaccggtttgaccggtgcgatgccatcggtctgaccaccggtgtcccgccggttggaccgtcgaacccgagcaaacacaaatcaaagatctcacaaagtagattgaaactttattacttctctctatgtttacaaagtgcaacaacagcactcctcacgaaaatattgactaaacatgaaacccaaacttttctctcaactcaactctctctaaaacgatatcgggaggccgcaccctctctctctatttatacccaaacttgtacaagaagtcctaatcccctaggaaaccttcccgtaaaagaaacaaactttacaaactccaattgtaccaaatttggactccctccaaattcgactccgtatcccatactcacacaatatctccatcgtatgacaaatggaatcttcaccaaccacgtgcattaatatttagcctaagcatcccgcacgatatcctgatcgtccggacgtcatattctcataaattgactcccgatccatcaccggcaacactctcccaaggcatgaagaccacctacacatgcatcaaccaagaaaccatatccgagcacaagttctcaccaacttgactcattgttaataaacaacaatactacatacacatagtatccatatagaagtcataaacatgaattatctacggatatccaacaaatcaacccgaatccgaaaccgacatagagttggccagtcagaccacgtgctggccgatctgaccacacgatacatgccggtctgaccggcaaccactacccggtctgaccggacccgctcaatcagtagtctttgttcatcacctgcaaatccaatcatctccaaaaccactttgccaataatctccaaatatcaaaaccaataatctcatatgccaattattcatcacaaaataagcattagcagggtcctttatgtatacaaagtttcgttagaatcaccgctatttagttcgatcttttttaccttgtactccctccgtcccaaaatataagaacgtaggatcggataggacatttcctagtagtacgaatttggacagacatctggtcctagattcttatacttcgggacggagggagtatttttttttcaatgcttttcattagttaaatgacatgtaagaaaatgagtaaacattccctccgtgggaaaaaaatccatatcctcttttaatgggcctatatatatatatgtccttttcctttggcgtcgttagtgtctatgatttctcttttgccctccttctataccaaatctaggtaattcatttggccattttcattcttagtggaaaatataaaacatttataaggcacaccttttgggtttagcctatgatataattacgaagtccaatacctaaaaactgactttgacgtggtttgtttagaaaattccaaacagcttaggaggaagaccgaagtgttcttcttaatcagcagctaagtctgtttgaagttaatgttgttaggagacccgaatctgactccaaaccatgtatctcttgccttctatggctcaataatggcatggtggtgttggagtagacttgaggaaggccgtgatttggtccccaaccaacttcactgatcataaatgtaaatgtattccatgaagacgctccccatttcttcacccatgcaagggtttcttcaaatgacaaaacataaaattcatggtgtacatagtatgttttgttcgaatattgtcagcgttctggatattggataccctatatatagtatttacctcgcaagaccactgtagaccaagtccaatacagaaacaaacctagataaagtctggaatagataaggaaggattcctagataataaatgaaatacataggcctacttgcgctgcttggactactcggatcatacttttttccctagttctacttggacaaacgggcaactgagggtataaataccaggcacgtaagtgaggagtaggacaagtcaaaacccatgagagaaactaagacaacatataacacctccgatctcgtcgagtcaacacccaaagaagtcgataacaactagtcgccaaccactatgcccaagctctgcaccgatatactagcatactagattaggttttttttcctcctcattattctcatgaggatgatatatataatacactagctccggtcaccaaaagttgggctattacccatcttggtgtgctggatcagtataaaaatccttgttgccttgcgttccattatctaaactaaattggatagagaattttgcatcataattagggttccaaagaatgatttatttgagaccgtcgcacaagatcatagatacacgcacagaaccagaaaaattttgacactagggtattattttgtaaaatagtttttgacaactaagctaaaacctggtgttacaaactcattaatattgtttttaaaaaaaatagacaataaggttctataaatatcatagtatttattgggttgtcttttcgttttttttcctcaataacaccgaatttcatggcagaaaactaatgtgataacgagcgggtagtaattaaggtcgtttttttttaaaaaaaagaactttaaggatgttctaacaaaatatcggctcattctgtctcgacgatgttcacagctaggggtggagatagtcactacaaaaccgtttttactcctagttgggaacccctatagtcccgattttccaaccggtgttgaaattattaacacataataatttaatttattccataaataaatcatgacattgcatatgtaaactagcatgaacatatcataagatctacatatgtaaactagatagtatagcataaacagatcaaatatgcgtaacatagtgagcacgtaccaagggtaccggaagaccagttgcacagcaggaattactcgcggttgcgggcgttgacaaaggcgtgcatcacgcgagcaaacagaaagacgagccgtcgtgaacgaatagggagcagtcgtgcgaagcgcttcccaaaaaccttattgccgccttctcccggtgcaggacgtggaaggcagaggttccggagacatgctatcccgatcgccgctgcatgccggcgagcggaatggagtagtctacaagcgacggcgcagtacagagtaggaggcaaaccctagattgatttcacgtgtgttgcgtggaggcggcggctcggtttatatagagaaaggtcgcttgatctccactccgcgtaaccgaaccggataagtcacgcgtaacttattcgaactccacgccgttttcacgcaacggatttttctaaatttcccgcagcaaaacaaaactgcaaaagaaggccgcatctgcgcaagggtgaggaaccaattttgtggaccattcgacgcgtacgttgtgccgcccgccccgccaggcgaggcgagcgagcacgcgtgtattccccctgttctctccacctcacatgcttcaagtggctaggagggcatcctcccttttaaggaggtcctcctctcctagaataagcaaggtgatactaaactcccatgcatgccatcccatgaggtgggcttttgtgattttcaaaataattaatcttcgagtgggataaggcccatctattaattccaacaaccgggactacgaatctgggactaaaaatgcgcatcttcagtccggggtgaaataaccgggagtaaagttcaatctttagtcccggttggtgttaccaaccgggactaaagagagcataggcagtccccgtcggtccccatttctttttttttcattgtttctttgctaattgaaagagttaatccctttattttctcccaaatcgagtgccatgcatatcctcaaagcaaaccccaaatccccaaatcaaagtaatatcccaaatcattcacatcacaaatccaaagttactttatacacataaatcaaatacatcacaaatcctaaaaaaattacacacaaatcaaatacatctaagatccatgcaatgaatcacaagttgtacaaaaaaagaaattatacatctcagggaatcacaaattatcaaaaaaaaaaagaatggacgctgtcggctgccatggccgccgcttgcggccccgtcgccgccgccgggcatgaccccgcttgccgccactcgccacacctgaccgcggccccacctgcccgccgctgccgatcgccggatgggaggggaggagggggaggagaagggaggaggaatgggaggaggggggaggaggaggaaggggatctgaggggttaggagcagagggggtgagatcgatccaatcttatctaaatatctcggtgaggaagaaagcccgtctgggacttaaccgatcagagatgggagagaaatatttactcccggttggtaacttcaaccgggactaaagatagatttttagtcctggttggtattactaactggaaataaagatctaaatgatctttactctcggttggtactaccagccaggactaaagtggtaatctttagtcccggttagtagtatcaaccaggattaaagatcctcagccccctgacacaagcctctgacaggggatgaaccggtacttaaaaaaaaaaaatttaaccgggactaaaaacaatatttagccccggttctttttagaaccggaaatattgtggaaatcagccgacccagcaaagatcatttctccagtagtgagtgtatattaatttggggggtgcccaggaacccggtcaagaaattttttagctatacccttaactattttcatcatgtatgcacccctcaatacaaatttaggcacccgcatcatcttaaactcgatctaaagtagagtaaattaagcaagtggcaccaccctctatttcgctctatctccacctcacagcagccccaaatgctgtatatacaaaggcggaaggggttactatactgttgtattggctacaattaattatcttaattcactacaccgaatcgttaagttatctctattctattaatttcaaatcaagtacgtattcatcccgtcccgtgcatgtattgacaaatgataaatcgtgtgctgaaaagcggcggaggcgcgggaggtaggcaccggcgccgcctcctctcgccaatcgatcgacgtacggcggccattcaccataaaatgattacacatgccgtactctagctacttgacacttcacctacccagggcaacgatgccgaatgggttgtccacttaatgcgcctaggctcattttcgtgatgggcctaggttcgtggaaattagggctgccagatgaatgtatttcaatttatgcatccatatttcgtactccctgggctccgttaaaaaaaacaacttttgtatatatctggattcatatatatagaagttggcattttttttgacgaaataaaagtactagtaacatatactaactaatagatataaaaagatatcgtaaatatatgcattttatgccacctatatattagttttcaaattcaatttcattgtgtttcagcagaaatcaacagggaaaaaataatatgatagttttaaaagtacaattttgctagatttttctctttttaggccagccatatctaatactccctccggttctatattaattgacgttttagacaaggttaaaatcaaagttttataactttgaccatcaataactttaaaaatatttagtttaaagaaactaaaacaatatatatagatttgtcttttaaagcactataataaaagtaaatatgcatttatttattatatatattatagtagaaaaataaggtcaaagagatatcttgtagaccatgtcattgttcaaaacgtcaattaaaatagaaccggagggagtaatgtgtcagtataacttattaggtatacctattgtacttggattcgtatctaccataatatactgcaaatccaatattatatggaaaatcatattaaaatagcctatcaacataatgaatctaagaggaatttttatagaagcttacacttacaagtaaaattatttttattttattactattattgtgacatttattagttagcacgtgtgataaatgtatcttaaacttgtgtacaaataatatttttgccggtaattatcgataagttctatctcaccatgatatagatacagccatacatataagtcgtgctttcctatgcgggcatggaaaacaaagaaattatatcaacgtgtgagccatgataatatgaatagactaaatttcacggaactacatatattttaatcaaattatcgtaaaactagatatttaagacgtggtatgataaactacaggtttagtgattaatttagtttttttttaaaaaataaatattcaagactaaatattatgaaattacatacttaatattgaagtgatcacaaactatatattctaaattttaaattcgtaccactatcttcacgcgttaaagctatcaacattctagttttgtgataaattggtacaaaaattataattttgtgataaattttctatttaatctttatttatgtgacacttcattctaaatctgtagttttgtgagaaatttcaagctaattaagtctgtagtagttttgcgatcctttaattaaatatatgtaattttgtgagatttactgataaaaacgatctaatatatataagatgggtattacaagttagaataaccaggtggtcaaggacggtagaactggacatacatcgatcgagtactgcctgcaaacagacgcgagacgcttattcaactcaacagcgtcaacagacagacattgcacgaaactaaactcgtcttattgagacacataaactctagtgaatattgttgcagctcaaataattagcaggtgaaaccggacgggtagttcttgccgcacttgttgaggatgatgctgaggtcgacgggcaggttgaggttgatgaggccgagcacgttagccttcagagcggtgcagaggcagacggcggcgtcgaggtcggcgataccggccagcagcgggcagcaatcgtctgggccgcgcccaatcttcacaccgatcagcccgttgagcaggttggcgcacaccctcagcttcagggcgtcgatcgggcagcggccgtgatcgtcgtgcgacggcggcgtcggggcaactggcttgccggtgcagttagttactgcacacccgaagaacaggatcaggagggtcagggcaagaaggggagcgatcttgttggaagccattgctcaagtggtgaagtgatctagctaagctagtaatggtgctagctagtggagtagacagtgcttcagcttgtgttggcgtgtgatggttatttatagatgattgctactccctctgtgttccatttttatacactacttaaaaaaaccctgataggtacctgctcatatatgccgatttatttaaaactgacacctattgaccatttctcaccttcacatgaggaaaaaatatgtaaccggcacttttgacaattataggtgtcaattctaaataaaaactggcacccggattttttcaaatacctataatatattatagataccagttcttcgaaaaccggcagttgaaaaaaattgagccgaaccgagccaccaattaactcccaccaaagtcatcatgcatccactccattcatatccgatccgcttgtgctctctctctctctctttctgtctcgcacttgtcctctcctccctctgcaacgtcctctcttccctctgcgccactgctctgtcgcctctagcaccacatccattgccactgccaatcgctacatccggcgccgccgcccattgtgccaccaggtctggcggcgatggcattggcatgcagagggcaatcgccggcgacctcggcaaggagagagaccttggcaaccggcaacagctacctccacaccgctcctccgatggcgacacatattgccaacgatggcgggaccggggagagtaagttcatcttgcttgtgtagttcttgatcttgtgttgttgttgatctgtaatctgtgataattgttgttgttgatatgtgatatgtgaaggatgggatgaggatttttgtagttgatatgtaatggatgggattaggggcagcttgaaagaatcgactcatcgagccgagccgatgcttggagctagcttctcttttcatttttttttcttttttgaatcggaaagagcacaaaggaaccggtaccaatgacctagtgtcattggtgccggataattggtcttggctatgaaaccaacacgtatgccaggtttgcaaccagcacctttaaggtgttatgctgtagtaatatgatgaactcaccaacgtcataaatttagggatagaggtaatataaattatatgtcgttttgacttttttaaagttattaattttttgttgaaagcttgatcaactttatataaaaataaagcaacacttatagcaccaaattagtctcattatatttaacattgaatatattttggtttcttttttattttgggttgaacttgatattctttatgaacttgatcaaacctaacaaaatttaactcaggaaaaaaaatcaaaactacttatactataatatactagtaatatggttgtgctaaaccctatggtacaattctatttgtctttaataatttttaaaacttcatgctagcaaaaaaaattttacatgacagggtgtcatagacataatgacggaatccttatatgacaagtgtgttgatgagcacggttttgtggactttgctcgaagtggcgggatgagcaatcaaaagcaatcaaagaaatttctccgcgccttaaacgagcagtgtgacttgtagaaaaaggattgcttttcaatgaatgtatgtgtcatggcaattatgcttcaaatgtcttttttgttgaagagttcttgtctcagttgtcacattatgcaaaatcacaccaggcaaataaattaaaatggaaaaatggacacaattcttattctgctctattgaagaaaatgttcctttgctacttcttgagcatttttgttcttttggtatgtggttgtcaagtgatagaagatatgcagttttcctgatttgtttacggtatatttagtcacaaacaaagcattgtaattagtaggttcttttttccttttacttttttctttttgtgttctttgatcgttccatcatgttctatcccttacctactggattaagatggatgaaacatttgattttttttctcgaatgtatgtgttgacaaaaatccaggaagaactccacaatctaacatgtctctaagtgtaaactggcatcaaagatagttaactaatgtaaattggacatgagcaaaaataactttatcacaatgataatcgagcataaaaaagggataattgctcatttgacgctctttttaagcataataactaccaaactaaccatatattttcaagtttgcttagttgaccctgttttctcaaatcgtattttccgtttgaccctgttttaactctaccgttagggtttcatatagaaaacagagaaaaaaatatttttaccaccccaaataaccaaaatacccttattacactcaaccatatccccaagcccccatccttatccagtcccaacccaaatcttggcaactatggcgtgcagcaccggagctcgccggcatgcagaggctggaggtcgggtggcggcggcgtacgcatgaagggagatggagcccagcatgtggagggcaggcggtgatagcgcgcgcgcggagggagggagcggcacaagcacggagggaggcggacgccggcacgtggacggctagtggtgacggcgtgcgtgcggaggaagggagagacgccctgtgtggcgagaacgactgacggcagaggggcgtgggcggagggaggcggaggccagcgcgtggatggcgggcagtgacagcatgcgcgcggaggaagggagcggtgccctgtgcggcatgggagctcgccggcgtgtgaagtctgggtagatagaaactaggtcaaatgagaagggtataaacgtctctttttccttttattaacaccgtttgcttggcttcacgaaatagggtcacatctgatgttcccttttagaaaatagggtcaaatgagtaaacttaaaaagtagggttaaattggtagttacgctttaaaatagagtcaaatgtgcaattgcctaaaaaaccacaatcaatgatataatcaacatataaagacggagaaaactagcaaacacaagggaggagcgagcgcaatattaatatatatccagattaagggaacaaaactcttaatagtactgttaaccaaagcaacagctgagaaggaacaattctcgattataaagcttgagttaccacggggattcccaacatagctaggatctttcctactcaaaacattcagagccttgacagtctagtccaaccttttgcctatcaaaagtaatctaagacctctgcttcttcttctccttgaagagtgcgagcagtgacactgcagacaccttcacaaccttcaacctgacacctggaatatctcccaaggcatgccctttccaaccgaatccaacaatcagcacctcatcctagagtatccaagatatcagaaaatccttgaaataccatcggcgagtacactaatcccagaaataccatcgacaagagcaactttctgaaaataccatcgtacaagcctttttctcccaaaaatgccatcaccgtcaacttaccgttgattccacaccgctacaaccattttttttcaaaaaatgaccagattgccctcagtccaaaatatacccctcccattctcccaattcacggtaaaagaaagaaaaagaaatgaaaaaaatgtcaccacccttcttgtcgaaacaagattttggcaatactaaaaaggggtggctatcaagctggaaaagtggatgggtttagagacaagaaattttatacaggttcaggccttcttaataagaagtaataccctacttctgttcgaggattgatccgccgagtgttttattgattgtatgatctgagagaaaaatcgtgccccaaaagacacccggacacctccttatatagggaaaggggtccgtattacaaagtacaacccatatccctaacggaataggtagttacagataagatacaatcgtaaccgactaggatcccgggtatttccttgacatagaagtttggaatttaacccgattccctttgaagatattctatctatacatggcaccccatacctaatcggatatacatgtcgtatgggtatggggtatccataatctccacagtagcccctgacacctttacagtcgatgaaatagtcttctctcgtaattcaaatgataatccgagtgcttcaacttcctctgtcttagtcttctgagtagatgcatctaattaggtgtagcccccgactatgtgattagttaaataaaaactaaacatatagtcaaagtgcatcaaaacatccatccgagtggttttacaaccgaatcacccaagggattatatggctaagcatgtgtggcatctgataaaacatccagccgactgctttagctttaatgcgccaaaaatgaggtatagaaaaggcccgagtgagaaacactctaaaggtctataaaccaacatacatgataaaaatccgagtaaaaactctcaaaaagactcatcaaatgtggtataaagcatgataaatgatgagtctaaatagcctaagctatgacccacgccattattaaggtaagcatataacatgctgagagaatgaccatttaaaattagtcatctcaataaggcccgaacagctttgtagcctaaaaaggccaacaaaattagtataacacttttctgttgggcacccttttatttgcattgtagtaattccaaagaattatctaactacgtcaaaaaggattttagcagcattgggctattctgtcgtgagcaacttttgccaaagcaaaaatatatacctaagtccctaaggatcacaaccagccacgctgataataaaattgggctgaaagtattgtttaggcccaggcccataagcatctcccgataccttagtgaaataaacgctaaaatagagcgccgtttcgtcttccccgccgcgatcctctccattttccccacttcccgctacaatgcaaatactgcgccggcggaaactagggttcgcaaatccgcaccattccacccctctcgaagctccgttctcttgcatagatcttccgtacatccatcgcaccaatatcctcttcattcgctgccgccctcgctccaaatctaatcatccatctcgctcccatggccgaggagagagaaagcttcgaaagtcaatgggctccctccgatgtaacggatgagaacttgaaggagatggtagcacatggcgttcttccggcaaaggagatcatcgggtggcgtccggcatgcggcgaagcatttctgacccctgacacacacgaggtcgtggtattttctcacttcttatatggtggttttcctctcccaacctcaaagttctttagggggattgtggagttttacggaattagcttgcatcacctaaaccccaattccatagttcacattgccaatttcatccatgtctgcgaagcttttctagggattaggccacattttgccttattccgccgcatcttcttcctgaagccccagccaaacaagaacaagccgtgcgtcgttggtagggggaccggttttcagttaaggggaaccttaagccagaaatacttctccatgcccttcaaaacctcaaacaagggctggcatgcaaactggttttatgtgcaaaatcctgagctagcactccccgagtactcctgccttcctccaacatatcaagacacccggaactcgcttccaatgggagatgaggctgcccaagcactttctttgatggaacgcatgttgaaacttaaagagcagggtctgcaaggggaacaaatcacccggcatttcatcaagagccggctggcacctatcaaagagagatctcgcactgcctttgagtttgatggcaagaatgaccccaaccgtgaagatccagaatctcttgagtttaaaatcatgaaggagagaatgtacaaaatcttctcaaacgctatcgcggttagctgttcacacctgctgccagtggtgccatataatgctttcaaccctcctccaccggtatgtatcagacatctcggcctttcttatgacatccttttgtcttttgtaaggttggctgaaaacttgaaatatcatgcataggaattttctttaatgaaatctgatcctccaatcgctcaacgccgctcaccccgccggcaggctggtcaggccagtggagggccgaaaatccggtctgatgctcagccaagcatctcaaagccaactaaccagtcggactctcgcaaaaggaaattaattctgagtgacgacgagggtgacaatgttgaaaaagctggcaacaaagaggtgactggaaaacagccaaggcaagctaacccgaagaagaaaacatccagtcgtccaataccaaaaatcaggaagtcatccaggtacaagtcattaagcaatttcccctgtatcgccaaacatacaccatcgaagtagtgttaatagcatatctcaaatctgcaggaagccatctgacatcgatccttctaggaaagactaaaccgactagcatggagactggtcctacgacctccacagaaaccgggccgaccgccgaaaatcgcctgactagtagtcaaccagcgaccgataatatagaggccagcaatgagcccctgactggaaaccagtcggccgaagctgaagccagtgctgatcaggtgcccccgactggaaaccagtcgggtacagaacaaaatgaggacatcccggaaacagaggctcgagcaagcagccttccctaaaaagataccaacaccgacccgaagtccagttcatccgataaggtgcaagggccttctcgtcctcaaccaaagatcataacaggtaatcagctcttccaaattcattttgatttgacaaattctcttcgattgttttatcatcatcatctgtgaatacgtaaaggcccaatgatcggtgacgaagaagttcttcggatttagtcagctgaagattctcgccaacccatcttagttaaatggtgggatgatgaaatgcagccacaagggattataataaataagtagaaagaagacgaggaagtgtctttgcttgcaaagacgctcaattaggccactcgtctcgtaaatgtatgttttttgcacatagctttactcatcctgttggccacttcactgaatagagatgaatttgcaatgcacagaattcatcttaggaatgaagcaaaaactgcaaccctcgagaaactggttcctcaccatggaaccctggaagagacaaga

SEQ ID NO: 8001 - DNA, 20186 bp, Oryza sativa
tgtcgacatgagtaccgtcttcacgcttgagtcgataagaacctggccgagtaactttagaaattatgaacggtccctcccataatggagataacttgtgccgatctcgtgtagtttgaattttcctcaaaacctggtctccgactaagaaaacccgcgatcaaacattgcggttgtgacaacgtcgcaacccttgtaaataccgagccgactgaattaaggctgccccacgggcttcttccagtcggttgagatcgtcaactcggtcttctccgtagcgctcctccttgaagttgcaaaatcgcaaagattcgaactctacctcgcttggcaacattgcttccgcaccatagaccagaaaaaacggtgactgacccgtggcccgactgggcgtagtatgcagagaccaaagtacggatggcagctgatctacccatttgccagcatagggatgcagtcggtcgaaaactcacgctttgattccttgaagtaccataccattggcacgttcgacttatccattgcttataggatgcgctacggaggcatagcaaattttgatgccgaagtcttcacaaaaatctttaaacacatcgccagtgaattgagtaccattatcggtaatgattcgattgggtaccccgaaccggtgcacgatgttgatgaaaaaatctctagccttgtccgctgtaatcgtgacgactagtttggcttcaatccactttgagaacttgtcaatagctacaaaaagataagtgaaaccaccagtagcccttttgaatgggccgaccatgtcgagcccccaaaccgcgaacggccaggataacgggatggtttgcaactcctgagatggtaaatgagtctgtcgggcaaaaaattgacaaccttcacatgttcgcacaatttaatcggcgtcggatacagtagtaggccagaaaaaaccctgccgataagccttgccaacaatggttcgtgcgacagcgtgattgccacagatgcccgagtgtatatcttttagcaattgccttccctcctccaaagacatagcattgcagaatccctgatggacttttcttgtacagctcggtctcatgtatgacataaagcatgctgcgcctggagatccgctccgcctcgtctttatcctgagggagttcttggtcaaaaacttgatgaggggctctctccagtcggcttcgatcatgcttacttcttgagtgtccacagcctcggttatttcctttcttggtatggtcggttcataaagatgttcaacaaacacatcagaagaagctgtttctcgtttcgaaccgaaattggccagtctgtcggctgcctcattgttatttcgaagaacatgggttagatcgaggccatcaaacttatcttctaacttgcgtacctcctgccgataagcagccatattatcatcgaggcaggaccactctttcatgacttgattaacaaccaactgagaatctccacaaactatcagacgccggatctccaaagatattgcgatccttaatacatgaagaagcgcctcatattctgccacattatgggacgtagaaaaatgtatccacaatacgtagctcagcctttctcaagtcggggaaatcaggacaactcctgctccggtgcctgaaagcctctttgacccgtcaaaatgcatagtccaatactccatcttttctataggcatgtcttcttggcactcagtccactcagcgataaaatctgctaaggcttgggacttgatcgaaattcgcggcttgaaggatagatccaaagacatcaactctaaagcccactttgcaatccgtccatttgcctcgcgattatgaagtatgtccccgagtagaaacgatgtgaccaccgtgaccgagtgaccttgaaaatagtgagataatttcctaacggtaattaaaacaccatataccaacttttgcacctgaggatatcttgtcttggagtcggctaaaaccttgctgacgaaataaattggtcgttggactttttcaacatggccatcttcttcacgctcgacaaccaggaccgtgctcacaacctgagatgttgccgacacatataacaacaatggctcttgcggatgtggtgaagttaagaccggtggagtggtgagaagtttcttgaggtcttcaaaggctttttgcacttcgggtccccactggaaattgtcggttttctttagcaacttgaaaaatggcatcctccgctcgccgagtcgtgagacaaaccggctgagcaccgccatgcatccagttagcttttgaacgtctttctgggaactcggcggtttcatgttgagaatggcgttgatcttctacgggttggcctgtatgcccctatgggatatcataaagccaagcaacttccctgacggtactccgaagatgcacttttcaggattaaacttcatcctgaaggcgcggatgcttgcaaaggtctcttctagatccgcgatcaaatcagccttctacttggtcttgacaactacgtcatcaacataagcttcaacgttgcgaccaatctgagttgaaaaatatctctggatcatgcgttggtaagttgctcccgcgttcttcaatccaaaaggcatggtgatgtagcactaagccccgaacggtgtgatgaatgaagtcttcaagtagtcggactcttttaatcggatctgatgataccctgagtagcaatccaggaaactgagtagctcgcagccggccgttgagtcaactacctggtcaatgcgaggtaacccgaagggatctttgggacaagatttgttgaggtcggtgtaatcaacacacatacgccattgcactgtcctcttccgaaccaggaccgggtttgccagccagtcgggatgtaggacttccttgatgaagcctgctgctaacagcttggtcaattcctccgtgatcgcatccttcctatcctgtgcaaaacggcggagtcgttgcttaatgggtttagcgtcttccttaatatgtaaagagtgctcaataacctctttaggaataccaggcatatcagatggtttccacgcaaagatatctttattattttgaagaaaggtgatgagcgcgctttcctatttacaatctaactcagcgcttattacagcagtcttagtgggatcagagggatctagaggaattttcttagtcttggcatcgccttctccgctctttgatatcttggatgcatgtcacaccctaaaaatcttaaatatataaattgttgtttaattggaattattagaattgattttaaaagcctagaagagaagatctaattttaaataataaattccaatataaaattgggccagataaaattttattaaaaattttgcttgattctatattccttgattttctgggatttatttgagccaaggaagtatttttaataaatggaattgaatttcatgaataatttaaattggaaaagttttaaaaagtcttcttttggctttgggccgaaagtcggcccaaatctctctctccctccctcggcccaagccgggcccgcaagcgagccgccgctcacgcgtgcgcgcgcatccgcccgctgacaggtggggcccaccagtcagggccgtcgtcaacctccagccgtcgcccgactgaaccctagccgagccgcgccaccgtctccttccaaattcgttcatccctttcccgatccggtgaaattgatagagggaaaatgatccccgagatccactctaccttttctcttttggaatcgtcggctaacatcgtttggaaattggtagattcgatctcgaatcggattcgtctctctccccgaaccctagactttccttcgggccgccggccgccgtgggccttcgccgccgccccctagccgctataaaaggaccctcgatgtctcctctctccgccgccaccctcgctttcgtctctcaccgccggtagagctctagcgccatgtagcctagcgccaccgtcaccgccgttcgtccagccgtgcgccaccgtcgctccggtcgtcgtcgtcgctcgggaaagccgccgtcgtgatcatcaagtcgtcgctgacctcgtccgcccctccgttgtcgctgtagatcgccggagccccgccgtcgtcgtcgagccgaaggtcgccgccgcttcttcctcatcgctgtcgccgtccgttgaccatctgctgccgttttggtcaccggtgagttcgccgcgtcgcccgcaacccgtaggtgccgtccgttcgcgccgccgtgccgtcatttgccggtgagcacgcgaggccgagccaccaccggtgatggcgtcaccgttgacgtcatcgatgccgtccgccatagacccgcggtagatcaagatgatctcggtcgttcattttggataggatcaatcccggccgttcgtttccgtgagtcaccgccgtgcacccggtccaccgtgaaccctagccgctgacgcaataatccccttttcctgttcaaaaataattcaatattgcgtcataattcaattaaaatctatataaatgatttaatccgattaaatctttgaaaattcataactaattcatcttagctcggatttagttggttcaagtctctaaatttttctaaaattgagatctacatgttaaaaatatccacatgtactgctcatgcttgtttatgtgctatttgggtgattttgttcttttctctttagattccgacgttcccggagagtccgaatttgcaggagaagactttgaagagttccaaggccagcaaggcaagtcacacagatcccaaacgatcctttgagcatgttgatcccgtttaaagctattgtttctattcaactattgcatttatttttgaatgtcattgggtggaaataacctattgttttgttatggcccttttgtccttgattactctattccttgataccttgggttattataattttactagttgagctttatatgttggttcagctagatattagacagaattgcttagccatgcttagagacactagctcatataaatgggataacttatgattcactattatttaatgatggcttaatgatagctcacgatggttgatcgtgattggttaattaatcaatttgccaaccaaaacctgataatggtgggttgtgagcatatggttttgatggttgtgctcatgacaattaaggaccggttcacgattttcggttgtgaaacatttaccgtgccaaccacaagccagcgttggcaacggctttactttctgtatagtatggttcatagtagagcaccagactgtgaagtggcggagataagcccacgggggtcgctggggagtccatgccttgtttaagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctttggccagagtttaaactattcgaatagtcgtgcccgcggttatgggcgggtctaacaatgtctttcgtgattagtctcacatttctcaccatattaatgttaataacttggttagctcctggtttggaatggttaattcctggtttggagttagaactgtgcagccggggttggttgttcagaatggttgggcctacgcaacagggtatgttgcatagcgttggattaatattgtttaattattatttaactgttttattaaattctgaaatatttgttaaatgctatttatgcaaatgagactatattatgccatcctttgctatcccgtgcacttgcatatttgctacgtggcttgctgaatatgtcatatactcaccttgcaatcattcatcagaggaggagttctacagtgatgctgttggtgtggatgattaggagtagccctggtcaagctgcctgtggagaggagtcgcctgcgctgtttcttttattttccgcttcttagaactttattgattgagaggaactatctacctctgtaatgacattttgttcgcttattaattagagtaataattgtactgtattatcaatttgttattgtgtgcctcggctgattcctggacgagggtttacatacatgtaagcgtttggaattttggatagaaattccgggcgtgacattgcaggcacttctccttcggttgctgttgatgcagccagtcggatctcctctcgagcgagcgtgatctcgcgagtctgggccatctcgcagctttccttgtcgcaggtgacggtttgcttgatgtcactccgcagggatatgactcctcgaggacctggcatcttcatcatcctgtagatatagtgtgggacaaccatgaacttggctaacgccgggcgtccgagtatagcgtggtacgctgtctcaaagtcagcaacttcaaagcaaatgttctctgtgcgaaagttctcccgagtgccgaaggtaaccagcaaagtgatctggccgagtggagtagaagatagcccggggatgaatctgtgaaagggcgcactactcggcttcagttctgtccgagggatctgcatgtcgtctagagtcttggcaaaaaggatattgagtgcgctgccaccatcgatgagagatcgtcggagcttgacgttgcgaaccactgggtctagcactagggggtaccaccccgggtggaccactcggtcaggatgatccgggtggaccactcggtcaggatgatccgagcggttaaacttgataactgtctctgaccaccgaagatattggggtgtatcgggctgaacaacattgttctcccgtttggtcagcttttgctttcgcttggattcataagccaggggtccgccaaagatgtcgttgagttccttgcgggagtcttgaaaaccagtcggggcatcatcttcatcatccttcttctttgacatgctttgatctccgtcagtcagcttgcgtgcattcttggcgtattgctctgcgaactgtttctagacgaagaaatatttggccgcatgatttgaattcggacgatgcgggcattgggagttcatgatcttgtcgaaagtgttgacgtgtgagcgctgtcgggaggatggtgtagtagttgccacaagttcctcgggcttacgcttgcgatccttgtgattggcacttccactcccccctgtagtcggcgcatctttctttggcttccaggtgctgcccgactgcttggatgcaatgacaacgtcttctactttggcatactcattggctttttcaaacatctgcttgacagtcttgggaggcttgcggccaaacttgccgactagttcatggcgaatgcccttagtgaaggcggcgatgataacgtcgtcagtgatatcagagatcttgttacgttgctcagagaaacatcggatgtaatctcgaagggattctccggacttctggataatgttgtaaagatcaaactgggtaccaggacattcaaaagtgccctggaagttggcgatgaagtggtcacgaagctccgcccaggagccgatcgtgtcacggggcagcccgtgaagccaggaccggacagagtccgctagggccacggacagataattagccatggctttgctatctcctcctgctgcacgaattgcgagaccgtagactgtgagccaagactcaggatttgtcgtgtcgtcatacttctcaattccagtcggtttgaagccggccagcaaatccactcggcgtaggtcacttgtgaaggcagcaactccatccacatcgtcgtcataacgatctggtgaatggtgggggatgtggcctctcgccgcacatcactggttgatagtatcgcgatgatcgacgggacgccttcgacgtggggagcgaggttgttcgacccgacgctccctgtgtcagtcggtgtgtcagtcgggaggcgagtgaatagatcgttcaccgtgatccctgctcctaaaaggaggtggctatcaagctggagaagtggatgggtttagagacaaggaaatttatacagattcaggccttcttaataagaagtaataccctactcctatccggggattgatctgccgagggttttattgatcgtatgatctgagagaaaaatcatgccccaagaggcacccggacccctccttatatagggaaaggggtccgtattacaaagtacagcccatatccctaacggaataggtagttacagataagatacaatcgtaaccgactaggatcccgggtatttcgttgacatacaagtttggaatttaacccgagtccctttgaagatattctatctatacatggcaccccatacctagtcggatatacatgccgtatgggtatggggtatccataatctccacacttctacaaccctaaaccagattcaggcgtctcttccgcccagcgacgacggcgaggcagcactccacggtggtggtgccgctatgcctgacgcagtagttccaggaggaggcgcgggcggtacatggcggtatcggcgcggcagtcgcaaggagcagtcaggagtccgaggcaatggcgcagggtccttaggcggcggcgatggcgctggctccacaggcggcggcgcggtggtcacatgcatcggcgcgggctccacaggcagcagcgctggcttcgtaggcagcggtgcggcggtcacaggcgacgacgaggaggccgcaggcgccggcgcggaggtcgcgggctatatatgggtgattttcttcttcctcgccttcttctttagctaactcgtagcattgctgctgtttgtttgtggcttgctcttgccacgcagagattctgagattccagcaacagcggcggcgtggtgggatgtgttgttcatatgctttgcttgactttatatcatagacccgcaatattgttgcctgtatttttcctcttgttttcaagatcgacttttttagagttctgctagcctgtactgttctgagcatatagtggtgttcatatgagttcttgcctagctattttgtcattcagtttaattttggtggttcctgacattcaataaatttggacaaattttggtctacaactcgaaaatgagttcgtatatcatagtgcagatttcagttttaggaatagtaatcctaaaatttggacagtttcagttgtgtgaaaattgaaaatttcagtttaagttttaggaagaatattacctggtgcaaatattccaagaaaaaatccactctttaccaaagtactacctccgttccagtaaaaaagaaaagtactacctccatttcaggttataagactttttagcattgtccacattcatatagatattaatgaatctaggcacacatatatgtctagattcattaacatatatatgaatgtgggcaatgctagaaagtcttataatatgaaacgaaggaagtatcaggcagtagttttgccgatacattatccagccttcgcaagggcagaatggtctttacaccatgtccaatggagtagagctgacagagcagtgatggtgatggcatttctgagagaagttgattcgcacgatggcattttggaagttagattcgtcaatggcttttcttggattagaacactcgtcgatggcatttcatagattttcactttgacgtaataattcaatactcatgtggtattcctccgttagagaacatgtaagctttgaaatcagtcgagctttactgtggtctaaatcaactatgcaattctctgtagactcaagggttaattagctccttgccactacaaatataccaaattagaaaaatattactactattcacgatatcagcaacgtgtcactggaatttggggaaattggaactataccactccgttgcattttccatccacttttctatcatccccgttaattctatctgccaactacggtggctagccaacaacgactatgcagggtgctcaactgccgaaagctgtcggacaaggcgtgcgcgcacgaggcacagaatgagctcatcccgctccgtgtggtggtgcaggttctcttctttgagcatgcgcgcgcggtgttcaagattgccatgcatccgatgaagctggaggaggattgatgaggacatcccttccaacgatacaaccatgcctattgcacaacaaggaccaatgactagagctcgagctcgtgaacttaattatcaggtaaaaccattcctagctaatcatacaagttcttctcagaattgggtgctactaaatagttgttgtgatctacttgttgttaggaatatgggagaggaaccagatcgcaagcaacactagcaatgctgatttgatgaagtcaatgctcttcactccggagggcaaacggggcaaatgagtacttgttggaaatatctcatcgtctactttcagctatgtatggcctcaaatttgacccaggctgctcagaatgacgaaaataattcttcacatcagaaacttgggcttgggccttgtatctttacagcccattaggggtccacaaaacctagggtttgctcccacctcctctcctgatcattcctccacttatataaactcctagcagccaccattttgcactttgggttttgtttggatgtaagtttagctgcagctacttccttgtactcgcgtgtgtcggctagaccacccggatacttgtattcagaaccccattctggtttgtttcagtttcatcacttgacaagtgacgtgagttgtttccttgtcaacttgttcttgctagttcttcgattgcttgcaggttcaaggttgttcttggcacggtaagaacagcaacaacgtggagtcagtgtaccggttgctaaggcgcagcacctctgtggtagttgtagtcggatcgccaacgtcgtgtcctcccccaaatcgaagtttatcctcctcttatcgaaagatcgggaacccctgctgctgcatcaagtggtatcagagctcaagttgctaggtgagagattttatcacttctttgtttttacctacagcccaaaaaaaaccacaaaaataggtcagatccgaaatcaccaaaactagttgagcctttgtagttctacttagtctttgcttgctgagttttcgattgcatcgattggttgagttgttggttctagtagtttagtcttttagagtttcgggttctactcacgattttgtcaccacatacacttccaccatcacttcatttatcttcatcccgctgccaccatcaccaccatattcaccacgaaatccacctccaaccccaccaaatttcgtccaccacaaccagcagcaccctcatcaccacatcaaccacccccaaatgcatttattgctgcctccaccaacagccaacccttttgcaactttttgaagtgaatcagcccttcccaagaaagcatttaagtactctcacttttgacttgttggctgaatcatgtaactagccaaccaacccatcattacttcttgttttgatttgttggctgaagcttgtgaaatttcgaaaatgtttgggaaaaggttattttgctaaggcttgttttgacttgttggctgaagctttgagcttgctgtaaaaaaaagaaagaaatgaaaaaaaagaaagaaaaaaatcagaagtgaagagaaggaaaaaaaaggaaggaaagagaggaagttgttgttgctgctgttttgtttgtgttattttcgtgctattttgcgtggctacgcttgtgactaggctcgcgtctctaaagggttttgcctaggaccagcacaataccatcgttgagcgattattcaacttgcattgattaatgtggttctagttgtaccttgatattacttgcagccacctatagctccacaatttttatctactatatcacaggatcgtgcttgttgtcggctccggtactactaaccattgttgttgttcttgctggttgccaatgccttttacataacaaagtaagaacatgtaagaactcgtttgcacaagtttggtagaaatggagatggacaacacctagctccaatagttgataggacatatttcttgtgaattgtttcttcccattaaccatgacaggaggatcgagggagcacactcaactttcaccacgtacgagggacatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctttgaacacttctcttgcaggtatcttgaatacgttggagagaatgggccaagatggtcatgatggatcggctaggcgcaaccacaatggccatgatgctaatagcaacatcgcggcaagggaagaactggagtacgctactgacaccgagcatgatgaggagatacttggtcgtccacaaagacaacagtgccggcagcgccatggcatgggcgctccaccacgacgggaggtacgtgataatgatgattctttaggcacgatcaagtttaccattccttactttgatggaaaatatgaccctgatgcatatcttacttgggagttagctattgatcagaaatttgcttgccatgattttcctgagaataaacgtgttagggctgctaatagtgagttcactgattttgcatccatttggtggagtgaatttgttcgttccaatccaaataataacactccccaaacctgggatgcaattaaaagagtcatgcgagctagatttgttccttcatatcatgcacgtgatttgctgcacaaattgcaacaacttagacagggaaacaaatatgtagaagagtattatcaagctttgcaaacaggaatgcttcgctgtggattggtagaaaatgatgatgctggtatggctagattcatgggtgggctgaaccgagaaattcaggacattctagcctacaaagaatataattcaattaatcgtttgtttcatcttgcttgtaaagtgaaagggaagtgaacggacgaagagctagcttcaggactaacatttctgcaggtcgtgctagctcctggacaccttccaacgctgctgcaccgtcaaatcgagcagcagcaccatcgtcctcaagcaacaagctgcgtccctctacaacaaactctataccatgcccgagtgaaccaacaagaggggttgttgctacaccttccaagagctcatcatcagtggcatcatcagaaaggacaagagatattcagtgcctacgctgcatgggctatggtcacgtgtgcaaggactgcccaagcactcgtgtaatgatcgtgagagctgatggtaggtactcctccgctagtgatttagatgaagaaacctatgctttgcttgcaactaacaatgcaggggaaggtgacgcgccccacaaagatgagaaacacattggggctgaagctgcagagcactatgagagcctcgtggtgcagcgagtgctcagcgcacaaatagaaagggctgaacagaattagcaccacaccttgtttcaaaccaagtgtgtgatcaaggaacgctcttgccacgtgatcatagatggaacgtgatcatagatggaggaagctgcaataatttggctagtgctgaaatagtggagaaacttgcattgagcacacagccacatccgcagccctactatattcaatggcttaatagcagcggcaagataaaggtaacacgattggtaagagtacattttgccattggttcttatcatgattcaatcaactatgatgttgtgcctatgcaagcatgttctatgttattaggtaggccatttcagtttgataaagattctttacactttggcaaatccaatcaatactcctttatgtataatggaaaaaaacttgtgttacatcctatgtctcctgaagtaattttaaaggatgaacttgctgagctagcaaacaaaaaaatcaggagcatactaggagtgagcatcttattgcagctaatgaacttgagaagcataagaagaaacccaccaactctgttcaaaataataaaaaagagattaagctgaagggatcttgtttcattgcaacaaaatcagatttggatgaagttgacactgacactgttgtttgctatgctttggtttgcaaagaaaccttatttccaattgaggatactcctatttctttgcctcctccggtcactaaccttttgcaggagtatgctgatattttcccaaaggaggttccactgggactgccaccaattcgagggattgagcaccaaattgacctcattcctggggcctctctgccaaaccgtgcgccatacaggaccaacccggaggaaacaaaggagattcagcgtcaagtgcaagagttactcgacaaggggtatgtgcgtgagtctcttagtccttgcgctgtccccgtgcttttagttcctaagaaagatggctcatggcgcatgtgtgtggattgtagagcaattgacaacatcataatcagatatcgtcatcctatccctaggctagatgatatgcttgatgaattgagtggttcacttgtgttctctaaaattgatttgcgtagtggttaccaccagattcgcatgaagttaggagatgaatggaaagcagcttttaaaactaaattcggcctatatgagtggttagtcatgccctttggtctcactaatgcacccagtactttcatgagattaatgaatgaagttttatgtgctttcattggcagatttgtggtggtatattttgatgacattctcacatatagcagatcaatagaggatcatcatggtcatttgcgtgctgtttttgatgctctacgagatgcacgtttatttggtaaccttgagaagtgcacattttgcatagatcgagtctcttttcttggctatgttgtgactccgcagggaattgaagtagatcaagccaaggttgaagccatacatagctggccggttccaacaacgatcacacaagtgagaagctttctaggagttgctgggttctaccgccgctttgtgaaggattttagcaccattgcagccccactacatgagcttaccaagagaaatgtgacattcacttgggctgtagcacaaaggaatacattcgacactttgaaagataagttaacacacgctcctttattccaacttcctgatttcaacaaaacttttgagcttgaatgtgatgctagtgggattggattaggtggtgtattgttacaagaaggcaaacctgtagcatatttcagcgagaaattgagtgggcctagtttgaattattctacttatgataagaaattgtttgctctagtgcaaacattggaaacatggcagcattatttatggcccaaagaatttgttatacgctctgatcatgaatctttaaaacacattcgaagtcaagcaaaacttaaccataggcatgctaaatgggttgaatttattgaatcttttccatatgtcatcaaacataagaagggaaaagaaaatgtcattgctgatgctttgtctagacgttacacaatgctatcccaacttgacttcaaaatttttggcttggaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctctgtgcgtatgctattattgcaagaagcgcatggtggagggctgatgggacactttggtgtgaagaagacggaggatatccttgctgataatttcttttggcccaagatgaggagagacgtggagaggttcgttgctcgctgcacaacatgccaaaaagctaagtcacgccttaaccctcatggtttgtatatgcctttgcctgttcctagtgtgccttgggaggatatttctatggactttgttttagggctgcctagaacaaagaaggggagggacaatatctttgttgttgtagatagattttctaagatggcgcatttcataccttgtcataagagtcatgatgctacacatgttgctgatttgttctttcgtgagattgttcgcttgcatggagtgccaaacaccatagtttttgatcgcgatacaaaataccttagtcatttttggagaaccttgtgggctaagttggggactaaacttttattttctactacatgtcacccccaaactgatggacaaactaaggtggtgaatagaacattatctacaattcttagggctgttttgaaaaagaatactaaaaatgtgggaagaatgtttgcctcatgttgagtttgcttataatcgttcgcaacattctactactaagaagtgcccttttgagattgtttatggccttctgccccgtgctccaattgatcttttgccccacccaacttcagagagagtgaactttgatgcaaaacagcgcgctgatttgatgttaaaacggcatgagaccactaaggagaacatagagcgcatgaatattaagtataaacttgctgggagcaaaggaaagaaacatgttacttttgaacctggtgatttggtttggttgcatttgagaaagaataggttccctaatttgagaaaatctaagttgctacctagagctgatggtcctttcaaagtaatacaaaagattaatgataacgcatacaagcttgagctacctgccgattttggggttagccccacgtttaacattgcagatttaaagccatatttaggagaagaagatgagttagagttgaggacaactcaaatgcaagaaggggaggatgatgaggacatacgttccaacgatacaaccatgcctattgcacagcaaggaccaatgactagagctcgagctcgtgaacttaattatcaggtaaagtgattcctagctaatcatacaagttcttcttagaattgggtgctactaaatggttgttgtgatctacttgttgttaggaatatgggagaggaaccagatcgcaagtagcactagcagcgctgatttgatgaagtcaatgctcttcactccggagggcaaacgaggcaaatgagtacttgttggaaagatctcgtcgtctactttcagctatgtgtggcctcaaatttgacccaggctgctcagaatgacgaaaatagttcttcacatcagaaagggcttgggccttgtatctttatagcccattaggggtccacaaaacctagggtttgctcccacctcctctcctggtcattcctccacctatataaactcctagcagccaccattttgcactttgggttttgtttagatgtaagtttagctgcagctacttccttgtactcgcgtgtgtcggctagaccacccggatacttgtattcagaaccccattttggtttgtttcagtttcatcacttgacaagtgccgtgagctgtttccttgtcaacttgttcttgcttgttcttcgattgcttgcaggttcaaggttgttcatggcacggcaagaacagcaacaacgtggagtcggtgtaccggttgctaaggcacagcacccctgtggtagttgtagtcggaccgccaacgtcgtgtcctcccctaaatcgaagtttatcctcctctcatcgaaagatcgggatcccccgttgctgcatcaagcacgaccacaatggcagtggtgacgaggacgacgagttcgtgcgctggtaatagggtgcgcaaggatagaaattgacaggaatgatagaaaagtgtggatggaaaacacgacaaagtgacacggttttaatttccccattctagtggcacgttaccgatatcgtgaatagtagttgtatttttttaatttgtcatatctgtagtagcataaatccaaataaccctaaaataaattgcacaacctgatttcccaattaacttatccctctggttttccgcacgcgcgcttttcaaactattaacggtgtttcttttgtaagaattttctatacgaaagttgttttcaaaattatattaatccatttttttaaaaaaattaactaatacttaattaatcatgcgttaatacacacaccgttttgcgtatcggagaggaggggttcccaactcctcctcccgaacacagcctttagtgattaggatctccgtaggggagacggagggatctggcagcctataggctctttggcaggaaacaatctggaaataggtggtaatcctatcccagattcaatcgggtctccagtctttgcactctagggtgtcgagacggacggcagtagcgacctccgggtgtctgtgcagcaccagcaagagttgaggcagacagcagcgcgcagcaacctcccagggaagtggctgacaagcttgcgttggtgcgaaagcaacatgctccctccactatcagcgtccacatctggacgcgactcctaggagcatccatgtttggacgctatttgtagtagcgtccttattactttggttcatctttcctcttaattactaataatttaatttaagggattttaattattataaataaaaaagctggtgctccaccactgcttcctcctgctcctgggatggagccccatatccgatgcgaaaacccgctcccctgcttcctcctcctcgtccttcctgtcacgggctcgtggcgtgggatgcaacgtggtgctagtgtgctactaattgagacgactgagtaagtgtgttcctagcaagggagcgtggtaagtcttccatcccgtgccaccctgttagatgaggtaattggtgctatcgtcgttgcgcattagactccggtcaaaatttggatctatagcagaggagaaaagggaaatagttaggcaagctcgtcatccctgcacgcggaacgtatttcacactggagatggggctccactgcggcactgccccagctgatgagaagtagacaagggagggggagacgagagggggggaattaagcacttgaactagaggtagaagataggtgctgtaagattcatgcgcacacgtggtggtagataaacggagtctttccaaacgtgagaagtaccgaggtcctgtacagttttcttccattgagtaagatggcttttctgacacaattgattgtggggtccagttcgtccaagatggacgagaagaagcacaacacggatccaaacactcgaggattaaatcgaaagaaattcatcctaaatttttacgaatgactgttagcaattttgtatattgtaaatcatgcttgcacatatagccatcaatttgggcagaaccatactttcctcttactgttatatagcatctcgcatgaaacatgttgcattgcgttcaaggtatatattaggttaaacaacaacaatggtattatttccataccattatatgaatattgtaaaatcacatgatcgtcatgaccagatgaacgaaattaatattgtttgtacatgaccaactagagagctgttcagctaaatttgcaaaataataacacacagtacaaaattggccggtagctagctaggtttcgtctaactgccatgcaggcgaaccctagcgcgaggttgccagccaggggatccatcgcgtggtcgtgagcaaggctgcaataaccgaagctcgaggcaaaagcgtccgcaagagagggctgcaactctggtgccggccactactagaaaactcattttcggcgtcgtagggtatcaattttcgcaggcgggcatgtaattcggagccaaaaccccactggcaaaaaatgtacccggggtggagggcgcggtccgcctgcgaagatcgatctttgtaggcggaccatataagcgtcgcctgcgaagatcgatgttcgcaggcggcaaacgtcgtgcgcctgcgaagatcgatcttcacaggtgccacttatatggcctgcctgcaaagatgcccctatatagtcttcttcctacccaagccctattcattctccccgaagtttctctctcctaaagtgacttaaatataggggggaggttttgaacttcaaatcttcgggggatttttctacggtgcttagatctactcatttcgggctgca

SEQ ID NO: 8002 - DNA, 4696 bp, Oryza sativa
tcttgttgtagtgatttaatgtggtaacataaattctcaattttttttatttttgctatcacatccacctcgtaattctagatctagatctagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagagatatggaaagtcgggaatggatgtatcattggccgaggtttttgtctccatatagaaacgaagtgtctaaatttattgttattgccaaggcacacgctgaaaagaacaatatgaggaagataatttgtgaatgtgctgactgtaagaatgaaatagcctgggacttcaacgatgcttttaaagtaaaggagcacttagtaactcgtggatttatggacgagtacaaaatatggacacgtcatggcgaagaacaagtggacgggcctgaaaatgtagttccgacacaagttgaagacatggtgcgtgacgatggttctgttgaggacaaaatcgacctacaggaaatgttacgtcatgcagaacccgaggtgctgatggggtcggctagagggttaaataactttgaagctttacggaaggtagcaaagaaatttttgtacaatgagtcgaagggctgtgacagtgagttcacaacactacggtaagttctcgaacttatgaggttgaaggcgatacatggatggtctgatactagtttcgacagtctgttataacttctgtagaaaatgctcccgaggcctaactcactaccatccagcacatatcaagcaaagaaactcatatgtcccctttcacttggtgtggaaaagattcatgtgtgcgtaaatcactgcatactgtacaggaaagagtacgcttctttagatgaatgtccaacatgtggtgctagccggtacaaatcgaatagcaataatggcctagaaccgtctgatacaactgagggacgacagagaaaaatcccgcagcttgtgatgtggtaccttcctgtcaaagaccacattaaacggatatactcaaacccgcgagatgcggaactaatgcgctggcatgaagaagggcgcaagaaggatgggatgattcgacacccgacagatgctcgtcagtggataaactttgatgctcagtatagagagtttgctaaagacccacggaacattagatttgccctgagtactgatggagttaatccttttggagacatgagcagctcacatagtacttggccagtgcttctcaccatgtataatcttcctacctggctttgtcaaaagcgaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccc

SEQ ID NO: 8003 - DNA, 49883 bp, Oryza sativa
ttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccgctgaactagccgggccaacatacttcgcaaccaatgattgcccggaaaagtacgaacatgggaaagcactcttgccggaatgggcactgaacgaaggaccatgggagatgaaaaggttacataccttctacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaagacttttatgtttcaggccaatttccaaaaggtatgaatgatactaatattactcttattcctaaaaaaaattatcctacttctcctgctgattttaggccaatcagtctttgcaatgtttcttataaaatcatttctaaatctttggccgatcatatcaaaagtgttcttcctgatttaatttcagattctcaacaagcttttataaaaggtcgtcgcattgcaaataatcttattattgcccaagaaatagttcactctttcaatttaaaatcttttaagtaaaatgcttttctgctgaaacttgatcttgcaaaagcctttgatcgtctagaatggaactttattgagaaggctcttcgtcgtaaagggtttcatggtcattttataaatcttgtccttgcttgcattaattcggcaaacttctctgtcaatcttaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagtcttcttattcaatgtgcttggagaattattgaaaatccaaataacttggtttctaagatcctaaaagaaaagtatttccctcagggctccttttggaaagctttaacaaaaattcctaaatctactttttggagttctattctgaaaattagacatcttttggataattctatcatatggcaactttctcaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactttggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgctttccccccgggcccaaaatttttcttttctccgcatctcgcgagctgagcgttgtcgcctcctcctcatctcctcgctcccttgccgcccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccgacaaaatttgacttttgattagagaagaaatcaaatagtccggagctattatttacacaaggtttgttatgggatggtattctcatactagtcatgtcattctgaaatgtaaggctacacctttggaagatgaagatcggctagtgacgaagtgagatcttctctcgattgggatctccgactttggagtgttgtttgacctggcttccacattccactagaaaactgcatctgacctaagcttccaacagaatagctgtgatagacgcccaatgactgcctggaggactccataagctgaacactgctgcctcctaatccatggctcatgctgaatggatggggctctgacccagcaacagtaggactcagaggtgtctttgttcttgcatcacctgtgaagagaatggcaatacgaagcaaatttaaaagttttgtctataggacggaacctcaagctacagaaaacaaaaggcgagtgcaacagccacacagaaattgcaggatagtttgacttcacataatgaaagaaatctctttccatactattgtgccttcattgttaatagagttaagtaacaaaaactacttttctataatagtatattaaataattaaaaagttcagtccaacataataattaatataaaaagaaaaaagaagcagcttttttagaatggaaagatgtttgattgtttaaaattaaagagatgatgcatagtatatagtagacatatagtataacactttatttggttttccaaaaaagcagagcaaccaatggctatacgtctactaaagaaaaagaaatggtacatatagtatcaacagaattgtcagggtaaaaattttgtgcttctagaatttaagtcccaaccccacagacaatagatgctttttacatgaggaaacaccttaaagtaacagcaatgtcaaggaaaaaaaaaactcaatacatacctgaagtaatatgactccatagatgaaatctgaaaggtgatcccatgctaagcacaggactgcctgcactgttctgcctaaaaagtggcagataagacttgcggaatgatcttgggattgaattgctgacacacaatatggcacatatgactaacacaattgaaatcagaaacaacacaataagaatatttggatttatctctcggtggagtattctgtatccttgaatatcgattcgtgtagacaacacctgtccagcctctaacaaagcaaccccaagagtccaagttatactaccagagtcaattatcacctggttatctttgatctgcagcccctctctcagaagtgatgtaatataaggagccctgaaacaatactgttctataaaaggttgtggtggaacactactctttgcaaccttccatgttttttcacaaaattcctggcctctatttagaacatcaatgagagtggcatcggcagtcaaattgaaaaatttaaaaaccacatagaaaccagacatagcataaaactgcccatgtggttgcggaaaggtactaggaagagcacaaggtttagtgttgcagtcaactgagcttgcattggaccactcagaaagattcactgttaattttgcaagggcactacattcgttccactgaggcatcccgatcagttcaactgccattccctgcttctctttgcctgttgtcttccctccaacactgggacttccatctagtttgagcgggtggcagtaagaacaaatataatcttctttgtatcccgtttgtagacaaggatgcttaacctgaacttttccattaccagctgcccctcccaacttcttcacaagatgtgcaacagatttgtcaaatgcatcatttagcccataaccagacagagaataagcactaagttgatgactgatagaaccaatccttagactcatacttgtttcatcctgaatggaattatcagtctcaaatgtcacctgtaatgatgatccacctaaatcaagtgaaccatatgtcattttagaagatgaggtgccaagcatattcaaatgatggttaagagctatccatccataataagcttcatccatgccactgataatcttgactctgtctctagaacacagaaacgatgaattcttcagaatatcccaagccttgtccagaagccactcagaatctgcactcggtagcttgcgcacaccagctgtggcatatagaaaagcaggcgtgtgtttgtgtgcacgtctaggaatcaacttctcagccattcgaaggaggggctctattgtcatctttaatccagtttcattgtgaacaagtttgttcaacccaggttcagtctccattcgctgataggctcgcccagttaatttaccagattttttcttaggagcatttcctaagggtttcaaagcaataggaaatgtgtttccatcgtcatggttaacagaccattcgtaaacatacactcttgtcccagtgcttccacaatcaagaataacatagtattcagggcttccttccgagagaaagacatggaaatatctcaaagaagcatatataaagaacaccaaaaggaacagagcaatagcacaaccagcagctctcatgcatttctttcgatttgttggtgatgaggggggtgttttctcttttgaaaagcttgcaacagcgccatctctttgaagtgtgcggataggttttgcacgccctgagaccaaatcactaccagtgctagagcccctttctaatgcatcaattcttgagaacgtaggcaaatcttgaagtgaagaagacagccgcatagttgcttctttgtagtcagggtggcaattattataagatctcactggtaagggcaaataagcagttggaatcttggcaaacagaagtcataaggatgcagcataaataaccagagtaaattaattcaatagcgcctttgcaccgcctctgcctgcaagaaaattccatagttagaatatactaacgtggtaaaccacatatgaataaagctaaaatttgaaagatgctccgcactaactaacaacactctcgttatcaggcataagaaaaactttcctacaacaccaatgcaacactagcattgaagaaaatagatgcatcctaaattcctaatcttaggaaatatattaacactatataaatatcagtaatatctgcaaatcaactcacatgctaaaccaggttttccctaaatcctgatactaactcagtgcccccacgttaaactgctagtattcatatgcatcatcccaccgacactacaacagaaacaggtcaccaccgacgacgaactcccggctacacactaccacccataggcaaaaactcaaggatcgcagcaacgcgcccgcccccaaacacgccagcttcccctcgattccagcacccaggatcgcgtcctccaccacaccaaaccgcccgatcccagccaccgacccccgaacaacctaagatctaatcgcagattgccgacacgcgaccacagaaacccggcatcgaagctgccggattggatctggccgggaaggggggggggggacaccgacgacttacccgtcgcggcgggccggtctatgcctccatcgccgcccaccccccggcggcgcggggccagcggcggcgaggattgggagcacccgcgcggcgcggtggggcggagcagttggggcgaggcggcgatgtgggcgggggcggtgcccgcaacggcggcgcgtcgacgaaggaccgggcggtgtggggcagcgtggggtcggcgcggacggaggttgtgggggcgtcgtggcggatggaggtggtggtgacgacgtcttggaggcggcggcagctgagtggaggcgggcgacggatcggggatccgcagtaccggcggcggcggcgcggatgagattagggttaggggagggagggagcaagggtgagagggctgggtgatgaaggggcgatcgacggagggaggaatctgcggcggaggggaggagaccggcggcgaatcggggcaaggagggcggatttggggggcgacggtgcgggcgcgggttgggggatgaggacgcgcgggtgttgggggagaggtggagatgatctcgatcgttccatttttcacggccgtcgactgctgaatgtaagagcttaggagtgaaggattagctgggtccaagttcacagttccgacgaaaatcggttgaatttcagaaaccgtatgagatttcaatgagtttcattaaaatttaaatttgaattgataaaaaaaatcaaattaaatcttataaatagtatgatattcgtagaacctattgggatataaattttcaaaaaaattgatgtattccatgtatttactgaaatttacactagaaaagaaaagaaaaaataacgaattagaaaaagggaaaaaatcagtttacctctttttctagttatcgattgaaatctcgatgatttcgctcggaatttcgccaaagccgactggttttcgcgagcttatcggtaaactcaaggaatttgtattcaaattttggtttatgaaatttgtttggtatctaccagatttcgtgaaaatcgttattccgccagagctcgaaacgaaaggccatcttggaatcgtaaaccctggccagtgaattatagggtagatagataaatggaagtagtattttgctatacttgtggcatgcacgacgaggatagttggtaggcctaccctcgatggatttgcatgcgaccgcgcttgttgttcggtcgagagatacggcaactggcatgagggaaatatattggttgatgaggaaactgttttacgcgagagttgtctacgccaactcgctttgctggcggaaaagctatcacgtgaacgttcgtggaaattggttcacgcgaacgccccttttccggatcgtttctgtatactaactgattagatcgctgtaatttcagatcaccaactaattagatttggagatatacaacatggaccttgtgggctatagtagtttaaattgacatctttatcttatttttacttttttttgtttcttttgtgaaattattttttattctagtttgttatttattttgtgatcacaaaatatgtattcatttttaaaacataacacaacagcaaaatttatctttgaatatttttttcactattatttagagaaggaattttaaatcatatataaactttacatgtgtaaagtttacatataaaatgttactgaaaattactatgtataaagttagtatatgtaaactttatacgaataaagttacatgtataaaatagaattgtttatgttagattttagtcaaaatgagaaaagaaaaggcccggatatgatttagctaactagtgggcccgtgaagattttgcatatgcataggctaagttgtgggctggagcaacttgtgagcaagagcagacacaagttcgctcgacgcgaacagtcgcgtactagactcacccctttgctggcgcacatgccacacggctggcatgtccgtgccctcacgagttttcttttctttcatcaatttttttgccaatttttttgttatttttttattttagaaattgaatctttcatctctaattctagttgaaagtttttgaatttgagttgaacgtttcgaattttgagatcaaagtttttaaatttgagttgaacgttttgaattttgtgacgaaagtttccaaatcttagtttattgttttcaaatattgacttgatttttttttccaaatctgagtttaaagctttaaaatcttggttaacagttttgaaatttgagttgaaaatttcaaatatatagtagaaaaggtttgaattatttacttaaaagtttttaaatctaagttgaaagtatcaaatattaattgaaaagtattcaaatcttgacttggcagtttttaaatttgagttgaaagttttcaatgaaagaaaagaaatgagtttggattaagtgtgcgctacttaatttgttagcgcatatgcgtaaagtaggaaaccactcaaaggaatgttgttctcgttcatctaaaaccatccaaatagttatattttttataaaaaaatgacaacatttataccatgaaattttgtgtccaaacttaactcactctaaataaattcagcaaatgaatagtatagtggtactatatttatacccaaatttatttcctgatttgtaggttgaatttaaacttgatttttgttggagtgctagatgtcactaaactttacattgttaatttttttaaaatcttttataactatttatattgaattttcaagaaaaatgtacgcgagggaacatcgtatcgagggattagaacccactttcctggctgatgaattcggccatgcattaatacagagcagcaatcatgtctattactcatttttataatatcaattctaccgaatgcatatttctatcagtaaaataatatggaacacctcaaattaatacatacgtacatagatgagactccccaaaccagggaaatctcttggaacaacttcggtaagattgtgaggacctactcagacctaccattattttcagaagaatactctctttgagttgtaagaaactattagatattaggattaattgaattgatgtcattgtaaattcatgttattgaaaaaaaaaactattactattcaggatacctgttacgtgctactagaattttataaaattaaaaccatgccatcttcgtcattatatatatatatatatatatatatatatatatatatatatatatatatatatattatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaagccatgggtgtgcggcggcacaagcaacgagagagcgaggcagcggtgaccttgtcggtgagggaggtggaggctgcagaagcagcatctttaaggcaggagccctcgagtgaatgattgatgtgagaatttgtagctgctaattaatatggaaatttttaacctttataccttttaaattaatgtggggacttctatagtggactctaatttaatatattttacgcaaggactacaattaataatatatatatatatatatataaagatataaacatttacacgtagctccttgtttctcaaatattttatcttgatcacaatgggatgtctgatcttctgccaggtaaagattaggcggagaaggctaatctccttgtttctcaaacacctcatcgagatggctaatccctacatgcgaatcacaaaacacaaacaagaacaaaggtagattacaattcaatttgcatatgaatggttaagatctcaaagttggggtttcacaaaccgaactagcagcgaaaatgcaatgacagaaataatctaagtaaaaccctactctaaactataactgctactaaattaatatgattaggaacattctatagttagtcttagggcgtccacaccttgggcttagcccatgacacaattataaggcccaaagcacaaattagactcgggctgcatatggtatgtggcttttttctgcagattcccgacaacttaagagaatttttgatgtgtgaccaaaaccatctgaaagtagactccatacgctttccaacaagtactgatgggagctgagattccttctggatcagcagctatgtccatttgatgttgatgctgttaggagggtcgattccgaataaaaagcgtgtagaatttcatcacttactttctatggaccaaaagtgacatggtgacataggagtagatttggagaaggatattggtgtgataattccagaagcattgaactctttatctctggctgtacctttgttatatattggtagaaacagcctctaccgcatgccccgttatacatcgaataagaaaaggaaacaaactagagaaatatccaagcttatcatctattatcacatgtgaatagtgctactttaatttctacaatataattggttagtccacagcactactacataatacccttttggtgctggttgggaaaccccccttaggtgtcggttttccgaaccggcactagggaggcagcactattgattccaagtgattggtaacggtttcaaaaccggcacctttgaggcgcttgtgagccaaaaaaaaaaaaagctcgatgcatcgagcgcatccaccccccacgttgcccccataatctcaaatccacaacatcaatgaatcaaccaacatcatcacaacgaataaaccaacatcatcatagaaattacagactataaactcccgaatcaaccaatatcaatcacagacatcacacaacaaacattgaaagaacaatcaactccaccactgctcaccgtcgctgtctaccagatccgccaccgctgccaccgtcaccccgaggatccgccgccgccgggccgccatcaggccacaattgcctcccctcccacagttgggccgccgggaagtaggggccgtcgcatccgggaagtaggcgctgtcgcctgaacaccattcgccaccacctcgcgcgcctcccctcccgcaggatctggtggaggggagggcgcgcaggcccctcctagcccctgcgaggccggtgctgccttcgccgcccttccttctgccggatctgtcggagggagggcgcctccaggcagccgccgctcctcccgccgcgcgccgctgacaccgtcgatgccgccgcacgccgctcctctagtcgccgcctccgatgaaagagaagagagggtgctcaagagagaggggaaagagcgcagagagaacgagagagatcgagaggagacgagagagtttgagcgagcgagcggacgctgcggaccttatctcctcgacgcgttgtggtggggcctgtcggctcatcgccggtttttaatattaaaggttctgattctaaataaaaaccgatacctataattacttaaggtgcctggtttttgcgatttcaacccgcggaggtgggaaaaggcctataagtgctggttttagcacttccatcacctatagcgctcacatctgtttgatgttttgtagtagtacatgtaacttcattgatcatgcaagcacttcgtatgcacgctcccctttctttcacccatacaaatatttctgcaaacaataagataaaaaaactcatgaaatacttacataataagcatgcacctttgattgatgaatataaaagataggcatggttatatccgagttagcgatgttctcatcacatcttgtgatgttaaaaactgaaaataatagcgtagccatgacagagttagccgcaacatttttttttgccactaaactgtgaaatcgtatgtgatttgaaataaacagaaaaagaaaatatttgtagacttatccgtgaaatcataagtgactggaaaaacaaaacaacaaaaattaggagatattttcagaaaaagtgtaaacaggagatatttccagggaaaaaaactaaactataaaattgattttcagaaagaatgtaaacaggagatatttccagggaaaaagaaaaaaatgtaaacaggagatatttccagggaaaaaaaactaaactataaaaattaaattttaaatgtatcagagccaggtttcgatcctgggacctgtgggttatgggcccaccacgcttccgctgcgccactctgatattgttgtccagagttaatctctcattcttattatcgcgttttcttgcactatccttgatctaccctgcatgaaaacggttcggaatgtttctccataccggacgtttttggaaacggaaagtatcagttggaaatatttccgaaacttttgaaaacggaaatgaattcaatttttttctcaaaaaatggaaacaaggtaaggctactatctgtgagaaacgaaatcggaatttttttggaaaacaaattctcagatttttttttctgggaatcggaaacaaagtacgtatttctcatgtacaactgattagcttcaatcttctttgctctactagtcgagtgcccgtgcgttgcaacggatcttaaatagaaaatataatatggtttaacttgaaaatatataaatgtgtgtctgcgttgttgtaaaatagaaagctatattatatttaaataaaaaatagttattcgatccgatgtctcccagatggtgtcattcaataatcgaaagatacaaagtccaaaggaacaaatatgccatggttgtacagactcataggtcatctttgggaccaattatagtatagacaacttatgattactctaatgtgattatcattatataaaaattggatgataataaacggataaaagatgttaacagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttgtcactccatttcttttacataacaaagatggaggaaatttcaagcataagtactaatcactctttatttctgataatgaatcactgcatcagtaaaacttgataactcatgtacattgaaaaaatgtgtcgataaggatattctcgctgttttagcattgcagataaagcagaggaagattcaacagagtttcagcctacttgtgcgggtaatatgcatgttttgcaatatttttttctttcaaaggaatatttcttttagaacaacaatagtagtgcagcatgtgcatatttttctcaagtttctagtttgcataataatatcagttatcaatgttgataattcaaaaccacaaacaaaactatatattaatgccgtacggccacgctcgacacctcaacctctaggtcctgaaaagtacaaaatgttcaggttttttttttcaaagaacacaaaaatgttcgggttctagatcaatccctcaccggcgagctcgaggtgctgcggtactggatcgaccgcctcgccgtcgtcagcatgcattgtaccattggaataactaccacccatgcggcagagcattatattagatacttcagagaaaagtattttctatagaagggaaatctataggtaagaatgaaggttttatttacaatccaattcagccacttgaatgttaccaacacacaagatgcctaaaaagcaagggcaatattatgatcagcaaacacgtcaaagatttaggggtgttggacgagttatttcttattttagcaaaatatgtctctaaatggaattatcgttatgttgaccattccaaaaaaaattacctacatttaacaatgactaaagcaaacttaacatttccattctaacattctgcgtcaattaaaaaattattgctatcaacctcaagccatggacacaacacttgtttgttataggatttgttgctattaacctcaattcagtctgcataatgattagtgttttggctatctaagagacagcggacacttgtacgttagaaatatcatgttaacccagagatgatttggtccaagataccattaaaccaattatagcagcaaggacgactgctgtggccgtgcccaaagatgcacaatactccatctctgcatacctttagcctgcaaagctgaattcgttgatgtcatggtttctatacaattaagcgcaattgggcaatttgtgttgttattgttccagtatcacgaaatacaaattagatgtaatctgaacttaccttttcttacatagccttgtgaagaaatcaatagcactgagcagagaggcagagcacgcagaaagcacaaagaggaggaaagagggattagatatggggaagacttgagaatagagaagaaatcgccatcagtaatggcgactcgtggaggtggcgacggaggagccagcgggatcgcgtgacgacgacctgtcggcgggatggactcgcgtggcaccaccgaggcggtcgcggcggcgcagggaaggagccggtagggttgcgacagaggagcagccaggatcgcgcgacgacgatgacctggcagcgggatcggcagccaccgcgggatgagcgtccgaccctgaccatgcggcgcctcctctctgttccactgcggcgcggcagcctatgcacggcggctatgccctaccccgccctcgcctcatccaccgccgcaactccgacacactgtcgggctcatgcctcaccggcacactgtcgggctcaggcctcgacccctcctcgtggcggaaccagacggggatgcggcagcgcgtcggagcgtcgctggagagagaagtgatgcgatggcgttggaggtggttgcgagggagcggagatgcggagatagtgaccgagagaagggggaggatgcgtgcgccgcgtggatcgggcctgcggcggcatgcggagaaagagaaactcgatctgaatcgttggatatcacaatcgtacgggtaatattccgcatgtctgttaagggtggagtcaccaccatcactacgaaatttttaagtagttgagaaatgttcagatttaaactatgtattgaggttcttaattaaatggagatattttttttctagtctagtgattcagatttttattttgcctaatgactatttttatttttattaggccatgccatacatactaattacaattacagatgcatatagttgttctttttctccaagtgaagtgtacaattagttgtaaaaattagaaaggtgatttattgttttagaaaaagtattgaggtacaactcttcgtggattcgagaatttcagtttgaaaaggttttatattctaataaatatttaccctatacgctttgttttttaattcaataatatttgatacctttttatatccagaatttccaattccgattcaaaaaaattaaatttatgtggtttgcctagaaaaaaaaaactacttgagacccaaaccaccaaacgcgtgagtgaaatcctgaacaacttcaccgagaaaaaaaagagtgatttgcttcgaagtggaccattttataaattaggaatgattccatctacctcttcctcccaaaataaattaaattttcgtatattaatttaaacatagatatatctaaaatcttataaaaagataatttattttaaaatgaagagagtagctacgagtaattgcttccaaatcttctctaccaagctcgagcctccttccccaaaccttaccaaaagggaaacaactccatcgatcaatccacctcgaaaatgcacatccatcccttccattctatattaacgtttcaatgtacttccttcgtttaaatatatattaacttttagtgtttaaaatttattgtaaagtatacttgatcaatcgtatatttccatcatttaatttctttatcacctacttcctattccttaaccaatcataatatttctttacctattttttttaaataatcatgttcaactccaaatctattttatgacggaggcagtataatttaatgaacggcttcatgcccctcgctgctacttctccctacatggtggcttatgccttctcctaaccaatcgtagcctccattgccatattattcctcctacctaaagactctgtttgagagagtttctggctactgcagtttttcccagaatcagaagctccctcaaacaacagtacagttttggtagttatgctaagccagggaaaaagaactttttgggggacatcatgttaatctcttgctgttttggccctccatggagtctaaccattgggattgtttaggcccattttttgaccatctatttgctgatgaaggaatcaggcatcgagccattggtagatatagttgtttgttactacttgtcatgttatctgccgctatgagtaggcacaaatatagcatgttttgtagaatcgtggtgcatcaacgaatttgttttgcacaatcatctgtgatttctaaattgtgtttacgcatcattttgactctcgaaatcagcattatttgtttttacctttttctttataatcaatacatgattcgttctccttttttgtgctaattatctggtagtttgttactgctccctgaaagtttccacgtttgtgctaccttagtgaacaaggatggaattcgcaattggtttggcttcaaagcgagcttaacacatttgtaggtgtttatggtacgctgcagcagtttgaagggactcgaaacgtttaatgcagtgcagccatattttttcctttcatgattagccattttctcatcagaggtagatcagtaaatgtatgcatactggtgaccattcagaaaacgaccacaggcagagaaccccattccaatagcaattgccattggtgtgtgacatgtaaatgtggggaaactgttttaaacactcgggtggacgtccacccgtttcttgcatgtcatctaaatggttatgaaaaaatttcaaaaaaattgacatgataggttaatttgtaatatatcacttcacaaacatgcaaatccaaattcgacttctacaagttgtaacaaaaacaataaatttaactgtgaatatacgtataatagttagtgtttgatttgttattttcgttacaacttatagaagtcgaatttgaacttgcatgtttgtaaagtgatatattacatattaacctatcttgtgaatttcttttgaaaatttttcataatcatttaggtggaatacaagaaacgggtggacgtccacccgagagattagaatccatcctcaataaatgtactgaagtgcacatgcaaaagcaaaacagacaccaactttacacccaaagtatcgtctgcagtttatgcggtaaaaaaggatatcactctgccattgaacggcaaacttactaggttattatcaccacagtggatctttctgaaagtactaggacaggcaatttcaccagttaccatcgtcgatctgaatatttgatgaagctatttcaagagtgtaatttgatgttgcataaccaaactggttcaaaaagatgaaacggcatagcagcgctggaactttgtgattcgaaataatgatgctgctttctttaagcatacaaggaacctcaggtatgaatttcatttaatccacctttaccttgatttttacagaaaacgggttacttcactatgttctgtcttctgatactcttatatattaaagtgattatcagttcagaattttctggcaatcatcatgatataaacaagtatatactcctatcagtaatcatgccgttgagttgaacacatagtataatatcaaaggccgcaactcctatctggaaaaacaaaagatcacgtcagttccatgttccagttgtgatattacatgctgaagccagatcaatggaatccaaaaagaagaaaaaaaatatagtccggttaaaagaaacataagaactagcaggtctgcagaatcattaaaacataaaagaacaggatgacattacttttggttcacaaagcatgaatgattggactatatccatattcaacaatgcatgaacttattttaaacataactaatataaacaacatagatgcgacatgagggtaacggtagatttaggagatggatttccatacatctaaacgtcttatcaaaggggggaattgagtagttccttttgggcaaacgtacttcatgatttgctaagataaattcatgaacttatcatagcattgaagattctataaaccttcataaaatgcttttggtagtgcaaatgcatacgaaaacaaaacattttataaaccaaggtaaaataaagaccaaataattttacctcataaggtatcctatccagatcagcatgctacaagaagtgcatttctcgttccaaaaagaaactttctttctagtcttgagatctgaacctcttgctccatttgataagaagctgttcaatgtcagcatccattcttgtgcccctacctccccagactaacatgtgagcaagatcaatcattgaagatccgtctacctcatgcactgttttgaaacccattctcgaatagaacctaacgagctgattagaaaggaaacactggtaagaacaccatcacgcgctgcttaaacaaaatgcaggacaaaaaaagtccaccaataaaatgaaacgaaaatattgcaatatgtggagatccagcacttcaaaacaaggaactgtgattttgtgaatcaatacttgcaaatatccaaatctaaatgttgtctcagcgggaataacgccattatcgacaaggtgaaccctaggaaatgataaacaaatcaaaactatttcttctcatcaattgtgctacccattgtttccaaggtgctttcctttgtgaattatatcaaagcgaatcacagcttgagcaattcgtcgaacaccatgcgcgcagcaacatatcaccaccactacgcagcagcccaggctgcaatagtatgttgtatgtaccttggagtggtagagatccgtgtcgttgatggcaagtagctcggcgcgcttgcagccggcgtcgaagccgtggcgcacggcgacggcgccgaggaagacgccgagcccgaacagcggccggtcgggcacctgcagcgtggcgcgggacatcctcatggagtcgaggtgcagcacggcgccgcctggccacgggcggacgacgccctgggcacggcccagctccacctcctccgtctccccctccccgccgctgccgccgccgcggcgcgccgcggtgacgcggaagaaggggccgagcgtggtgaggcgcacgcgcaggccctgcgcgcgcgacgcagacatgatgtccgccatggtagggaagacgacggaagcgcgcgcggcggggctcgccgccggcgtgggcggcgcgggcgcggccatggagagagatgaggggttggggtggagcgtggacacgtggcgagcgatgagctgaagatatttgggtgagggctgcggctggctggctgctgcggtggtgggttcagcagcgccgcgcgaaagaaatcgagtatttctttttcgaagaaaaaaattgttctactaccttcttaagatataaaaaataaaaaagaaaatctttcttatgcatttccctggtataaaatgtttttggctatgaattggtcgtatcagccctaaaacaaacaaaggccttcactaaagccacgcaaaaaaggggaatttaattatttatcacttttacatttcacaattattcaaatattctttttagatttgcgcttactaatttgtcatcaaaaagagagaaattcttaagtttatgccaattttacctacgtggcgggataaatgagattgctagtatgtatgtagggtgtgaaatgtctattttatcctcctgtcctgtcatcctcttccctcctcatttctatttcctacatgcggcagcgacagcacccggctttagtatcctcgattgcgacggccggaagcaaagctgaggaatggagtggcggccagcggtgggaggtgtgggatgcgatagaagctgcggacgtcgatagccttggggagccacgatgcgatccttggttgcggcagcagcaacgtggtagaagtaggagcaagccacgacgacgcagtggtcctgcaatatggtactcccttcgtcccaaaatgtaataacttttaactctcaagatttatttcaaaatataacaacttctctaccaatattttcttctcaaccaatcacaactctccaccattcacttttcttacctacctctactactcaaccaatcacaactctctaccgtttgcttttatctatttttttaataaccgtgtctaattttaaaaatacttatattttagaacggaggaagagtaattcttttttgccggtcatcttctcaatgctaatcgcgtcgtggacaggattggagtatggaatgtgctgatgctggtcgatccatggtttgctggctctttggtgatgtggcagtcggatgggctgttggagcatcacacgaagcatcggatcgccgtggcgatcgggcagatcgacgacgtagatcatttctgatctaaccttgagcgattgctggcagctggactcctcatcaatttaagggctcaccacactacaggaaaaattaactattgccacatatatattgcaaggacatataaattgttacaattagttactcagctaccacaattttatttttttatttaatattaatatatcgccacaatataaatttgttgtgatattttggaatttgttgcaatgaaaaatgggctattacaacgataaaaattactgttgcaatacaaaagtactacagccacgattttaatctccgtggtagcaattacaatttcttgccacaatatattagtgtcgtaattatttaaattttttgttgtactataaaaatacacgtacattgcaacgggtaaaagagctgagcaataaattaaattattgggatcattatacattataattgaaaaggttaatgaaatcctaacactggtattgttatagattttaattagcgcaggtacaatagcaagctgtaagctagctgcaaacatattttaaggagataaataaggagagagaagagcagcgggctacagatttgtagccagctgtagtacggactctaagacacagtgtatgtatgacatgtcagaccagttattgacaatgtagtatgtaactattatataaatgagctattaaattggctataaatgaattgaagctaatagttggctgtactattaaacttgctcttaaaaaagttaatgaaaatctttcctaggttttgggccgaaagcctttctttcttttcagcccatggccaatccactacctccctccgtttagcctgctttcctttgacccagccacaagtggaccccataagaccagctcgaacagtccaataccatcttcaacctctcgaagatagtcccgtgcccgtacggttgctggagcaatcacccaaaattggttgagggtttttatccactcgatctactcttttcgtttttttccaaaatcatagcgtaaaactcaagataaaaacgaaaaatgattgaaagtttttgatcactcgatctactctttcctttttttttctagcgtaaaactcaggataaaaacgaccgtggaagatcgttgcatcatcagcaactgttaaacggagattaaagccgaatcgaaagggaggagtggggaatcgatttttgcgattaaattggaggagaaaacgcaattttgatatgacggcggcgggaggtgtgcagagaacaggtcggattaaaaaacaaaaggcgcacgggagaaaaaactggtgacaaaaaaaattacggaaaaaaaggtaacagatcggattaaaaaaaccggaaaaaaaaccaaaagcgtcagcgcgtgcgcagaaaaaaattccttcacgtgaaaaaaaatgggtaaaaataacggtgtcaagaaaaccaaacggatctttttttacggtagtcggacgttttttcttactggccacataagcttttttttaatcactttttgagtcggacattttttttatttttttctacttttttttttgagtcggactttttttttctacagacgacggtgatttcttggtcttttttatagtagagatgattaaaaccgaaacataaaattaaaaccgattcaaatatggataacgtatcaaaatacctgtaaaaatgttttcaactttcataatagtagagattatacataaggtatggcaacaaataaatagttgttgcagtaagcttacactattaccaaaaaaaatactcctcgggctcacctcacacgcagccacgaaggcccacagaccaagcccaccacgccatgaaccaaatatattagttcataatatccaaggaaccagtcaacagccaattccccattcctcacaaccctaacttaccacacccttccctttgcttcactattttgcatgcatagatccatcacaaaaggtggtttaaattataaaaaaaatgtgtagcaagagtggaaatgtatagatttaaccactctagaaagatccctcaaagatttgtagttcaaaatctcccccctatattttggttggtctcggagagagaaaaacctcgtatgtaaacaggggctcgaagagaaagaaggctatatagctggatttttgtaggcgacagaaattaggtgcctgtgaagatagatcttcgcagacggacgacataagtctcccgcctaaaataatcgcagcgcctgtgaagatctatattcccaggcgatccacataatataagtggtccgtctgggaatatagatcttcgtagtcagaccacaaccttagcctcgggatacattttcttaggtggtgttgtggttcggatgtgcatacctgcctggaaaagaaatggcaaacgtcactaaaattcgtttttctagtagtgaatcatcaccgtgcttcactataatggaatgtgagtcgatagtacacccgtccataaaatcctctcatgcttctgtttttgcttcctctcatgcttctgtttgccttgcatgttccatagccacgcgccgtgcgccatcgaaccctttcggttgcatttgcgaactaaccagatgccattttcttcctctgcaatagctagataactgcaaatctgcaattgccaataattaattgccggcggagaacatggcacgccactgcatgtccaccatggccgcgaacacggcgtgggccgcgtgcccgacctgcaccggcgcgccgccagacgccgccgacatctccgacccgcagcagcggcatgcaggccccgtcgagctgcctcgtcgagagcaggtgctcggcgccgatcctccgcagcgcgcgccacttgcggcgcggcgggaggacgaacacggagttggcggcgtgcccgaccccgacgccgtgccacgcggccggtgaggctgccgttgtgcgtctggaggatctggcgggccgtcgacggagacgaggcgacgatcgagacgacggtgccaagccggaccgccatgagcaacgtggctatggatttaatatggtgtctcgctgtgtatccgccgccaacttgggaccgaactcgattgtaatttgtaatcggagctgtcttgactcttgagtagtatatactcaggtaggggcggtgctcctctccacccgaccccataagtctacaacaatcaatctaggtttaaggtctcaatcgagacgagaagggggaataagccacaattccggcggctacggctccgtctccttcatcaggtgcgcgctttgatctggattaggtgtcgctcgatccttttcattgtcaaatctctcgatctggatttggataattttgtgcgaacttgggatagatcgatgatcttccgctgctgatagttgataaaagtggcctactttctcgtttctgatctgatgctgttctcggtttctccacagcaattcccgcgctgctgatggatccatctgagggaaggaaaatgagtagctttaaggaggaaagaagtgaagggaaagttccggccacggcgattgatcccaccaacgagaaaaaaaagaggactaagatggtgcgctacactcaagaccaaattcagtactgctttgcgaactcggtggagttatctgacgacgacgaggacgattttaagctgacggaggtgctgagcaaggagtgtcttggccggatgtcgcaggagtatctagccaagttgtatgccatggaaatcgctgaagagaaggagaaggctaatctgaagaagatacaggacgtcctccgcaatgaacgagagaacatcttcaacatccgtgaaaaacccgaggacgtccttaagcagtaccacaccaaaggctatgctgagtacgaggttgtcgttgacgatgacaagggcgatgaagacaataaagttcatgcgcgagttgctccccctggccgaagaagattccggaatggggttgccatgaagaagaatcagtcaggaggaggaagtattattaggaagataaattgaaataatcgtctttagtgtttgacagtatttgacatgtatacatcttagttgtaggggaaattatattttcccttctatttattagcatatagtaataatagtattatggtttgattatagtcgtgctaattgtattatgtttcaatcttgttcagcattgatccatcatctagttcagggaatctgaaactacgtaccctagactgaaaagtcagagaacatagtttgttttgactggagtagttttgttgactgcatttttaggaataattttgaaccccttgcaaaagctcgcctgaaaaatgttatgtataatttggaacctctacctcttgcaaaagctaagctggtctctgttgacatttttcagagttgcatgataaggattccgatggacaaaactttttgacagtcatatgagaatggcactctgctaccatatatgtttctccaaatgccaatgcaagttggattaacacctgaaatgaagaatgagtcagtcaggcagtgtgcttgagactgtcagacatattttttagtttagtttgcaaagttattgtagctatcaggtctgtctgatcacaggggcaagtgaaagtgtgaaaccgagcaatttcttcagttcccaacagcaaatttcttcagttgcttgacaagctattactttctcctgaatcttttctagctaacacatcgttagcaagggtgggcgtgatggagtatggatggacctggattttggtctatgctgcttccggatttacctaggcacgagcgaggattgcccatcgcctgtatagggatgggggtgaaagtggaggtgggtgtgttggttaggggtggttatatggagagttttgtcacgatttcccccattgcagtatcttggtggtacttcggggcatggtaacatgtgtggaatcttgtcttgcgggtaaagttgtacacctctgatcagagtaaaactattcgaatagccgtgcccgcggttattggacagtcaaccatctcaccgtgattagtctcaccttaataatttgacttaatgaactggtgtagtttaggtggtttaggtggggcctgtcgcaacgtggttttagcgttggacagtcatgaggttaatactactaaattatattctgctttactgtttttaacttatgatttataaatgctacttttactgcaaatatcctatgagccattccttcgatatccttgcatcataccttctcattggtatgacttgttgagtacagtggttgtactcaatcttgctttattttcccaatccccagaggcagtgaatttgtcggatggtgagttctatgaagattagacttgtgccagacgtcgaggttttgcctggggattatgggggaagcttctctttgccgagcatattaagtttagatgatctttagttttttccgctgcttttctgagtttattttatatttttgtaagacatgaaactgtatcaaattatcatctgtgtactttggttgatgtctggacagagattaaatatacagatagccggtgattcgggttctcgaatctcggggcgcgacacaattgctcacgaaacggttgtgcttataaatctaggcagcactgggaaagtgaaaaaagccttgactcctcatttgcacagataattttttttagataatggaagctttatttagactcagttaattacatcaagatgattttacattaatagtccaccaaggtttttattttctttttattagcaacggaacgggtataattttagactgccagctttttgggggtggtgtggctgaaactaaagtcagctttatagcaatgagtgatacagtgtgtaccaatcatatagaatgaatggattggcttttacttcagaaaatcatccagtttcttaagaaacatcacaattttgtgtcgcatttgtgctaaatattttagttagtgaaacttgactgtattaatttgcagatggaaatacatgtcagatgctgcccttcattcaatcttctacatatagtctacgaaaagtacgtatataatgggttacatagtatcatcgtacatatgtgcaggaccagtttgtaatgggttgtatcatcattaagcaggtaccgttcttgcgtttatactgtgttttttttttaaaaaaaaagtttgtaatgcaattatttaattggtagataaacatgcacccgcacgtggctcagacgcagacatcagatgctcttggctatagcttgcagcggggtggccatggtcatcgtcaacccaagattctccgacatgtccacaccattttcctccacctccaacgggagcgtccactcgaagcgatgcagcagcgaccccagcattgcgtgcagcatccttgtcgcgagtggcagcccgaggcagacgcgcctcccagcgctgaacgggatcagcccgaactccgtcgtcgccgtacccagggcacggccggcggcctcctggccatgctgccggagcatgaacctctccggcaggaacctattcggctccggccacgcctcggcgtcgcgatgcacggcccacaggttcaccaggatggtgctccccctgggcacgacgtggccatgtatctccaccatctcctcggccacgttgggcactatcggcaccaccgggtgcagccggagcgtctccttgatgactgcccggaggtagggaagacggtccatatcggcgtattcagcatgagttttggagccgagaaccttcttgagttcttcctgtagctttctcatggtctctcggtcctgtagtagctctgccattgcccactcgagtgtactcgcaatcgtgtcgactgtcgccagaaatatgtcctgaaattgatggatttaattggattaattgttaaaacaattactacgatgacattaacgaacttattggtagtaaagggacatagttggaagttggatatatatgtccctgtatttcttttatgttacataaataattgatgttacataaataattgtaaaaaaagttggcaaggaccccctttttcttcctcgcctctcttgattcggatctgtcggatgtcaccacaataggggtcctcgccaagcatatctactgtccatctaattcagacctgaagctcgtcgatatcgcatgacaaaggcctaaagagaggagcggagaggggaagagggtatgtttcagtgacggatccaaaccacgggccacctgggtcatggcccgtggcccggtggataaaacccatgttgacacgtgtaaatttaccatgtatttgatagataggccaaaagtataatgggctggctcggggcctacccaaattctgggttcacgcgaggatgttgatgctgagtggaataggaggaaaaggaaagggaccctgttggcggcgacattctgtgcactgttcaggcaatggcagagccatcagcatcagtcatttttgcaaacattgatcacactcgtagtggaggtgacagtgatgaagcctaggcaaccacttgatctaatggagagctggcttcccatgcaaaggaaggcgtcggggtaggactgcatgaccacaaatgccatcaagaagagaagataagatagaaattcaactaggccccagtatgaattttgtttccgcgtcggatgccatgtaaaaccgcctctaatttgattattggtctaggctaattcactatttgtcatcctcccaaaatacacatacccaaatgccactctcccaaatttttattctcaggtaatcagacccacatgtcagtcccccttcccatttgctgaccttatggacccatgtggatccggggaggaggcggacatgtgggcccaggtggcaaatatgaatgaaaatttgtgagagtggcatttgggtatgtgtatttcggaaagatggcattctcgtggttacagagggtgtaaaatattcggtacagtagttacggttgtaaaccagactttaatccacatactagtttttttttagaaaaattcatagatatttgcatggtgacttttctggtaataaaagtctatatataatttatacaaccaccttgattaattatttatattatgctagtatggtagaactcatgaattactaattttccagctataccttttgcaaaataaaaaaaatccaactaaactgcaatagcagcacacggatttattggtatctatagtacccatctatcttaaaaaataattatttccatctccacgtttagatcaccttactaaatataatacatgcacggtaacaacccatccttcagaactgtgcaacctagcctatccaaccgacgggccaacttatacatagcacctcacttacactatcgtcaccgctttatgtacaagagttaacccgaaaatgatatattatagttagggagacaatgtcttataagctggttctactattactcaactagcaatgtggtagcaaagagcacacgacactcatgggtcacacatgtcgcatccttattgggcaagatattacatgcacccaataggagatatcttgaggatgtaggactaacaaaacaaatttaaaagaaagggatgtatgcatgtatgcacgatttgtcttatgaaatataaaaaaacgtgtttattactctatattttaggatggagtgaatagttcttttttgaaaatatcacacgtaccgtactaccccttttgtataataagtaaagattaaaggcaaattttgtaatataacatcatgactttgcaataatagaactactcagtagctacaaacccacttttttttccttctctttcttttatctcacttatatatttaatgtgacaattgtgcactatatgtataaagtcagctcttacactagaacgaccaatctttatatattttttttcttcatttgtggttatagctgacttataactatatacctgcagatacctgcaaatctgcaattgccactaattaattgtcggcgtgtgtcatcatgtagcattgaaaaaaaaaacgtacgcgagagaaaaatatgcacgagagaaagaaatacagtttggtgctttacttacagtgagaaatgttctgatcaggtctctgtcgatggccaccttaccgtcgtccttcccatgctccgacatgtcgagcaacacgtctagcaggtcgtcctcgctcctggcctcgccgtcgtcgccagctgcttcacgccggcggcgcatccgccgctcgatctgctcgtcgacgaggtggtagaccgtccccacccgcccggcgaagcgccgccgcaggccctgcaggtcgacggcggcgagcgccggatagaagtccgagaggttgggcttcagcgacagcgccacggcctccctcgccgcgtcctgcagcacgcgcgcgtcgtcgtcctccaggccggcggagaacatggcgcgccactgcatgtccatcatggccgcgaacgcggcgtggccgacctgcaccggcgctccggcgccgccacccgacgccgccgacatctccgacacgcggcggagcaggtcgagcacagcgtcccgaagcagcggcaggagccgccggccgtcgagctgcctcgccgagagcaggtgctccgcgccgatcctccgcagcgcgcgccacttgcggcgcggcgggaggacgaacacggagttggcggcgtgcccgacgccgtgccacgcgtccggcgggacgcggccggtgaggctgccgttgtgcgtctggaggacctcgcgcgccgtcgacgaggacgaggcgacgaccgcgacgacggtgccaagccggaccgccatgagcgggccgtgccgcccggcgaggcgcgccagggagcggtgcgggaggtcgctggcgatgtcgaggaggttgccgatgagcggaagcggtgttggtccaggtggaagacggcggcgggcgtcgccaaacagttgtaacgcgtatgaaatcaagaacatgagaagaagcgagcacatgcagacgagcaagaaaaccatctttctttttttcttttcttttttgatgactaaaaactctgaatgtgtttttttgacagaagcaggttaccctgaagctcaatttatagacgaaaaagggacaattccatctacataaaccacaaatatttcaacggtaacaattaataccacgaaattcttccacctttcagaattaccgtaatgggggattgggatcatctgcagtaggaatagcgaccgcaagataaaccactgcatgcgatttcagccgtccattttggtgatgaatggaccagatcatcagctacagtactagcgcaaaaatactaaatatttcttgctacagtgatctacagtatccgggtgcatgtgaaccgttagattcggatctaacaggtggcaatggactgcataagttgcagtcatagtacaaactgcacctgatccaaatcccgtaatggggaagtgtttttttcgaaaatataccacaaactttaccaagattacagagatgccctgggagcaagattgggacgggttttcaatctcgatcattgccggcggcagcggtagtgtgtaggacagcaggaggcacacctggataaattttgtgcagctcgctgtccaggaactgacgaatcaattggctgcaatgcagcatagaagaacctacacgtgccctgatgcccaggacgcatgcgcctaacctgcccgaatggaggccgtagcactctcggcgcaacacggacgccagcggtttgcggagggtacgattgtggaggagaaaagtggcatcaggcgagatgtaacactggctcggtccccctgctcagatttcacactgtggcggccggcggcggagcagagaaatgagtgagggctgcatgagcgaatcagatgagagaagtagattgtgggggtgatcccatcgcaaaactaactccgtcattctcccgtcactccgtcaattttgtgctaattctggcaagtggaaggattttgtggtattatctggtaccattgaaacctttgttgtatggatggaattttcccgatggaaaactaactttgcagaactgccactggctacgctctagaagtcaggatttacaaacttccactttccaacctcatatgtccatctacatagatagcagttcgttcgccaccatttaagttcttcggtatttatgggtgactggatttgggtacattctatctatttgtttcctatagcagcattgttcatgcaaggtttgttgtttgtgttgagctcaagctccttagattcagtggcgaactccgtggagaattcctgctgagcctggtgaagcccacaagaaaatttgtagttcatcaacaaaccttcaattgtgctttttatggaggccaacaaaagggattacaggttattaagcggtgtgtatgttaaaggaggcctaaggatgcaatagttgtggcaacgttgcaattccctatcgatttgcacctctattgttgcttgatttcaataggaagtttgcaaccttagtgtagtttcctgttcgttggaatcagatggctggttactttcagctaatcaatttggcgatgtactaggatttgttcccctaaactctcttattatgttattaatgaatgttttatgtttgaaaaaaaatgaggtatatgtatgcacgtgttgcacaatccatggaaaccatccatcgatcactagtactcttcttgtcggtggctcccagtaattaaatttgggaaatcttgctagtgacgatcaataatagtagtaattgagtagtacggtgaaataaaatctgagtgggattgttgtgatcgtgatgtagtactgtgcttattgttgatgggatttttattagttcatcaatacaggggctgcaaggaagaaaaaacaaaggcaactgccaatgacataagcaatcccaatggtaaattggcaatcctattggtcgatttcagggttggaaacctcgatcttgtgaacgagggtcggctctatgccgtaagtcagtgtatactgtagtcagccctttgctgccctattcccatcttcttcaatttccctctttcctcttcaatgctaacctagtcctcctcatccacattctattccacattccctcgttcaatccctcttccttaccttcttcttccccttcctgttttgttctgctttggcgttcgtagggggtcatggatctggatggggatccacccctggaggatgagcatgaagtagtccactctcaacttccagagattgccacctctctggaagcgatgacaatcacaccaacaaaggagatcagagtgaggttgcaacagtctcctgaaacggcaacagttcaagccactcacaacctcctcatgaaggttggacattctggaggccagcagaggcagatccctttggaggctttgaagaaatcaatggcaaaagcttggcaaagagtttatcttgacatctctcaggtagaaagcaatctctttatggctcattttcgtaattatgaagatctgtcctgggtttggcaaaagcaaccgtggtcttttggcagtgatgtttttctgcttgaatgggtttctttggatgagaaaattaaacctatgtcagcttacactttcaagcatcttatggttaatgtgcgtatctatggcattcccccaagtcttagaaatgttaagaatgtcaagttggctgctgaaaacataggtcaaatctcaaaagctgaaccaatagatccagatagtttgctgaggaatcagaaatttgtttctattagaatcaggattgatgtggaaaaaccagttcctgatcatgttatcttggagcttcctgataaatctgaacttaaagcttttctgcattatgaaagaactcccataatatgtactttttgtggtctcctcttccataatgttcaggtctgtcctcaaagacaaagaattatcattcaatttccagatgcatccgaggaagatcttaaagataaactaggaaagtggatcactcagatcgattatatgccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggttgcagcactgttcaagggcccccaagtcaagctgttcacactaccacagtaggcaaacaatgtgagaaaaaagacaaagaacctgatatacaaagtacaccagaagttggtaccgaagagatgttagtacatggaagtacagagaaaaagaagctggtttcaagtactatagaggatcatgtcagctgcaactcaaagaatgtcaatactgctggtaaggtgcatcagatggaaccagtccagtctgttccattggttcaccgagtttcacccagtgcaagtgcccatcagaacagtttagttaaccctgctattggcaccaacgaagtgcaacacagaagaagcacaagagctaccaagatttatgagacagcctcacaacatttaagtaagaagagagggtttcatgaagcagcccatgaatctaccaaacgccattgctccccaactacttcagctacctcttccttctcgattgtgggaggtgaagaacatggagggattgaatcaagaagagcttctccaactaaccatcattcagcaccaatcagggttccaagtagaagaggtgggcagagagctacaagatgggatcagagaggaggttatggtggtggaatggtgacctccacttcttggagacctcttgctgctgctcattctgatgtcattcaaagagatgctccaagatcccctcaaagcattaacaattttcatagcaggaagcatacttggagtgctttggaggtgcatcatgatatctttgttgatcaagctgctggagatactcaagggggtggtgcaagtgatgctggagctagctccaggctgatactggctacagatcctagggaatgcaatgtttcagagattcagcttgttgatcccagtgctggaaacggtggagatggaagtggaaagaatgatggatgggcaatggcgccagcccataaggcgtcaagggcgccatgagtcttttaagctggaactgccgaggtatggggggtcacctcggcagtaggaaaatgccacacctccaacgcctaatatactctactaatgctaaggtaatctttatttcagaaacaaaaagctctaaagtcactgcttctgatctgatccatcattttcatgtagctaatagtcatgtggttcctgttgatcaagcttctggtggtctgtggctgatgtgggatgaagacatggatcttactatagttcagtctagtattaattatatcttagcttatggagtctataagaactctggtcctattttcaatcttctttgtatttatggtgatcctagtcacagggccactagtgccatgtggagtgaaatctcctcttttgttgtacatag

SEQ ID NO: 8004 - DNA, 1949 bp, Oryza sativa
gaaggagaaagaacagaatctctagtgttatccataataattgaataatcaatgatcctgatgagatagcaactgtgttcacttcttactttgaaaatctctttcaaagatccaatacagatgatgccactccttctatggatcaaaatgacaatgatgtaatttttcctccccctgaaatcccttctgaaaatgacatcctagaaattctaaagcaaatgcgaagagatgcctccccagggccagatggtctcaatgttgcattttatagagctgcctggaattggataaaagacgatgttactgccatggtaggctccttctatgaaacaggtaagcttcaatcaggtatgaatgctactaatattgttcttgttcctaaaaattctaatcctaagtcccctgctgattttagacccattagcctttgtaatgtttcttataaaatcattgctaagtccttggctaattacattcagaataaacttcctaaccttatttgtgacactcagcaggcttttgtcaaggggagacgcatctctaataatattgtgcttgctcaggaaattgctcactctattaatctcacctcttttaatcaaaaagcttttcttttaaaaatagacttgtctaaagcttttgacaggattgaatggagattcatagcggacgctatttgtcgtaaagggtttcatgctaatttcgttcgtcttgttctttcctgcatcaactccgctaatttttctgttgttataaatggtcaatcgtacgggtacttttcagctcatcgaggtattcgtcaaggttgtcctttatcgccttatctttttgtccttgcgattaatgaactttctgaccagcttgcagatgcaattcaaaggaaccacatttcagtaataaagttaggacaaaatggtccttccattcattctctgatgtttgcagatgatctaatcattgtggggcaggcccaacaagaggaagtcaggaaaacctctgaaataatcaattccttttgtctcagatcaggccagactccaaattggggcaaatcttccatcctgttcagcaaaagtactcctgaagaggtaagacaaaatattcttacaatctttcctgtttctcttatgaactccagcacaaagcatctagggcatcctcttctggtgagtgcaaaagacagaaatgctgcctacagtttcattgtcgacaagtttaaaagcaagcttactacttacaaagctaattctctttctcatgcaggtaggcttgccctcattaaatctgtctttgcttccattcctatttattacatgtccatcatgcttttctcaaaaaaattgattgctaaactaactgctattataaggaaattttggtggacaggaattcaagcagatggtggcaaaaaaggaatggctcttaggtcttggaaagacatttgcaaacctgtttctgagggaggcttgggcataagagatttgatggctgtaaataaaagtatccttgtccaatctgcctggagaattcttactaatccaaatgatcttctatcctctgtcctaaaatcaaaatattttccaaacacttccttttggaaggctagaacagatatgccaaaatctgctttctggtcttctattcttcaggtaagggatgtcttggaggaagcttcagtgtggcaactttctaaaggtgatatttctatttggagccaaccctggtgctctatttggaaaaacattcatgatcatcttaatcttgataatcttccttttcacatgcctgataaggtttctgatctttgggatgagaataagaattgggatgctcagaaaataactcaaatttttgatagtgcagctcaacattcaattatgcaggttcagattatgcagggagaggaggaagataggctttgctggaagtacacaccctcaggagtttgt

SEQ ID NO: 8005 - DNA, 939 bp, Oryza sativa
cgataccctggattctttttttaagcactgaacagtgaataccatggtttaaaatatgtgttatgcaaatataaagttacataagaatatttttttcctgcattagaatttatcaatagcattactctcttaaatatatataatttattccatactgtgttttgtgatgaactgttaagacttaacaattggacttatatcattgtgttttatgatgaattgttgatcgttgggacttgagaattggatttgttagtttgaggggtttttgtattccgataaattttcgttaccgtattcgcgccggttcgttttcgctccgttttcggtttccgacggaactcggaatcggtcggaaattttctcggaatttctgaaaattttgtgactgcgataccctggattctttttttaagcactgaacagtgaataccatggtttaaaatatgtgttatgcaaatataaagttacataagaatatttttttcctgcattagaatttatcaatagcattactctcttaaacatatataatttattccatagactgtgttttgtgatgaactattaggacttaacaattggacttatatcattgtgttttatggtgaattgttgatcgttgggatttgagaattggatttgttagtttgaggggtttttgtattccgataaattttcgttaccgtattcacgccggttcgttttcgctccgttttcggtttcgataatatttgattccgtttttttatccgtggtttccgatttaaaaaaaagaaaatggaaatgataaaggtggttttcgtccgcctccataccgttttcacccatatgccgtatacatggtgaaaaaaatccagtggacctaaatgtaaattacaagttctaagaggttttttttgttataaaatgcaacgttccatgacatgcagacgcgga

SEQ ID NO: 8006 - DNA, 565 bp, Oryza sativa
  unsure (1)..(565): unsure at all n locations
attcctgcaccccatctatgcaaaatgtgcacttctcaagttaccaaataaacgtgcatctcgtagagcatcaaaaacagcacgcaaatgaccatgatgatcctctattgatctgctatatgtgagaatgtcatcaaaatataccaccacaaatctgccaatgaaagcacataaaacttcattcattaatctcatgaaagtactgggtgcattagtgagaccaaagggcatgactaaccactcatataggccgaatttagttttaaaagctgctttccattcatctcctaacttcatgcgaatctggtggtaaccactacgcaaatcaattttagagaacacaagtgaaccactcaattcatcaagcatatcatctagcctagggataggatgaacgaaaaatctgaatttttaattggaaatggggtttttggggtttacccaaaaaaaaaatttttttttgggggccgtctacaatccacacacatgcgccatgagccatctttcttaggaactaaaagcacggggacagcgcaaggactaaaaaactcacncacatacccct

SEQ ID NO: 8007 - DNA, 671 bp, Oryza sativa
cagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttcattatatatatatatatatatatatatatatatatatatatatatatatatatatattatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaatccatgggtgtgcggcggcacaagcaacgagagagcgaggcagcggtgaccttgtatgtgagggaggtggacgctgcataaacaccatctttaaggcaggagccctcgagtgaatgattgatgtgagaatttgtagctgctaaataatatggaaaattttaacctttataccttttaaaatcaatgtgggg

SEQ ID NO: 8008 - DNA, 1661 bp, Oryza sativa
  unsure (1)..(1661): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttatggtgtgcttccacaatatttgaagtgttgtatttaatgtttagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatggatcacaaacaagttggttatcttcagacactgattgtgtagaagactactaattcaacatgcctgagagattatgagtaagagttttagtttaacatagcaaaacttaagcatgaacggggatgtagctcagatggtagagcgctcgcttagcatgcgagaggtacggggatcgataccccgcatctccacctgttgttgttttcatttttgaaaaatgcaatctttagttttcttccatgcagcaatcatgtaaccgccgcatcatctacattctcccaaattattttttaaaaattgattcttgtttgtttttcttttccaaattgaaaaatgcaatctaaagttgtctttcatgcagcaatcatatgtaaccgccgcatcatctatattcttccaaattgaaaaaaatgcaattagcagttttctttcatgcagcagtgatccataatatacctgcaccatctacattctctgatcttagaatattaacaaacgacagcataacattcaacaaagttctgttgataacagcactgcaataacgatctgtttatcacaaacgcccgaagcaaaaatacaccaaaaatgctggaagaaatgttgtggtcacagtggaatcaaattattgagaggtcctcattcatcaacgagaaatgcatccatattaagtcacaattacagcattcccaaaaaatactcttatctacagaataggggcctgactatcagctgacaaatttcatcaaatcaatactaagtgttttagtaagttatatatgctggtgt

SEQ ID NO: 8009 - DNA, 6446 bp, Oryza sativa
atattattaaagtggccaatgcaaaaattacatacagttagtattttagagttatgacaatccaatgagaaggaaacacagcaccaaacaagtatggagtagaaatctctctcagcaaaaacttcaagcaaagtctaaaggagaaaagttcagggcctgttcggtaggactaaatttggctgcaatacagccatcagctacagtactgcgcatacaatctctacagcagcagcacagctgcagaagtatgacagccagacaggcccttagtaatcataccatgcaataccattcaagaaatcgaatgagaagtctacacagcctttgaattcatgagtaatcaagtttaaaacaataataaataaaatcaatttgttaacatcccaaatagcacaactggctaccacaaataatctatcagcacagcgaaaagcatgagaacatacccaacaggcagaggaattggaagtgaaccagtgaactctccagggccagcaattttcagagtagatccaaaaagaatgttgcactcactgaggaatgaaacagtacagaatggccgaacaaaatcatgactatcaatatgtggtgggatgcaatctccagggtcatatatattgacaatacaactgtctggtatgcaagtctttggtagaacatgccaccgtaccaatctcttgatcatgatcttaaataagctaggcatcggatcagaagcaatagttcgaataatgcctggtgggtttccattcttgtcctgtcatcacagattcaaaccttagatggattcacatgtgaattaaatcagtaccactgcagtatcaagctgatgggatcagaggataaaactagagtatgtaccgtggcataattataacagcatccaaattggattgttactcgccctttaccacgcatccacctttggggttccgtatacgtacgatctgacagggggatattatgcttggatttagatatacaaaaatacaaataaacaaaacatggcaaataaataaatgcagctgtgagcccaagaaaattcatgtgcgtatagcatttgtaaagcagaaagaaggaccttggatagcactaaatagagtaggcttcccaatatatagtatacactcacccaaataaggatgagaaattctattccggtccaatggcctaaggtgaatcaaacaggcttaggtgcttcagggtactctaaagtgtggccatttgttagtgttatactgggccctcagtagataaatagtgcatagcttgaatattaaattaattaaattgaaaagaagaacgcagatatgtaaactggaatgaaggtcaggcatctcactcaacatgttacatttacttcaatcgtggttattgtggtgtgcacgactgtaagaagcacagaaaatcatgcatgtctgttttaatatccatgctgagaacgcttatgcagcatataagcaaagaaaccaaaaacactcagagattactgtaaataatacattgaaacatattgaggtttacacaaatggggaaacaccattatgacagaatcatgtgtacagaaaacaatgaaaatgttttgctatccgctacgcttctcctggacagacagatttcggcagatgcttctgattgtgtagtagggtgaaactgtgttatttttgtcaaatatggctgattatgttatgatggcaatacctataatttatcaaataccatatttatcttcctgcttgaaatcacaaaagctaatctgctacttgtggtaggtagatccaatgatttagtagaataattaccaaaaaagtttgtagctttgagtgcataccacatagaacaagacatgagaaaaccaattttataataattcttcggctttctactttgcacgagaacactatacaagttccagttctacacgatagaactactgtggtgcatatagacatctaaatgtttgcctatgatccatatccccacaactaccatagcctaagtagcaaagcatgaccttaattacagctaaaacctttgcctaaaatttacataatcctgacctaaaacccttttcatcaagcatttctcaaaactcaagactttacatgaaaatttagccaaattcaactagcgccatagaaaaacatatcgaatctccatgcagcttaaatctcacctccaagctccccgtgcttgcccatctcctgaagatcgtatacgtagtcgacaatacgcttctgttcggccgcgctaaacacaccgcaatgaagttccaggccagcgaggatattgacgagccgaccattgaccctctcaaaacagatgaaatccttcctccgcaccacgttccggaaccgcctcagctcccgctgctccctcgtcagctgcacacccggcctaccagcctcgctcccttcctcgccgtcatcagccgcggatgccgccgcgtcctcctctgccgcggcggagagctcgtcctcctgagccatgtctgcccacgacttccgcgggttctccgccggctgagggttctgctttgctgctcctgctccggtggcagctgcggcggatccgagtcccatccgctgggcttgaacggcaaatgctgcgggtgagccgtagccggatcggactcccaccccgagggctcatgctgatcgatccgcggcggcgggcgacgacggggattcctcggctgtcagagtcgaggtgaacgggggggcgtaagaggcaacagcacaaaaaccctaactacggcgaacccagcacacgggattgttaccttgcgggggcagcagggaggagacgcggctgcggagggagtcggcgcagaaggcgcaaaggcccgcggagaggaaggggagccacgtggtgaggaactccccggcgatggcgagctcgtcggcgttgtacccctgcacgagcgccatcgcgtcggcctcgccgccggcggaggcggaggaggaggcgtccatcgaagcgtctctcgctgccgtgtgggccccaccctccctgtgcctcgatgtgataactagtactagtacccctagcttctagttgttggtatccggataatcctggccgtccgttgtacgatcggacggtctcgctggtgtgtgggccccacctcgctagtgctctacttgttggtatccggataatcctggccgtccgttgcacgatcggacggtcaggatcggactcagcgaggagaagaggagaaaaatctcgagatgaaatggacgcgtaacctgactccgattcggatcccccaccggcgagatggcacgcggatccgccgccgcggcgatcgccggagttgtgtggtgcttctcctcctcgtgggggtggcgtcgggggcgcgtcttccgggcgggagcgggggtaaccgggggcgggagccgcgcgggggagcggcggcggcggcggtggccacggagacggcggtgttcgcgctgggaagcttctggaggtcggaggccgcgttcgggtgcctccccggcgtgatccgcacctccgtcggctacgccggcgggtccaaggcccgccctgagtaccgcaacctcggcgaccacgccgagtgcgtcaaggtgcggtgcggagactcccacgcttatagctgttcttgatcgataccatgaaccaatgatatgtccagttccatggtcgtagcaattcatttccgtagttagcatcgtaatctgattggccattaccatttcgtatgtgtaagttaaaaactgaaagaaaatactcgcgagttttcatttccatcgtaatctgttttttttgggttccaagtttcattttcattgctaaatagggatcatttccttaaaaaaacaaaaggaatgttctatgttcaacaaggacgattcatcctgccagatctgctttttgtgtgtattttttgtgcataaaccatcggaaatgtttgtccgttgagtgcttcattcaaatgcatgtgtgtgtgtgtggtgtaggttttggagtggtaaactggtattaatactttgcagggcctccttataaactaactttgttggtgttttatgagctaagatgattgacatttttgagtcatttaggttgaatatgatccccggttgattcagtacaagaaactttgagaggtcttctgggcaagtcatgatccacgagaggtctttgggcaagtaccagatgttgccaagccaatacaggtgcgttagttttattagcgcacccccctatgtgcaatagatcagtttgttcacagtttaccatagtcagctttacattcataaccaggtgacaattttgtattcacatgtttcatgtaaaacttagactggtttccaaaccagcatttagcatatggtggctgataagtttcacaacaaagcgactcagaattgagaggcgtgcagctcatttcctcgccttagtctctccagccccaagcaaggacctatgtgttcacaacgttgccatcatggcttaggaaataatgggtcactgcatggtgtagctgtcattctcactagtttgataggatcctcagacagcactgtaatgcgtcaattttaattcttgcttacttatgtggtcacagatccatcatcttcacaaatggatccgtggaagctagattggctggtctaagcaaagaaaaagaacaagctaaggatcgccgcagtgtcattaccacacagatccaaccaataggtgcattttatccggctgaaccggaacatcaggtagcaatcccatctgaaaattcgaactcaccatgacattctatggtttatttccttttagttattgcttgtactttggtaaaaatttgagctgaagcgcaagccgtttctcctgcaactgattgggaacctgcccgaggaggagctcctgacctcaacactagctgcaaagttgaatgcatacgctgctgagctctgctccccaaatacccagaacagaataaactccaagattgatgagattgctaagaaaggatggcccatcctaagagacatttagctcggtgttcctgggttttacatattaatatatcattatccaattgtgcatgattttgccgcaaatcttgtccagatgactggttgtggtcattccttggtcgcagcaatcactaattagcgttcatgtcctcctctgctcattttgagatctctctaatagaatctgcatgtatatccaaactttcgagttgtgtgatgtgacctgaaatcctgaatttatgattggttcttacagaacaggtgccgaaattgtatattgttactctggctcttttatgtgtaaaaatatatgatgtggattcattacattcttaatcaaaaacacttattcccatggaatgctaagaattgttcattcttttgaaaacaaaaatcacattttgttcttatggattttttttcacagtttgctcttcggaatgagtaatgggctaatggccacagtgaaatggcgccagcaacgctatactagatttttcttgatggtacaattgcatggaacacacaatctacaggtggaacataagaccctttttttgggaaacatttcgctattgttgcaacctcacacagctaagcagagactagttatttacatgctccatagaaggaagagattattttgcaaggctatttctcagaaacattctaaacaacaagtgaagacacaaatgcacaatggtcagaggccactaattgggttgctgcttgactctttttgaaaccgttcttggccaaaccatggcttatttcctttttttttccccattttcatcagtcctgccaaaagcgacgttggcctgtcgttccaatgcttccctcacaaaaaatttcaacctccaaagggttgtctcactctgcacccgcataaaaagcatggttagaataaacaaattacccaaattattacgagaggtaagtgtttggacagcacatataaaataccttgaccttccttatcaagttccagttcgtcttctttaactttcaaacctagggttgtcttgggcaaccatttccaatgccttataaagcttttttggaaacagggggcaaaaacctgcacccagtttttttttctcatatgtagtcattttcctacaacatcaagattttggcaacatgccacgtgcatgagtttgacagcagttgcaacttataaacagcagataattaaatcgataggcaacagatgaacatttgtaagatgtaccggcatttctggaccaccatttgccgaagctcctccaactgcttgttgatttcaatcagctggaataagaaaccaaagaaaacacacttaatatctaacatatatcagaacattagtacaaggaatgaagacaaggagttgcagcattttgtgtgtcagccttctagaaaaatcacaaaaaggtatatccatatgtcaggaactcaggatat

SEQ ID NO: 8010 - DNA, 7546 bp, Oryza sativa
gcttacaaacattcattcacctcattttcaactttaggaagaagctggagccatttctcttcaaatttctcaagcaatgatttcgccattatatgaacatcatgtcgttcatcattgtacttcattgcattggcaaaaattaatctaacatccgaatatatttctcggacattgttatacttgttgtcatctttcccttccattttcttttgtatggtcgaaaaatccataggtttggtgataatctgtaaataagacaaattgaaaacataaatatcactacaaactcatttcagggaggcataatatagtagtagtagatgtccaaatcaacactgcttgacaagcgcagagcaataaatatcacccaaaagaaaaaagaatgccatttaactgagatgtttatatttatatatagcaattggaggtctcctacaagctcccacgttaatgctattaggggggaagctggaacacattagcccatgaaaaaaggggggggggagggggggagtacaaataaccacattaatctgaaaagggaaggaaaagaaaagatgctaagcgttcatctgagaaacccatggatactctacaatagaacagatctactgtgtaaggaaacatctgattctgctagaaaaagaaaccaccgagtgatgtacactataagcataaaagaatcaatattaacacaccatctttgcatgtctgatttttgcaggattaagcaataaataaacagatagtagaagaggacaaggtagtaaaaaatgcctgacgcgacctgtgaaacatgaaacacaatccaaacacgcatagcacacatgtgcatagctgcgaatgaatccatgtttaaataggaaacaaatcaacaaagcaatcattagacaagagtacagcataccgtgcggtcatacctagttagcaagactctgcatagtcactacattgccaataaattaaacctacatggactcaaacacataggttctaaaaaggatgtactttataagaggtatttgcatctataaaaattaagaacgtgctgtactatcacaatattgcatatagtaggatagaatgcgtacatgattattatgtgccatatatgcagatggaataaatcattcaaaacatttgaaataaaacgggcaagaaactttacaatttagaactacaaaagtaaaaatatcaagggatacaagaattctaaaaattatctgaaccatcgaaatatatgaactctaacaagaaagaacaattataagttcaagattaatcaacagaccatctggcaacaaatgttggtgcctgagccaagaagagggtcaaaattcaaaatgcaattatttacaaataagtcagcagaaaccatgatagaattagatttatacaatttactgaagattacaaaatcgagttaacagtaatttattgccgcacatattcaaaccagaagaataaatacagaaaatgaatttactttccactatttgccatattgaaatgtttgaattaaaagcttgtgataagtttattatagcgttaatactaaagctttggtccaaaataaaatcaaaggttgtgtttgactgattagaattcatacatgcatgttcttcaacaataaacggacacatatacacacacaaaccttaaacgtgacacggtagataatttgttatagatgtataattactagctcatgtgggtgcacagattctgactagttcatttaatcggttaccaagaaataaaataagtgtccctaatattgcaggacacatattgccaaatctgaaggatgcatccataaaccattaggattgacaaatcaatgctgcattccaagagtccaacatcattttggtcgtctgtaatcctaattcattatatcagtgtggaacagtgtcacaagtcgaacaagcgaactcagggaagagagaagagggggttcactctgctagcaaatacaagatgaaatgtgctagcagtattaccttgtaatagtcatcaagctgaaggcctaccacatcaaccggcttgagaaatggctcggcccattcatgagatgtgatctggaagaaaaggaaatcaagaaaaatattgagtgcatatcatgcgcatttcatttggaaagctagtagtgtgttttgagtgtcgagttcaactacgatcaatcaatatgaatttgagaggaaacaatggagcaagaccatacaaatttatcagcatatcatcaagctagatatatctgtctattttgaaggatgttttctatacatggttatggagcaaaattagaatcaaaactagcggcagaaatcttaattaaactgcacttatttatcattggaaataacagtagccacacgtgcacaagaccggacaataaatagctttctagattttttttcagttagacctatcaggtacagtagccatgcactatccaaaattagcctgcaaattaaaagcttttgcaccaagcacattctgaagcatgattcaggatacactaaatactttgagttatccatgccagcaagcaagaacaacatagatcaatgcatttgtcggatttttcttttttttttttcctctcgagatgtggttaagaaagatcacctggcgcacaatcgtgccaaactggcgcataagatcaggcatccctttggaaaggctgctatccttgcgaccagccttccggccaccactgccatgtttcttcccgtcgtagaatcccaccacttcattcaccctcctctccagctgcaatccacataaatctccaatcaaacctctacgccccaattatccgaatacaataaatgcaaaacaaagaaaaaaaaactgtaccctactgtttccctaaccaaaatccccaaaaccgcatactacagcgaggcgagaaggaactcgaaaatccttccgctgaagaatctcatctaccaggctaagcagcgagacggactacttccaaggttgggggagttggtatttatttacctggtcggtcttggagacgaggtcctcgacctggcgccggaacgcgtccacctccgtccccggggccctctccccggcggcggcggcagtggcggccgtctccgccgccgccatagccctccctccctccgccccctgtgggactccacctcccggcaccatatctagggctcgccgccacgcgcgtcgccggcggccgtctgcgagcgaaaaaggcgaaaccaccggcgcctcgactcgacggaatctttttttttattttttttcctttttttttgccccgcatctcttcttcccttcaccttccgaccctgtgggccggatgggatgggccatttcctgggccggaagacttcgccctgcaggatgtgggcccaaggtggggcggatggaattgttgggcctagtcagcctcgtgatttgttaacatgggccggagaaaaggctggggcgaacggtacaggggccgtagggcacacgtggaataagttcatatgagttccttaacttgtcaacgaatccgatttttgtccttaaaccccaaaaccagatataacggtccctcaactatcaaaaccggtgcagataaggtcctcgacggtttagatggcgattttttctgacgtggcgcctacgtggctattttgactcggtcttcatctgacgtggcgcttacgtggcaattcgatccggaaaaataataaaaccagtggaccccacatgtcagtttcacacacaaaataattaaaaatggtgggacccacgtgggccccacatgtcatcttcactcccctccttttcttccttttcactccccatctcccctcttttcatctcgccggtggctgctgggaaagaagcagcgtgtgggcaccggccgtgggctccgcccggagggaggagaggagcggcgcgcgcgggcgtcggccggagagaggagagaagcggcgcgcgcgggcgtcggccggagagaggagagaagcggcgcgcgcgcgggcggcggccggcgagaaaggagccgcgcgcgggcgacttctccctctgcttcctctcccgccgcccctgaagacgacgacggtgacgggttcaacgaggagaaggacgagcacctcaccatcgctgccccgcccccgtttccaccgtcctccgcgctgcccaccgacctcgatgacgtcctcttcttcctcctctctccagaaacccacgggtcacgggaagttatgcggccgacggcggtggcggcggcaggtcatcagcaagtttttctacagtgtcgcgaacaacaacataggcagccgcgcaaagaaatcccatttgcctcattccaccacctagtgtcttcctaagaattttagcctgaaagtccatatttccatcgttacataccatctgcagtttaaggtaacaagttaacaagctcaattgaacagaccttctctatgaaggccgccgaaccaacatcaactgatccaacaggaactcctaagccttcatatatgcacacctgcagtgcaaatttccgtggaactacttgcaccgctcttcagcgacctactgcggcgtagacctgccgacgccctggtccgtgtagtcagaccgcatcttcccggaggctgtcacagttgacgacaagctcatcatctgcctcgatgacggcagtcctccacgatgatctgaaccgcggacgcaaggagcaagcgtgcgccgtcacggacgccgcgcgcgctggcgtggctcaacgcgaagcctacgcggtcggtggtgtacgtctgcttcggaagcctcacccggttcccgcacgagcaggtcgcagagctcggcatggggctcgctgactccggcgtgaactttgtgtggggtcgtcggggataagaacgcgtcgccgccgcagccagggtcgcctcacgccgccccttcctcttacgcccacagccgccggagcgtgcctccgccgccgcgcgccgcgggccgctgtctctccgtcgcgagaaaggagatagtaggagagagatgaactgatgaagagtggggagaggaggaagaaaaggagggctgagatgacacgtgggcccacgtgggccccactatttttaaattaatttgtgtgtgacactgacatgcgggtcccacaaggtttattatttttctaaatcggattgcccatgtaagcgacacgtcaatgccacatcagatgaagaccaagtcaaaatagccacgtaggcgccacgtcagcaaaaaccactgtccaaaccgccatttgcactggttttgacagttgagggacctgttgtatctggttttgtggttgaaggacggaaatcggattcgttgacaagttaaggatcttagatgaacttattccgggacacgttgctacttcgccagagagatcctcaacggctcgattgtcgcagtctcgcagagatcaaattgctggcaagaagtggcaagaagttttatttgcggtttttttttttttggcggggaacggtttctttagttcaagtaaatggtagtacaagtgctaaatgaggtggcttatatgttagctagatcgactactggcatggtattcatggttgtatctatgaacttgtaaactctgaatttaggaacttgtaaactctgaatctttatttgaatgaatgagcccaccttgatttaccaaaaaaaaaaatactcactagctgcttgatttgaatgttcaagtgggttgatagtgatggtgaccatgagtccatgaccgtgtcttggtgcccacacgtgacacgacagtatcgctctcgtagtcgtaggcgtacgggtataccaacttggttacaggatactgctcaacttggctgcctttgccaaataactcttcacatgccaaatttgcctatcacccaaccatgtacgtatgatgaactactaacttttcctctcttttttcaataataacttctaactgaccaaacgattgatatgtcaataagccatggacttgttattctggtttctgaagataaacatggaccagctttcaaggcctctttggatcgcaggtgccagatggtttcatctgaaaacgaaaggtaatcaaatgaatcagatctgggtgggcctgttaaactacagaacagaacagatgctcctccttatcaattctgatgatgcgtcggtggatggatcagtgaaagtcagcttcacagaataacagtgcctgactacttgtataatccggtgctccgtcttcataacacagcctgaatcggtgaattgtcaatacgcgctgtgccggtattcaacagaaagacaagtcaggtgctcatgacaaaggaaaattcattgaggacaaagtacattgatcacagaaccaaatgccacttgaacattttcaaagtcagatatagtaaatgcagcaatacgtacagtatgtttgtgatttgattcacaatcggtatggaaatattcatgtttgaaagtaacttacacatgaccatgaatttgtagttgtgaaatgtgaagaagtcttaccctcacaatattgaagatcatgggcaggacttggagacttgaaatgcatggcattacttcatttacatggtagggcgaactagaatatttggttcacataatcacattacagaagatgcacaaaaatgtgaacaggtaaaatcaccttgaaaagaaactttagttgcaatatgacaacagaaaacccataaaatcccaaatcaatcagatgttgcagatgagtgagcaatagctcatagtgtagcgtacagttatcaaaactgagatcttgcattgttcgacaataggctcagagaagagctgtctgaacaataagattgatgctaacttacatccaatggaaactatgctgattaacaataatagtacagacaatcatcatgtccttttcagttcctaagaagctcaatcctcatctcaaactcacaatccatgacagggacaccaaagaaaaccaaaaccccgccaaacaaccgttaagtattttggctgctgaaggtcaatttaccaccatagacaggatacaaagggaaggcaatacaatactcacaatgcttgtcctgaaggccattttgtcacatatgtcctcccgccttacatgcaagatacgaaactggtgctgactttttatcagatatgccatccgtaaacttcaggaacacatagtttagacccaccaagtcacttacctagatcaacaaatgagggcttgagtccaagatttccattgaactacaggccaggagttcagtacattctatcaacatgagaataatatggacagaagattcatttttccaattgtgcactaaccacatgttacaaagtgctaagagaatagagatggcatcgatccacgatacagaaggacaaatcttgtttcatagtaagacacataactacacatttctttgcaaatggcatcgactcgtttattattattatctgttaagaggacacagccatatgacatagtaaaacgtaatgaaaagcactatatgatcgatcaaacagcaac

SEQ ID NO: 8011 - DNA, 1925 bp, Oryza sativa
ggcgaggcgcacggcctcaaggaggcggagcgcgccggtggcggtgacgtcggcggtgtagtcggggacctcgaaggagacggcgacgtgggactgggcggcgaggttgtagacctcgtcggggaggatgtggtcgagcgcgcggcggagggaggaggattcggaaagtcacgtattggaggcgcatcggggggcgcggcgtcaacggctgggagtgcgggtcgtggtagatatggtcgaggcgctgggtgttgaagttggaggagcggcggatgaggccgtgcacctcgtagcccttgccgaggagcagctccgtcaggtagctcccgtcctgccccgtgatgcccgtcaccagggccaccttccgcggcggcgcgagggagggcggaaccgacggcggcgcggcctcgccgttgtcgccggcggcgccgccgttggagtgctgcgtcgtggccatttcaacctgcttagatctggtgggtgggggacgaggcgaggcgaggcgaggaggaaatttgaggggaagagtgggcaacgagggcagggagtatttgtagggcccgcctgcagtgggaccctctacctgtatgtgatgagcgaagtgacgaagacgcaaagtgcaactcaacacgatttttgtagtcttctagggggtgtttggagagaggacttatgttttggagagtttatgtttttgagagtttagcctctctctcccaaacaccctcttacttacacaaacatatatttttaagagatgtgtgaatattatgctcactttatcatgtaaaaaaataacttagtgctggatataacacattatattactatgaatttagacatatttctgtcaagattcgttgtactataatatatcacatctaattataaattctcgtctttttagagagtatggtcgagttgaatttcatgtcgtgctagccatgaccaggcaacgggcactatgactttgtgagtctgatttttgagaaatcaggaaaaaaaactcaaaattcttgcaaacaatagcaatgttttttttttctaattacatggataacgcacgacaacactaacactaagtacccacacaccggcaagtcccaaagaaacgcttaaatggattaacggacaaaagcctcgtggagatcaacatttaaaccgtgcgaagtttccctaaaaaaaaacgtgcgaagtaaagatatgcactcgtgatccacttcttgggtatatgattattacgatagaaacaaaataggtaaatcatcaattttaactttacaggcaaattatgaaagaatgtgattaaaagacgtacaccctccattctaaaatgaatcatatccatatcatatagccccatcaattttggcatatcggaggaaaaagtgaaacgacatatttgtaaatgaaaaataatttgtgaataaaacttttatatacgtgttctgaacgatctaaaagcaaatgttgaaaaataaactacgatgaaaaaaaccccaaaatcaactctaaatttaagattgaaaattcaaactttggctgataagcgtgagtgaaaagatgaggctaataatatccatattattgctaggatgcctcaaacggaacatatcctatatagattaaaccgggatttgtttttttttcatatgattaattttctgaaggaaagggatgtaatttgggcttgggctgaccaaattgatagcaggccagatcaaatcatccagtcaattcttgtattaactctaggcgatatcagtatcacaaaaaggttgatagcatgcgtagcatagtgcaaagacatttaggttgttaatccgtagtactaattactaagcttcaaaatccacgaggcgtcctttgcctgcttaatccttccctttcgtgatcgcaactcgcaagcaacaggtgcaagctgc

SEQ ID NO: 8012 - DNA, 8726 bp, Oryza sativa
ggcactatgtctgtcaactgacaaagtaataccaatggacgatgctctgctaacaaggaaaatagggtatccaccagagcctcttccatctttcttatggttgatttgcaagacggcaggtgtatctatatctgagtagaattttgcataacagatggaaaggatatcagggatgtttaattaagttctgacctccaacttctctagatgaatggccacatagaaatagcgcgaaagtatcagttggctctttcatggtttgattagcacctttgcagttcctcttgataaaataatgagatggcagcagtacatctctaaccatcaccaagatgattttgtttagactatcacattctttctgaggttgtttactcctcagtgctctctctgaaatgttgagaacaaataacaaatacagaatagaaggcccactgttcaaacattgcatgcaaccattttgtagttggatttgccttcttttcagtttcctgagaacgctttcttccacctgaaacaataaatatatgaaaattcaaaattaaggagcacataaagcatgaactctgtggcatgttaaggtgaacaacaatataaaatggctaaaagaggcacttaaccttaattgtttgactcaataagcccaggttaatatgaaataattatttcagattgttcatacaccggggaatatatgctgctgataaagaagcctggaaaagctgaaaattatgactgatgaagtaattttgataaaaatgtgtatgctgaaatgaacatctagcagaatgggagaaggccagaacagctaataccatcaaaaatgtgaatgacagaagaagctgggaaacttctgaaatcagtagcccgaataaagaaaaatccctcttgcaatgtagaaggaaaatacagaaggtcatataaacactaatccgataccgaattacaaacccagttgagttatatgtgtatagagtaggcacctcatcttctctagcagctgtttcttcagctgattgttttgccagatgagccactaccagctcttacaatttcacaatggcaagtacgtagttcgaagttcgtaaatcagaaaatgtgcctttatcaatacacagtacagaactaaaggtactgctgtatggcataatttactgaaaggtatacaaccattcccaaacaaaaccagaaaatgaaaactgaaattcagcagggtaagcagacatataacaggtgctagtcagcatacgacaaggatgaacttaagttaaagcatctttcaccaacggtcgaagaccatggtctagtgaacagaaaaaggggaaatcttccttcagaactctgcgccaaaatagcttcagctttgaccggcgatgtaaaaaaggatatgatctgcttctaattggcaacagacaagctctcctagtgttgaggaactttggaacactttgcaaagcagagagttctcatctttgtaggactaaaatctaagatagctgcacaaaataattacagcaattagaacatttctagtaacaattgtacacatgagctaaactcagagagaacaaaatggaaacctcatcatgcacaactcttaatggaatccatttgcgtgcttattgaatcatgcttgtgcaactaaccaccattacaactagtgaaaatatctcatgcagtcagataaaaaaaatattatgtggatctgagaaactctgccatgcatatcttctaacgcgaaacatgtgcttaaggaaaaggataaatgagcatgatcacagaggatatatctgtcccaaacattgtctatgcagtgctagaagcacttgttacttgtttgatcaattaaaatgtaatgccaggagtaagcaaaaaaaaaaaaatcgaagccagggctttgatcttacttggaataacaagaagaaagtttaatcaacatttgaccaaatcaccacttaatcagaacaagatttttctaagcaaattgattggattttgcaacttcagacaatcaagttaaattgcttatgttcaacttgctaatagctgttgatagcgtaattcttcttcatgactttgagtagtacacagtagtttgccttactttatgcattagaatagtgtgcctttgcagtccacattttaaacgacagaataatattgcaaatccatgatatttcaatttgtagagtgcacacctgctgcattcgggggtttgatgaatcatgggcaagtcagaaggcacatcaggttattttacatatatgatgtcctcctcatctggctcatctgcatcccagtcaccttcttcttcttctgatagatttgcaccttctccatcttcctcttcttcatttccttcttgttgctccctttcctcctttaatttgtccagtatagcaagatctatatatatggcaacaattagactatagtttcccaatatatttgagagatatgaaaaaaaaacgcttagtgcaatactgcaataattcattgtgtgctaatgcaacccctgcaaacattggattgttaagttataggttctgtgatgttaaagcttaaaaaaatgtctgtatttggggctgattgcctcgcaaagaccctacaggaagaagcttacgtctggtgtggtatcaatgaagcgtaacctatgatcttatccaaataaagcatatgggtacttgtagctataattttcaggtaaaccgaattgcaaacagccaaacacaattttaagtttaaacagagatgcaaaatactaacacaacttgtaaggtaacaaaaacaatgaccatgcttcttttgaactatttggatcttgatatttgataactatccgaggagcagtactggacaatcacatagtatagatacgttcaaggatgcatgtactaaatgaagataaaccagtgaaagcagatattcattggaacaggtagatagatgagtttagagtgtgtaccctgcttccccgctccatggactcatcctcgatgaaccgtatctcaggcgtgaggcgcagcttcatccgcttgcctatttggctcctgacgtacttagtcttagccttgagcccagcaatggccaccttcttccccctctcgtccccaaacacggagacatacaccttgcacacctacgaacaaacagtgaagttcagcatagctcgcacaaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccgctccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtggcttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctcccccgagacgacggcggcgacggcgacggcgatggcgaaggagaggaagcggaggcagcccgccgacgcgccgccgccgggggacgacgacgaggggagggaccaccggagggagaagaagccgaggaaggagaggcccgacccggtgctgccgtcgcagatcaagaacaaggacaagcgcaaggaggtgcacgcgaagctcaagcgcgagaagaaggcccagaagcgcaagctcgcccgcgagcgcggccaggccgcgcagcgcgccgtcgagctcggcgagcaggcaagcgcgcgcctcgatttctcccctccgcagcgagctccccctctcgaattcctccaagctttgtttcttaggtttttgtgagggttttcattatgggtgttcgcagccgccggagaagctggtgccgcggacgatcgagaacaccagggaacctgacgagaccgtgtgccggcccgacgaccaagaggtttgtgcacgttcttctgtgtttcttacttggattgatcctaccaatgcgagtttctcaattatcggagtaattgtaattttaatttctaattgtacattcgaacctgtttgactaatagtagtttggaatcaaggacatttatctgacagggtctccttaatgttgcattaggtttgtggaacatgagaattacatttctttggtagttaggctaggtatgcggtgaggttggggcaatttctgaattacatttctttggtagttaggctaggtatgaggtgaggttggggcaaattctttctttactagttatgaccagggaaggctatctggaacgtggtgccttgccgaggttaaggaataaggatgagataacgattataagtggatttagctgcttgcttgggggagtttgcagaagttcatgaggcttgtcagtgaatgagtgttgtgctgattcctgttattcactagcatagaacactatactatacagatgtcatgctatcatcatatcatgcttataacatgaatcagttaccagtatttatgattttaattaagcatgcaacttctacaagacacatcactgtgtttttctgccttcacatgcttgcttcgattgagttccttgcacttgttatacatattcagtatgcaacgtcaatgcttggtagtgctgcactggttgatgctgctgccttatattatataatttgtgcgtacacatcacgggtttttatatgctaagctgcaaacattagattttttttctagacattttactgctttactaagtactaagaagtaagatctagatgtcctttttgtttcatatagcaatgtgcactccaagatatcattagcatctcctttagatttattagtctatttagaatcttggtgtattatatccttttctgttactttctcttaggatgaacactcattcgatcattgtgattcaactttacatggtatcagatatcaaattatcgttcttctgtgcagctgtttgcagggaatgatgctgatgaattcaatgcagttctgaagcagcaaacaactccaaaagtgttgattaccacatgtcgcttcaattcaggcgtatgcattttctatgcttatcacctctgcttttggatttttgttcttctcaatatcttgtgctggctgttctgaattgataattatttgataacctctattcttaagaagttgcatctaacactttatgtttatctgcacatatgtctacagaggggacctgcctttattgaggagttaatgcaagtgatacccaattcgtgttatgttaaaagaggaacttatgaactcaagaaagtatgacatgttcaaagtagctaacctgttcatttgtttgaattagacacttcatatggactgaaacacatttctttttagattgtggaatatgcaaataacagagatttcacttcacttgttgttgtccacacaaaccgaagggaacctggtaagaatccatcaatttattagttcaaaatttgcacttgttatctgttatgacatatttattgttattgtgtcacagatgctctactgatcatcaattacctgctggtcctactgcacattttaaactatctaaacttattctgcggaaggacataaaggtactttatctgtattttctttatcatactagcaaaatgcctttgctatgggtaaaatgcacatgcttatttgaatatatgttattcacttgattcaaatgaatattagactattatataatacaagaaaatatcaagggctattttgtaagttgtgcaaatgtagttgtgggttggtgaaccaccaccaccgctattgtcttttacagtagtatagattatcacctactaactaatgttatattgttttcttaaataatatctactgaaactacaactcttagatgagttattcaaaattttgttggaaatggtaacctgtatttatttatttttatttttgtttttgggagaacttgttgaatagctttggtgttgtctacatatctttgtgctaacttagcatatattttcaccataccaaagggataggacagcaacactgttatccatcttctatgtgttctgataatctttgtatttgcattgtgaagaacaaatagtaacagctacttcagacaagcacaaattagtgctatttttgaagaatcatatgcatactatcttctgctactgcaaatctcctgtattagttagtttataataactgtttgatctgtttgtgtttttaattgtgatctgatcacgatatcctttgttcttagttttttgcacacatgtaagagtgagaaaatcccacggctgtctagatcttagcaaattgacaacaatatgctagttgggaactgtgattatgtcctctccagaaaaaaaaaagttaactgtgattatgtgttatgatgactgagagccaacacacatggctattttctgaattctttagatctaatgctgatctttaccctattaaacatttaaacctctatacacaaaaggaagaatataaaattatatgagtatatttaaagtcagatagtaaatgtgccattgttttattttcagaaatcttaaacacaatcttgtttttaccgaatgctatcaggaattcattagggacatactggttgtggtttggtatattgttatctgcaggaaaagagccttgcttgtgcataacaactccttttgagggtcttatattattgttagtaattagtgcggtggcctattggctaatataaacacatagtgtagttcagaagataaaacaaactttgatgatcacgttcatcacaatgatgaatatgaaaatgtcaactaattcgtaacgttgtttagatagttatggtaataacaatgattatatcatagctgcatatctgttattacaccgctaacctctttagactaaaggtgcactggaagtgaacaaagcccaagttgacatcaattggtcatcctacttgtctctagtttgtctctaggatgacttagtcatctgagctttgccctcaaaatcaaatgtgcatgtgactatgttcggtatcatatgacatgtctgctagatgctgatccatgtctctatccaacatagcatgttttagttttagtttttccagtctttcaatgattgtatatattattgcaattgcaatggagttgggttgataaccatgttgctgatggtcatctagattgatggaaagcagaaaaaaaatagctggaaggaacgtctttattctgctgcacctggactttgactaattttagtagcgtttcatatccagatttattcagtttatttgatatgttcttgttaaatgacaaaaggttctcagcttattttccaatattatataaatctgtttttgaattttagctttgcgaaccagttaatattcatggctttgtttacctttttggttgcagaaccacggcaaccccacaagtcataagccagagttagtgttgaacaatttcactacgcgccttggtcatcgtgttggaaggtgatttgtgaacatgaacccttgtgctcctttgctgatc

SEQ ID NO: 8013 - DNA, 2411 bp, Oryza sativa
aaaacaaaattggttcaaaggacaagaaagctaagactttttaaagcaaaagcccaccttagaagcaagtaatttgtcgcctccaggtatttgagctacttatcagtactcactacaagttctgtaggtgatggcacatatttcattcagttcacaatctgttattggtcatcaccatctggcaaccccaaccaaagtgctttctatgttgcgtgtttgaagggtgtttctggttttccgagatatgctctcgctttcaacatcaaatgcttactgtcttgccagttagacaaacacaatgatatcattacttaggcctaatgctatttataattgttaccatgttattattagccctagcagtaaacctaagctgttctgatgaactaggaatgtggtcctcgcttcaccctcaagctgctcaccttacaacatgggacctttgacacaaaaaatggggagtatgaatgggttcacaaggtactattattcatttaccgtcccatgcccacactacactctacatgaaagttttctgacatgctgcaaatcttgcatcattgcatcatttacagccggacatggacacgagcagaagaagatttttcttgtaatttagcatgggatcctcatgccacaccagatgaaatattagtgttgttcggaaattactgcatattcgttttgtgcacttagaatcgtatcacaaatgtaacagacctctatgcacatttgaagcaattttgatgatctatcaaatgagttgagctatacgaatcttggcctctttactatatggttgttgttcccgtatccagtatcttgcacaaaagctgccctttgttttgttccagccctaatatgtcttgctatccacaagatgtatcatcaaatctgctgccatacaaaggtcgttatcatccaactgccatgggattacacctcattgttcctgcccttctctccatccaagaacttatcattgctggccccatgttcttcaaggctgctatagccaccagcggcgccatgacagccccaggatcatcgtatccccgaggtatacctcttctcggcctgttacctactctggttataaatatttgatgtttaggttagataacacttattttaaaagtgaaatatttatacctgattagcctatatagtactctaacttacaagtagtaatgagatactggttggccattgcccatcaaggccgctgatcttttaaccctttttattactgcaaagtactagatgccactcatttaaccctttttattactgcaaagtactagtggatgagctgatggtataccctatacctctttctctatctttaagactgtaattacaacttgtgatatctgtggccattgcccattgctagcgctgttaaacttttgacaaatttcatgctgttactactgctaggtagtggctgagctctgatgagcaggctggctggcagatagctgcctgctgctgggtactgctgctacacatggcctgggggtcccatcctatccaagtaaggccatatgtttctgcgcgtacgtccgtgcaggccagggcgtacaacacagaggtgcgttctctctctccttctcttggtcgtcttctcttttagatgagatgagaggatcgcattgcaccgctagcttgaaagagaggctcctctccatagagtaattgccatctgaaattgccgccctgttgtgtttgcttgctaggtgggttggtcacgagtgcagcagtgcagcggcacatggcttgctccctcccctggccctgccatgttatctgctccagtttggtccaatgggtgagtgaagttatactgccacttcatctctgtttctgcagcatctgcatgctagctactaggtaaatgtttgttcatccctcttcttgaacactgtcagttagctgcatatacatgctcagttgctggccctggccatggtagatctcgagttacagctaaaaatcaccccttttatcttcagttttgaactgagttccaggtcactagaagtcttaaccatgcagtcaaatttgggtgagcagcttttatgcagccatttgggtattaaagtggatactggaatattagtatcgcgcacaaaagctaagcctggacataatttgggtgagcagccattgcgtacatgcacctacgtgcaactaggcgttaattactctcgtttttagatgggaaatacgttaatttatggcgtgttactgcatgatcgcgaagatgatcactctgaataatctgcactgtacgtggcaagtgtgcatgcatgggttgtggtgcaaactatttacatgagtggatcagatctgtgcactggtggatcttccgtgttcgatctgtgtgtgttctcatgcaactcaaaact

SEQ ID NO: 8014 - DNA, 16972 bp, Oryza sativa
gcaactaggcgttaattactctcgtttttagatgggaaatacgttaatttatggcgtgttactgcatgatcgcaaagatgatcactctgaataatctgcactgtacgtggcaagtgtgcatgcatgggttgtggtgcagactatttacatgagtggatcagatctgtgcactgttggatcttccgtgttcgatctgtgtgtgttctcatgcaactcaaaactattatggtccgagctgagcgaaagcaactgccgagtaacaactaagctacctgcatgtagctatatatacttctgtagtctgtaccgtaccacgtacgcacgtacaactacgataatatctctcggagggcgtatcagcgcatagccaatatgaggtgctaattaatatccgtgcttgtatacttcctctgcctcgttaatttgtccagtttcatcgctcgaaataaatttgcgtacagttacaccagaaatctaaggtatatactcctcatttctaaaatgtagggccagttcggtttggttccaaattgtgccctatcaattcattggtaattttcaatagtgtttctagttgtttggattggtgccaaattttaacaatacatctctttagataaaaaagttttgccgtctaaatttggtagtgccaaaaattgcttaaactttggcactaccaaaattttggtatggcaccaatccaaactgacccgtaattattttttaaatctaaaatagaaatgtagctatattttaatacgaacagagcaattactggcatcaaattgacgcagtacgttaagtaacatgaggtccttccgtcctttgctagtggctacaaactacaagttatacaaaaacaactagttatataagctgcctgtcagtcagtggtggtcactactacaagcacacggcgatagccaatatgaatggccagaaaattaggctagctctctgcattcacatacgtactgacgtacatatcccaatcaatacaccacgttgagaggctttcggccggcaattaagcccgaaagatatctgcaggctaattactgatcatatacatatcacacagggatattgcacaatcactgcatgccagatgccacattatattgccacatatacacccgggctagctagatgcttgctagctagctaccttttcaacctcatcgtcattaactattatcacgactactctttccattaatcaaaatgtatacatatcaagaacacatgcatggttgcattttggatatctcgatctctagctatatagctagctagctagcttcttaattagccggccggtcattcattaccttaatttgcatgtacaacgagaccaaaaaaataatgagtaaatgatgattcagttcgttcgaactcatcactcaccaaaaaaaaaaaaaacagcatacatgcaacgacaccagctaagctagctagctatagctccaaattaattaaacttcgccttcgttttcgtctacctctagctagggcgcgcgctaatctgcgcatgcgccgttagctagctccgacgatcaaaatgatcaatcgatgaatctcgatccggccggggtggttcatatttacacggtagtatccattgctagatcgagctaagctagctgatcttgccggagcaatggaagaaggaattaatatagctagtgtacagatgcgcggcggcgggttcagcgggtgcaggagtattggagggaggaggtgagggagcggaaggctacctcctcgcaggggaggacgaggaggccgccggcgccggcgccggcgaagccgaactcctcctcggcgcggcggagcagggagcggaactccggccggtcgagaagcgcgaggggcaccacgaaccgccgccgccgctcgccgacgtacaccgggaagtggcccctcggcacgtcggacggcaagccggacgccttcttcttcctcttcccactcgctgacctgcttctgctcctgctgccgccgccccaggctcgagcaccgcttcagtatctgctcagccccgccgcgccgcccttcttgatcgccacggccgccggtgagctcaagcttgctgtagttggtggttggtgatggtggtgacgaggaggcggccatggcgagggggtatatatagggagaggtgggcgaggtcgtgaggtctcgccgtggttggtgctggtggtggatgggcccgcggcgcccgtgggcttgccgggcctgggcctggtacagggtgtgggacccacatcgcaggtccctgtgtttttcaccttagacctagtaattagttgctagttgctactacctccctcccaaactaattacattttgagagaattaaagatagattagcaacaaacacaatttaacacaataacccaatttaatgaccacacattacctacataaacttgattaaaaggaaggtcgagacaataagcccacttaattaccattcttaaacttgattaaaaggaatatttggatcctttgtcagcagaaatttttttgggataaaatttaaatgatagaaatgtaattatttaagacggagataatactagatagtaatggtagagttgcaatggttgtgattagtgaatctgatctgataatggtagtccataatgtggtaccttggggagctccttgttttttcatttttcctttttatacaggagtttttgttgagtgctagtacgggcccattctttgaagatgaaaattgatggatgatcgccttaattacagggatggattaaatactatatattataaatctaataaataacttagaacaatttatttaagcaattctgatttatgaagttttcggacaaattatagttatcaaagcgtggcaatgcatatacaatctatcagggttaatccaaaaagagcgaggccttagatttagagttaaatgatgtaatgtctcattttaaatatgtaagttcagaatttcccacctttttttacttgtatgaaacatggtgattttctggcctttcgaattggacctgtttggaatatggtaatcttccaaccttcaattccgaataagtcaattttcatatccacatcaaaatgaaatatttccttcctacgttcgaggcgggccttcatagaatgttctagaagaaggttgttcgaagttatccaagaaggttgttctaagttttcgaaagtgaaaagataaaaaggaggagaaaaagttgtgatggggggctagctaaaatcctcgatatttccctactcttgcaatttgcatggtagagacaaggtcaacacactatagttagctagtatattgtaggatctaagtatcaatcaagtggcagtgaacataaaagagagaaagaggagctcaagtagtggggaagcaacttcaaggggttgacatttgacaaaatgacagtggaaaaattccaagtctcacatcaaagtgagtgatcaaaaccaccctttaatttcttctgctttttcaatgccctgcagccagtgttgttgcagacacgttcaataatggtccatgatccatatctttcaggtatctctgaccactgtacgtctgtaccggccgttgccgctgctgcatcctctacgcatcacaaaagatgcctagatagttttttacaacagtttctacttgcatttcatcagaaaaaaaaaagaagaagattcatctgtgtttctgaaagagaactacaacaagatttctctcctagttcaggttaatcaggttcaggagtcaagacttcaggtagcaattttcaactattgataatatttgaataaattattttattttattttatttaaaaaaatataaaactattaaccatgttaatttaacatatgaagtataaatttcgcatggatttgagatctcgagccgtgtcaaatagggagatggtaaagattacatagtgaactcacatcctctagagccgaagtattgcaagaaccaatagttcacatgttaattaactcaaaatctagtgcagcaatatccctcaaactgatgtaattaagtatcctcctagctaagtagctaggcttggctacttcagaactaattaatcttatctttattcagttaactaatctttgaatgatagttgatcaatcacagatagtatgtattatcagctggtagatctgcagggcaaaatataatcaagggccgccatgcacttgccactggcacttgtgtggttgcatctcatgataggtgatgttgctatgacatggctactgggcgtacggatgggtggccacccgtttaagcttggaccatcaaagatggggcactaactggcacactatgtcaggataaaaaggaaaataaaataatcatataattctagctatgtatttacatggcatgtaggagaaaagaaaaatactgtcctttgaaatcttcagaaagtgtcctttgaagtcttcagaagcctagctagctagctcgcttgcacacttgacctcatgctaatccatgggtttaattaattttggaatttaaaacccagtaaggaaattcagaaacaaagccatgcattccaagacaagaatgctagtcgcattcacaccttttaattagttagtagtaattaattaatcaattaactgataaatatcacactgcctgcttggctatcagcatcatgcgattattttgatgtaacatattgagataattaatcaccagacaattcttttcaattttctgactgaatgtcatattgtcatgcatggtgtggtggtatacaagcaggtcagcactaattatctgctttcctgcttgtgttatgtccctctgctgttgaacaagtttgtatgggctctcaaccaactggaaacattatgttggcaatctcatcacaaatcaccattgtatattatgctgaaaattctattattgttggaccgctatagtgtcaactcagtaatgatccatttatctgaaatctgattggaataatgaagtggcagggtcgttgctagattcttatcacctgacatgacattggtcgcggctagctgtgtgtttcgtatctaagacggctttgaaatagaattccacattggccatgtgagatgctacaaattcagacactgattggaggaaagagaaaaagatgatcatccatgccacttcttgattaaattatcttattcagaaatcagagttctggaatgaatactgttgaagcacatgcatgcatcatccattttaactttcccatcacatattcagattaaccttttctttataaaaaaatcactttaacattttgatttgatttagattattgagcagattatccatttgattgtagagataaaacaaacttaacaaatagcttaaaataagtgctctcagcaatacaatagaggtattttcttttgagaaaacatatttttttaaaacatggagctgtttcaataatccagtgaataagttgaaaagaaatgggcggcaacatggatggtaaaatctaagcgtggatctccatttgtctctggtcccttcatcaaacatgaatgcagcctgattgcttgtctgcattagcaaacaaaggcgagcgagcgagcgtgcgtgtgcaaccaccacactcacacgtacgcccgcacgtacgaacgtacgcagccttcaaggcctttgccccgaattatatcatggccaaacagtgcgacgcttcagtgatcaccagcaggtgcagtcaatgcagataccaaacaagcaatcagaaaattcagggttcagacaggctcacctaactgaccaagctttttagccaaacagaagggttgcatcatgcgtacttgaactaattaatcttgcagactctctggtcgatttctgaattaattaattaccagaagttagctagaacacctgttcgatctttcagaaattcagacttgagatgagagacaggaaaggaaactgaaggttaagctgtacaaatcaaactagaccgttctaacgaactgtcagaatttgaatgttcgaggagtactactgatggcagtagggtcgtcttcttggagaaaaacggtagctgctgctagctaggacaatgacattcttgatggatacatgatcagatgaaaatccaaaatcaattaatcagatggtagtatcatcatggtaggagtacaccaatacaccaagaattgaaagactcgatcgatcgacatcaatcgatcatggatcgttaatcaacgcatcaatcgatcgccatgcatgtttatggagatgctccaaacatgtcagtgttctgctccagttgaaaaactcttaagctccaaattaaaaagcgtactcaaactcttgatcttagctaatggcgatcgagccgtgcaaatctgagcaacaaaccgattccactgacgacgatgagtacgtctgtacgtgtacattgtgctgtcgccgtcgtcaactgggacggcgtacgtggccggccggagaggtcgccggccggccggccggcgacggcgacgtctgagcttccacatggcgaactggatcgtccggtggctcgtcgccggccgatggatgttgacgcgaatcattgggccgggagacagcgcccaaacagcaagttgcaagtgtttgtattgtacctacgcccccccgtgtgcatgccatgcacagcatgcatgcaaagcactcctgctgccatataatctcctcaacattatctcattatccatcgactttactaaacgaaatgaaagcttaatacgttttttgaagattatgtgaagattctgagaaactgttggtaagaatctaaaaaggctgagtttatccagcttcgagcttcaagttattgtagtttgtttttatattttgtaactaccgagacatgtaacttggaggaaggatgtggactgtttaagggaaattaagattctgagagtagctgtagctgctagaagctcctcgcatagagccatacacacgtctcaaatcaaatcaaggcttggttaattaattggggagaaagcggaactgcattatattaggcttgagctaatcatgagggttttgtcagcttcagcaattgaaagtgacttgtaaaagggcaggtatgattgaagcaaagcagcaagggacataggaaatcttgtgaaggttcttctggtccttgcaaaccagcctgtaagatttggaccatcgatcgatcaatcgatcagccatgatcagtggtagattgtcccacaccttgtaccatgtatatatatccatcatagattcataggctggtggttgaacccctgtaaagcaaccccatttaatcaatctcttactgtttgcaatttagtaatagtataaatgttgaatagtggcaagagagtaattccatttcagactttcagtgcagacattcagtcagtactctgtccggctatatatatccaaggacgatattaacaccatttcgttccagttgtctggttataaacatacatacaagttggcatacaagctaggaaagtcgatttgagtacaccttgttttcagttaaatttggaaccacatgatttttcgcaagtaccgtcattagaagaaaattcaagcattatagtggaggtggatggttctgtaaaatggtaagcgagacgaacaagtgtcctttttcccgcttatatatcacaattctattttattttccttcccaacttcatactagcatgtagaaaatggttagttcccaataaggagggattcgaggagatcgagggaaaataattctatgcctaattctaattcctcttgtgggtaggattaaccgaacaagttgtggataggattaacggaacaaggcctaaaccagttttatacagctaacaagattatccctacttgcagtcaagagacacaagaagtcaggaattgctaggtaggatctttttttgtggcaacaatggctatggactgtctaaattttgtcggcagctctaactttgagtgagcagcatcgctcatggccagtagcaaagcaatgcacattgcagacactcaactaatcttgcacagttgcactacgatgcctacccccttaggggactgtagcagcttgtgaatatataccagcacgggtaccattccccatttttcactcactcctagcacctgcttgaaaaagaatatggaacacactgctacatttcattaacgcaatgaccccagtagaaaacgcgccattgatttcattctaattgttcacatgaatcaaaacacatggcaagacatagtgagaaagatatcttgattgcaagattccagaacatttaatcagaatgcatgaaacaaaaaagattccagcaagaactgaatcggtcgttcagcacagtttttaactgttacccacactaagcgcgttaatagatgctccatgtcacagaatcaagaaacatagcacgtttttgagccaagaagatcagcattcagcactatttgcagagtcaaaaggagttaaactaagcaatcgtacttgttctagaatgtccatcatatagcagggcaaaaattaacagcttagatgagccctttcagtatggagtaaaagggccaatcagagaagtaggtgttctcataagatgaatgaaatcatagtagaatatatgcacaatgacactgcttgttagtacattaattgcaagcccaagggctaaggcaacagctacaatggaaatacagtgatacacttgttatcatctagttagagcgttgttatcagatcccaacatcttccttatgacagcacttgtagcaaattagccgtgcccaaattgttggccttgaactgaatgtacgacagcgaaattcatcgtcagattaaactctggcattatttacctacgcaacaatgctaatcagaaatacaagtaattttactgaccagaaacagctttggattgctgaggcattccatctatcatgcttaattgccttctcagcttagctatgtgagcttgcacctggagcaacaagagagttacaatgtcagagaagtggacattgttttaccccattcaactgttcatgcacaagcaattcctgttactattaggtactccctccgtcccacaaagaaaccatccctagattcccaatgcaagtttagtactgatgtgaaatgacctaaatgcccttcttcaagtacaaccactcattagtcatcagcacttacccacgaaaaaaaaaggaaagttaaaaatccctccatcgtcgtttgcatctgagccaccgacgacgaccctgtatgccggcgcgccaccgccggcctgcacgtctccgtccgccgcaagcttcagatccaccgcctcacaaacctctgttgttgccacccccgccgcatctgatacacgacgccgtggaaggtcgcaggcacagagagaaagggagcttccaagccgcatccatccaccggagctgcctcccacatcggatgatggggatccgccggcttgcaaccctccaccgccttccgagctgctgcgtccgggtggacgcggaatgtcgcacggaggagtgggagagaggagaagagagagggagcagggagtgggcaggacgaagcaggaacatgagcgaggggtgaagcaaggatggaggtcgctggagatcgacgaacaagagagacgagcagtagtattgaatgtttctggttctggacggagagaacaagagagacgagtagtactagtattgtgtgtttctagacggagaggacgagcagtagtattgaatatttctgggttttcgcgcaggagtcgattctttccgggacaaactctcactggtagaaattgattttttgtgaggcagagggagtaagtcagaattattctatgcaacatcccctatactggcatgctatgtaattttatttatagctcgaaaatatgtctatggttatatataagtcagtctaggcaagtgatccccaatgcgaaattttaccattttgttgcccttaaaagattattatgctaatatagtcctttagtagtgttatcattgggagatacagaacttaccctggaaagcgctttccagttgaattaatttggggaaaaaaagactcaacaaaagggacaactactagtttacaactgcttgcatgaatagcttaattatatgcaagggaaattaaaaaagaccttcttgaaattgatacgggatgtacaacttagccaaaaagacatttaccaactgaaattgatataagataactctctcatggaaatatctacggattgaatgcatgttacaacagactaagtagatgagaaagcaggaatacttcttgcagtattgacaagcatagtaatatatctcagagaataaggacaattgaatctcacctgttgccgagcagcagccagttttaatagttcatcagcttcagagaaatttgagaaccactggctcaaaggatgatccttagtgtcaccacgcttcttttcatgtggcacaagttccatagggcctagacgatggataattttgtattgccatttttatttttcccccaatgaaatataggtacaagtcatggtgccaagaaaaaaggagtacctggaggaggcaaggttataccaggaggcaacctaggcacagtagcagctggatgattttgtactcgttggaaaaaggcctcagtgggctcagggaagacaatttcatcgtacgtttccacgacaacaggctttttagttgattgtggtccagtgtcctcttctggatacagtttaagttgatgaaacctgcatcatttatgtagttaactaaatgcttcccccaaagaaatatgatgtttgaaacaagatctctgcaacttacaaatccagacgcttttcacacacgtcactgtggaaataaagggttattgcaatttcaaattctccccagccagattcagacaactcgaaaggtggttgctctacaactcttgttggattagtgaaactcgggtgaagttgaaacaccacacgcttaactatcacacttaaatcctcatttgttgcagagcgaacatacacagtccatttgtgagagttgtacctagaaaaaaagaacatattcatgccctttagataatattcactataggtagcaaactgagtacttgaggaaatttaacaataagaactgttcacagaaaaaaaaatacttactcgcttgccttcttgccaagccagaaagaaatggttccatagacaattgggaaactgatctccacatccttgagttttttattctgtgcgaaaaaatcagtaaaacaccatgtcaagtaaaaaattgattaaagcttattattaatccataaagtataccaactaactaaaatgaagcatatggtgtaacaaaatcaccctggatgattcacttaggcttcccaaaaaaacagagggtgaagtttgttggatgcttatttatttccttgttttcatacttcaagaaggtgactgtatgtttgatatcatatactagacgactaagcaattaattggtgtgaagaataagacatggtatgatgatgcaaaggaatgtatataaaccacaagctagtaatcagttaaacaatagatattctggtccactgtttctcaattctaactctaaaaatgacaaacagcagagtccgatgcagcttagctaatcggttagataagtcttggattgaatcgtatcctagtcatttactcgattgcacaattgaacattcataagatgttcactgcttactaacgaatgggcgtgatgtctacttcctttgattcacccgaggcaccgagcatagctactggtgtgccacccaaaaccctagtagcacccccacccctcaacgcaaaatcacaagagaagaatcggacgagcacgccactgcaaagggaggtaaaccttcttgtcggagtcttcgggcggcctcgtcggcttggagcggagcgccttctgcgcggcggtcagcacggcctccggctgcgcctgcggcggcggcgccggcgtctgcgggtccagcgcctcctccgaagctggcacagccgacggagaagggtccgccgcaggctgcggcggaggcggcgccgccgccgtcgccggcgaggaggaggaggcttgcggcatcggcgcggcgcgcggcgagggctcggtcggtcggtgtcgggtcgggtcgggaagaaggcgaggcgacgcgaggaagaagatggttgggtcggatcggtccgatgggcgagtgggcccagattggccggcccactcgaagcggcgtgggttgcacgcttgcacggataagttgggctgtaaacctgtaaagtgtgtgtagggttttggatgggcccggcccataaagtgagcggtgggctcaacgggtgtggggtatttttggccgttcagcccatttagacaaccacaggcccacgcttttggattatctgtagattgaggcccacagcttttcgcatacatgattaaccattttaacacggaataaggtcaccggaggtccctcaacttaacagtgagattttttaagatcccttaactacaaaaccagaaatgtgtacccctaaactctctcaaaccgttcaccggaggtccctcagcagtatttttgtccggttttgctgacgtggcatcctagtcagcaaaaaaattaaaaaaatgcgtggggcccacatgtcagctgcacatattttttttttctctattttgttcttctcctcttctctcttctctcttcagcgagcgcggcagccacaggcggaacagcgtgatggggttctcctccgtggaggcgatgagcacggccgcggctgtgacagcaggttcccagacccggagccaatgcgttcagccggagcagcggctgctacaccgacgccgcattctccgccgtgcgctcctcgccgccgcctagatgctgctgctgcgcctgcgtcgccgccgggctcaccgtcagcttctccttgatcgctcccgtcaataaaaatgtggacatcattattgattgctaggagcactacgtgcttgcagacggcgaacgacacgacggtgccggcgaagcccgccggggccgggccgcagctgaagctgctggtggacaagcgctcgcgtcgcgtgctgtacgcgaaggcgcgcaaggacgcggtggacttcctcatcggcctcctccacgttcgtctcgttcgtcgaggccgacgccgacgtctcgctggaggagttcggtgactcgctgtgcccgtcgatcccttgcgctggcgaactcttgaccctgctggatagcgacttcgccgtcgtcaccgaccggccactactctacgtgcaggtacgtacgtcgtcataaaacttgaataaactttgcaaattttgcaccatttgtattgtacgtgatttacgtgttcatgatgccatgcatctcgtctgaggtgtggcggcttcgtgttgcatcataggtgacgaggctgaggtgtggcggcttcgtgttgcatcataggtgacgagactgaggtgtggcggcttcgtgttcagcacccagatctgccacaacctcgtcgacgcggcggggatcacgcagttcttgcaggctgtcggtgagctcgcggaaggcgcagaccgtctggccggtgtgagcgagggagcccctcgacgcacgccacccgccgcattcggcgtacgaccaccccgagtacgagccggcgtccgacgaggccagcgacaagctccgtccaggcgacgagctcgtgcaccgcaggttcctcttcggccccgacgacgtcgccgcgttgcgcgaccagctccccacgcacctcggccccggtgctcgcgtttccttctcctcgagtccccgggcccagaccgccgcttttcgccgcctacagccgccgatgctgcccttccgcctgctccggccgcgtgccgccgcccgctgccgctcgcccgccgcttgccgccgttgcagccgtgctctcccactgaccaccacccctccacctgctccagccgcgctcgcccgctacttgccgcgtcggcgtcggcaaccgctagctccgagtcttggaacctgccgtcgccaccgcggccgtgctcgtcgcctccacggaggagaaccccgtcatgccgctccgcctgtggctgccgcgcttgctgaagagagaatcagagaagagagtacagaaggagaagaaaagaaaagggaaaaaaagtgcagctgacatgtgggccccacgtaatttttaatttttttctgaataggatgccacgtcagcaaaactaggcaaaaatactgccaagggaccttcggtgaatggtttgaaagagtttaggggtacacattttttgttttctagttaaggtaccttagaaaatctcactgtttagttgagggacctccggtgaccttattccttttaacaccgaatttactgatgcatctgaattcaacttctaccggtgatgattcttaagagattatttagatccgttctttaggacggatgactatcacggtcacggtctataaaagttactgtgtaattaggatttgttcatgttttgcttggttctctgtttatctttggagacgctcataggcaaaaaagagaaaaaaaaaactacagcttcctaaaacgaagaatataattttagacgaatggaactaattcccataaaaattccgtgaaaatttacccccttcaagagtagtagttgaactaccatgtgaactgtgaatttgtgatcgagcaagcattgtgcccgggctatcctagctagcaggcagatggacagagagatactagctagttctaaagtcgccgtggtggtggcagctatcatatcatacacgcacgtaccgttgcccccttccctcatcgccggccgccggcccggaaagtgacctcctgtacgctggaatgccggccgatatccgctggccactaagtagaagattcaactggatcgacccatgaattcatttatttatagatcaaataagtaaataatctatatgttctacatcatgattcggcttaagatgcaagtgactcaactcgtgaacccacttataacccaaattagtatgtaacccgcagtccgcagatcaattcataggttacatactaattttatttataagtggattcgcggatcgatccacttcaatctctagccccactgctgtgcttcgacggcgaggcaagccaccccgacaagccacgccccgcgcaacgtgctccctcccttccgcgtcagcaagacagcaatcgcgctaatggaagaagctgctgcattgctgatatgaggcggatggaggagaggagagatcatgcagaaagcgactctcatactcactttaatcaatcaactgccgtcgtctatcactgtagtacgcaccaactgttcctgcacttgcccctgtgcactgtcagctagctgctcttcatttctcatgccagttcttctcttcaaaacaattatgttttcatgtgcatgcacttcgtgtttcgattctcaattttggtctttatttatttttagataagtacaagcttttacgtactaattccagaagatacaattgtaccgagaacactcccggtctatatatagctaggataccattgtggtttgatatgcttgccatgtacatatgctcatatgagcagtactgcagtacttgacttgtaccagcagattcatatttcaaatcacgctcattgtcaagcggtccacggtacaatacaacaacgtcctttcaaattgctttcgtgaaatgccagttttatgactattaactaacagtgcattatacgagcaaaaccaatcatccgatcgagtctgcctggagcaggatacggaattggacgattgccctctcgatcttgcgttgccgttatggctacagttttcgtgacgattggatcaagtagccaggcagggaatgtcatgctcaaagctagatctgaagctaaccaggagctcagatcacaggcccacaatgatgctgcctcttgtttatgtgacctgaatatatacttcattgctgatctagctttagccaactgccaatgccatatgctaagctaaaaattcatttttgattctgtatattcggtgtgctgtgtgtgctggtccctagctcccatcctctgttcatgtgaccaactcaagtatctcaacttatcaaagtagtagacaagtactagtagtagtagctttgaatctctaatagagtagtgtatgtttatgttcaggatagcagccagatcttcttgctctaatcgcctttttctagatccgaccgtgcgtgtgcagaagcgcatgtgtgccccttttggagctcttgcgatcacccttcataatcatatctgcaaacgtgttcagagttttttttattcatgtaatcttgtagtactacgacattagcaatgaggtaaagcttcttcaattgctaccctctctcaagtgatttacatctttgtatcactgtatgcacagctagttaatttgttctggactttatcactgtatgcctctgaaactctgaatcttgatctgaagagacaaagttacaacacagtatcgacagtaatttgtccaacagtggtattgattggccttattaggaaaactgaaaaaggtcagactaggtcaaatcttgttctgtgttgctgtgcaagctagatgacatgctataagctacaaagtatcgagcagtggaccaacaaaaatccaaataaaatcgaataatctgcgtgctgcatgcactgcttggtgctccactcatcacgtctgcggattgtatgtaggaatattatcaaaagagctttgccttgtcctggtgttgccctgaaaacaccaaagaacaggggaacaaaataatgggcatatttttctgctgtatctctgaacatatattcccttgtttac

SEQ ID NO: 8015 - DNA, 5132 bp, Oryza sativa
cagtagttcatcagagggttcactccgaccacctatggttaggaaaagcaagcttgtggttgtagacttggcggggtctgagcgagtagacacgtcaggtgagtgcattctcgtcgataaatgccatgtcttgctgcacttctatacctttgacaggataataaggctaacatacgcattgggcattaatctctcaggaagtgagggtcatacattagaagaggcaaagtctatcaacttgtccctaagtgcacttggaaaatgcatcaacgcgctagctgaaaacagcccacatgtaccagttcgtgattcaaagcttacaagattgcttaaagattcatttggaggtaaatacatgctaacctgtcatttggtctatgtaaaaatgaaattgtgccatagcttaggaggcacgctcatctttatctaaaagctaataaggagccaagagcatatccctgtacaactcattgcttgtaacacttattgttttttgttctaattgaggtgcttttcttgaaattcataggcactgcaaggacatcattggttgtgacaattggtccatctccaagacatcggggtgagactaccagtacaataatgtttgggcaaagagtaagtttttatgctaagataggtttaatgattttagattctcttgccttcaagttgcaaaaatattcattgacagaccatctcacgatttcatcgtgtatgctactgctgcgtgctggaacaaaattccaagttttttatgaagtgattaatgttttcttcattgtttcatgtataggcaatgaaagttgaaaacatggtgaaactgaaggaagaatttgactacaaaagcttatgtagaagacttgatattgaattagataagttaattgcagaaaacgaaagacagaggaaatattttgatgatgaaattgaaagaataacagcagaagctcaattgcgtgttacggaggctgaaagagaatacaaaatttctctagaggtttgctttccactataatgttttatatattttgttaggcttggtgcaagtgtttattcttggggatatcttgatcttcatgagcatgctatttataggaatcaatagtgcagtgactaaatatttgactttgttttctcatatacttttatcttttagtcagaatactggtcgtcagaagttttctttgacaaaaacccacagtgaaattgggccttacattgacaccataaaggagtatccaattttgatcttataatgaataagttaactattagtcaataccttaatcatgtcttgattcctcaaatataccgcccctatcatcaataattcatcatctatatctcaaagccttgagcatctttaggtgctcggctgctcgtgaattctcttaaagggccatctacaaacatacagcgatgtcagtgttgtaagctgtgagtagaaacatcataggtgattctagaaacatcatcttgtgggacctttctctagaaaaaaaaactacagaacaaaaaaatttatgtaaatttcacaaatagtctaaatcgcttcatctctaagcttcctaaatcctaaataatcattctagttctaccatgcttgattgaggatgtcttttttatattaattttttatatgcattttcttaatgcagaatgagaaagcgaagtaccatcaggaataccttgactctataaagatactggaggagaaatggaaaatacaccaacaatcacctaagaaactggtacatctttattttaggcactgactagttcatcagtcctcttattattttctcattgttggcctggattaatgtctgacttaaaaaaatcacttacattaactttaataatttagtttctcatttgggagagaaggggaaagatccacagggttgctgtatattctaacttaaagcgattgatgtgcaccaataatggggaaacatgtaagcttgacgctgattggcatgagagtctcgtgtttacattgtactttgttttagaggtttttaagccataacaacttatgttctgacgatttgccatttttccatcaacctatggcatttattttacatttttactgtaaattaaagaaactgaacctacatccagtgaggtaggaaaagtgcagaacttactgagaatgagaaagtgttgcgccaatctgctgaagatgaggctaatgaccttaagaatcaagtattacactggaaaaagatggaggtactgtcagtatataattgttttccgcctgtaataatacactaaccttgttttcatcttgtaggctgcagctactgctgaggttgtcaaactacggaaaatgctggatactgaagctagccaaaaagaaaaacttgatgaaaaaattgctgttctgaaaagccagttattgcagctaagtcttgatgctgatgaggtaagaattactggcggttccattttttttttcttactgatcattctgaatttctagatttttttagggccaattgcatatttgccactagtttgaacagatattgtgaatctgccattacaaaaaatgcaattgcatatttgccaccaaaaaacattggaacccatcatttctgccattggattgacagtttcgactaacaccgttgaaaggtggttttttttaaaaaaatgggacaaggatacccttgcaatgaaattgcaaaattaacatcattttagcatgaatgttactgcaccggagggagagaaaaataccaataatttgaatgaatatatgctggtgcctcttatctgtcgcctgtcgcctgtcgcccaagcctccgccacatgctgctgccgccccagccgtcggctgtttctgcctcttgcatttgttgccgccgccgccccgaccgccgcagcgcctgccgccgtcgctggccgcttgttgctgactcgtcgaaagccatctccactgattttcggttcgtttgctattgatttggaaaggatgagagaacttggtgatctaggggggagatcaagggagaggagagggagggttctggtccggtcaggactcggggcagcagaaaagatcaacttgacaagggcaaaatagtattatcaagttacattgatttttgtaaattatttctatcatcttagttggatcggtatagacggtagtggcaaacagcaccacagtagactattgtaggtggcagatgagccattcgcgttcttatgagggttattgagagttagggggtgaaagtagtggtaaatttgccattctctcatttttttaatgagatggttcatgtattatctgatcaatttgataagtagtatacctagtgatgcatatattctctcatattattgcctgttggctttgtagtgcataacacagcaaatgttaaagttaattaagtccatccacagtttttttgacttgcacccttcctattattccaattattccatttgtatgaaacacatacgtgctttcttgggggactgtttccaagattttagtgtaaggtctctgatgttctcttcttttgtaccgttcatttttttctttctttttagacaaggaggagcctcgacagaggagatggatctgggaaaatatttcctgggtttgattctttgatgtctcattcaaggaattctcagcctagagagcagagcaatggacctaagccgcccattgctaaactgtttgaacaaggtatgcattacttgagaacatatttcattcatttgcacctgtctttcagattgtatctttttatcctctagtccttgtaagatatctacatgtaataagaccattataaaaaaatgtgataaaagtttacctatgttattcctgtaatcctgtacataaataaacctgagttgtgattttgcttttggttatgatgatgaaagtttctcttcaactatttcagttgggttacagaagatactgtcgttgcttgaatcggaagaacctgatgttcgtgttcatgcagtgaaagttgtcgcgaatctggcagctgaaggtgcggtgttcatattcaccatgttttaattggaaacatggattttgttatattttatttgatgtgtcaagatttgcatttgatgtatagtatggttgtccgccatatatgcaaatttgatttttaagcatttacatctgatactctacaatctgcatgtcatgcatagcctatgttggatactgctgaagtgaagtattcggataatataaacatacatttgtcgcactagcagttgcgtcattttaaatattgatgccttgatattacaattatggaacccgatctcagtttaacttgatacacattgcttcttgatcatgttatatcaacagcatttgatgcgacttgcaaatgattgattctattcacttttcttctctgagctgcaatcatgaattaactgcggttgcatttgcgtatttcagaggcaaatcaggaaaagattgtagaagcaggtggccttacttctctcctaatgctgcttaggagctccgaggatgagaccattcgcagagtagcagcaggagcaattgctaaccttgcaatgaatggttagtaggccagtagtaattcatgaaagagggccttaaatagtgattatatatctgtttgtagaatgtctcttatctcattgtgtcaataatatatgcagaaacaaaccaagatcttatcatggcccaaggtggtgtaagcctgttatctatgacagcatctgatgcggaggacccacaaactctaagaatggttgctggagccatcgccaacctttgtggcaatggtaaactctatatttctgcatgtttgccattcaaggagttagtaccctaacaaattaatatttttgtctggttggctggcattgcacaacaccgaggacattcaatttaatattaactatccctgctatgcatatacgtgtagctttaagttccgtgcaaaggagaaaattgttgaagtctaaattttggttaatggccacataatttttgttgggagcaaagctgataagactagtgtgggagcatacaaatttaaagagaaaattaataattttcttggatttaaaacatattcccatccatatgactatgtcct

SEQ ID NO: 8016 - DNA, 11817 bp, Oryza sativa
ttcccttatgtccctttcccttatcgtactttggtatgagtgggtgacacattccacatttcaaagatgccatgcaagggacattttctgcttttcagattgtaatggcacataggcacatagcttgaacttgctatttccatcttatgatcttgtccatgagaccataactgagatttccttttctagctaaaggactgatgactgatgatactctgagattagctattatgcagttctcattatcttgaaactctttcaaggaaacatatctccatgctgatctaatttgacacagtaaatcttgtgaccgttaatgcagttctacataattcttgtcagaagccaaatttttatgtataatcttatgccatcactagaattgttcttcatgttttaaccatgtctttctaactaacacgttggcaattttatttcatcaggaaataaggtgggaaaatcgttattaattgatgatggtgcgcttccctggattgtaaaaaatgcaaataatgaagctgctccaattaggaggcacattgagcttgcactgtgccatttggcgcaacatggtatccctctctctcgttgcttgcaacattgctccttcatacactccgttgttcatacagtatgtacatgtaattgtaaaactatacgtttattatacttatggtgttaattttacctttctgcagaagtaaattcaaaggatatcattagtgaaggtgctttatgggaacttgttcggatttcaagggattgttctcgtgaggacataaggatgctagcgtaccggacattgacttccagccccactcttcaatcagagatgagaagattgcgcatagaatgctgataaccgactatttgctgctggttcactgcttggttttacattccgccctcacaatcaaggtgccattgcgccaagagctggcaatcaggcatataggtcatgatttacccaatttttgcaagcgtatgggaacctgagttttcatctcgacaggtcccctgttctcctcaagagttttatattttcgttgtgctggctgctgagaagttgaaagtctgggttgcaattgatttattcattatggtaggggttcgtattttacgttgtttgtaaaattgttgtaaaaatatcagcaaggccaaaaatgagagctgttatcacttagagaccgagagacagcagataggtgtagatttggccatgaatcataatacttgtattcattgtacagtagctgatctttactgtaagtctgtaacttattactgaaaaaggcgtgatattagttgctactctgattacctctgactcgaactgtaccaattgtactcatggcatgcaagggatggaaggcttaaggctgaatctgaatagcctgacacgtgtgcgtttacccatgaaattcactcttccatcccatgcatgattgtagtttttggaggatttgcgttgaatatttgtttggtcagtagaaatatggacaggcgaggcgcagacagtggtaaaacactgcaacacgcagagttcgaggacgtagattgtcgcacggttgcaagcagaacgccgcggtcgctcgccgtaaatcgatgaaaaacctaccaacctacctctacggctctacctgaggagggaacgaggaattgaggagcaaccgaacaaacgaaaagggaagaaactcgcctcctagtactctcctagcacagcaaatactacatccgtccaaaaataagtgcagccgtagatatccgtgcccaacgtttgaccgtccgtcttatttgaaaaatttatgaaaaatttaaaaatatttagtcacacataaaatactattcatgttttattatctaataacaataaaaataccaatcataaaattttttcaaataagacaaacggtcaaacgttgaacatgaatcgtgtaaaactgcacttattttgggacggagggagtacttgctgtgctaattaattagcaacgcggctgcgctgcgactgcgagccgagagagacaggcagacacgcagtgcgaaggcagcggtgtacgtcgtcgcgtagcacggcacacggcagacggggcgcaggacgcacggaggctggcgagaggacggacaaggtcagcagcgtgcgtacgtgcgtgttttgtactacacctctttgctgttgtgagttaaaacaagacgaatggcatgatgatgatatgatgatgagtcgtcgattatccttgagattttcagaggtggcgatcgatggcccccttgccccctgaatataatcctgatgacctgatcacgcacgcacgtatggtattgcacgtcaaagatcggtaggaccaacgtccaaaccttgaaaccctgaactgaaacacaggccggctcctacctaaattaagttgttggtagcacgtccccggagacacggctctcctccatcgagcgcgatgcgcccaatgaccatcagattcttccactgatccgctagctgcgtactcatattgcaccaacgcgcacgcaacgccttgccggttgcggcctctcctgccactgagacggacgtagtcgtagtcgtcgtagtggggggcaaagggcaaaggagacgacggggggccacgaccacgagcggcgcggcgcgaggattttataaggcgcgggcgggtcgtccaccggcacctagcgtcgctgtggtgacgagacggaggctgaactgtccgcgtcgggggcgggcggtggacgacgtggacatgtcacgtcacatcatatatatatatctccacaggatcatacatccatcgcgcgcagcctagctaccaccacacctgatcgagccgagccggcggactcgaagcatcacccaatccgtccgcccgaaacgggccgagatttttccgcataatatcgagggttgattggatccatattactacaaattaaatataccatttcagataaatgacactactatttgcgatattggctgcgtttactataaaattttgaaaaagtgaaaccccacgccatcgccatgacgttttccatcagaccccgtagacgtgggaaccacatgtcagttccatcttcctccattctccctgttctttcttcccatctcttcctccattttccacgtctaatacgagggacaacgatgttggcggttcctgagccctcccgctgtggatggggttgaagacgatggcggtggtgcctcctgagctctcctgccacggatgggagaaggccagcgatgacgacggttcccgagccctcccgccacggatggagtcaaagaagacggcaacgactcttgaaccctcttgccctggacgagagaagttcggcaacagcggtggcaacggaaagagggagagactgacaagagagaggtaggggaaagagaagacaggggagagaggtgaagaagatggaactgacagctaagtcgtcccacgtgcagttaaggctaacagagatttttgacatatatcgcgacggagtggcacagttccaattttcccaaattccagtggcacatgcatgccgatatcatgaacaatggtggcatttatctaaaatggtatatttgtagtggcatggatccaattaaccctaatataaaggcgcaccaaggccccccacatactctttcaatctcaaaataaaggctatttttactccccttaagttttgtcctacaataaagatatttatttacctacctacctcatctattgttcctcatttaattaatttcttcatccatattttcttctatcaaggcccccacatactctttcaatctcaaaataaaggctatttttactccccttaagttttgtcctacaataaagatatttctttacctaccaacctcatctattgttcctgatttaattaattttttcaaccacattttcttctcagctaatcacaatatataattttggattaatttcacctactttccttaataccttgtatccaaaactctgcaaatgattatatttgggacagatgtgtacgtagcatgtcgctagctagaagtactacctgtatcgctatcagccacaggccccctataattgtccggtcctacgtactccctccgtctaaaaaaacaaactctagtttccatatccaactttgactgtctgtcttatatgaatttttttttataatttgtatttttattgttgttagatgataaagcatgattaatattttatacgtgacttgtctttttaatttttttcatatttttttaaataggacggacggtcaaacgttggacacggaaaccaggtctgtctttttttttttggacggagggagtactctccatcgacgacgcaacagtaagtggcagcccaaaccctgaatgcatatgtacaaacacgacggggggcgaaagcgacgcgatatggcatgcaatttagttccctgtctgcctcgttaaattggctacatatacacatatgcaattatttttttgaggaggacacacatatgcaattatgcatcatgcgtgtatagctttgaccgatcgatctcgattggttggtcggtcggtcccgatccatgaaattatagaacgagaccatgacaagaccagatggggttcatatatatagcttcaaaactaagttattacctgcagccgttcattctcgttcgtccttggatgcaggcatatatagctgatactactctacctcggaacagagaatcagataagtatatactccctctgtccttaaatatttgataccattaactttttaaaaaatatttgatcgttcgttttattcaaaaacttttgtgaaatatataaaaccatatgtatacatgaaagtacatttaacaatgaatcaaatgataggaaaataattaataattacttaattttttttaataagataaacggtaaaatatatttaaaaaagtcaacggtgtagaatatttaaggacggaggagggaatagattacatgcatgtaacgcagtactccctctgtcccataataggtgacgtttttgactttttatttgcaacgtttgaccattcgttttatttgaaaaattagtgcaattataaaaaaagataagtcatatgtaaagtacttttgataataaagcaaatgacaaacaaaataaataataatttcaattttttttgaataagacgaatgatcaaacattaataaacaaaaactcaaaaagacaagtaatatgggacggaggtagtacaagaaactatatatatgcaggccggccaattaaggtcgtcgtctgatcgtctctccgttgccgacagcagcgagaggggaggactggtcgtggccacagcctgacgaagacgacgacgagtcgaccgatcgccaaacacacaactgcactcttgcaggggcaggcaatgcagccaggcgcccatgctgattttgaacggccagctcgatcgatcacaaaattaaccaagtacgtcaatgcaaaagcatgtactacatgcagatgcaggctctggatgatctgaatgcatgcgacactgcacgacactcatcatctgctgcccgatctgcatgcctgtcagtagtgtatctatcgctctgtgcaggtaccctgtactatactgatgatctgatcgatcgatcgatcgatcgagaacatatgtacatccattcctcggttgaatctttgatcaacttgtacacgcagatgcagctacaatctatcagtatatatatactactcctatctatgatctatcagccgtggaccatatgcacgctggctgccggccggccggcgcctgagaagagacaagctgtacagctgcttgaagtaattgaagtttgtctagcttgaagctgagctgaatgcctgaaaccctgaagcaagctagctaggttgcgtcgctgcaggccggctgcagctaaactaggagctatatatgtactaggtagcactagcagcagctgctgcattgcgacgtcgatcggagaggggacgggcatgtgtaggggtccggccgtcgcgcatgccgctagctgctgggaggaggcgcagtcatatgcatgcatgcaaacacacatactcagctcagattgctgttcatttcactgttcgatccatccacttttcccatcttgcattgcccttgtgggccggggcgaggtcgacctagctccctctcgatcgatctcaccgccggcagccaccacgccatggccgccggcgaggagatagctagctgcaaatcgcattgctgcaggtgttgctgctgaaaattggagcggtgattcgatcgaagagttctattaattgttaattgggatggacggctagctgagctcctgttttaatttcttctgaatcattgatcgaaccgaatcaataatactgctcgatctctcgttggttcgtcagtaattctctttcctgcagtacctatcaagcaaagcaagcatatatgaatatgacacgctgattggatataatattacacagcatgatcgagcatgttgatccagtcgtctgctagtgcatgccaatactactgcagtatcatcatcgacactgccgttgtttcagtactgtaatatcgacctatggattgttgacctagttctactgccctatatatatatatatatatatatattgattctctctttggatttttcttcagaagaaaatcagtgtcgatacgacgacttgatcacaagcagctgggctatatgtgatgctcacgcatcaaagtgcgtgctcattcttttgttctgaattaacatgagcacaaaccaaaatatatatattcttgctagtccagctcgcgtgatatactctacttctttggatcgagtatactatatactactatatcactgtttctctatacctttttaaatatataagttctctatacaccagaacatataaaattaagacagaagaactaatatataattcactccaagttggcggcaggatgaatgagagccacagaaatataattatgatgcacttgaaaaatacacctgatcatcagatgatgatgagtagaaaaggagaagtgtcagtgtatcgagatcaatcgatggaatgcacacggctggagaagaacatacctcaaattttgtcaggttgtacccctaaaaaaatgtcagatatagctgtgctgatagccactggtacatcaagtgcgtagataatacaaaatgtggatgaatggcaacgaccaagggtcaatatatactcaatattcatgcatagagtgaccatatagacacatctactactgctaaaaccattttttatgtgcggataaaatcgatttccaccaatgacagctctgggtgctcctcttcctcgcttgtggtgatgcactgaggttggtgtaacgagttcgctatggcaggagactaggagccgtggaaagagcggaatttcagggttttcgattactctctctctcttgttagtctcagcaattctggaggccatcctacaggaagattgtctgtggtcatccactggcgccgctgcttttgggggtttattagaagtatagtggggctcagccgccaccctcctatagaggagcagcgtttttccgttttttttttactttagcagtccttttgtttctttctattttcccttgtccccaggcaatggtcatatgatcggttgcgttatataacaaaagctttgctttcttctaatatattgacgtgtaatcttttgtgcgttcgcgaaaaaaacagccagagacaaggagaaaaaagataaaagaaagtgtgatgagaaaaccaacgttgtcctctatatattatatttattggaaagaagagaagaagcagaggatagaaggactagtggtaatggagatgcgaccagcgtttgatcgacggcttgatttttgaagcgccgatcaccgaagagttgtgaggaagacgacaagacaagattcaagcagataaataggagcatagcctggaaaaaataaaatttcaatgacggccagcttaatgtcgaaataacatcatttccacgagcgatcagcttaagtgaccacttttaaaaatataatttttgtagacggttgcttaagacgattgcctttgaaaaatatttctgctaccgatctttcacgcaatgacacacccactactctttagatgtactgcacaggcagtggcactatgccgcctgtgcaattagggggtgcttgtgaaaaccgttttttctactactcctccgtttcatataagttgtttgattttttttctagtcaaactttgttaagttgacgaagtttaaagaaaattcagcaacatctaaaacaccaaattagttttatcaaatctaacattaaatatatttagataatatgtttgttttgtgttgaaaatgttactatatttttctataaatttaatcaaacttaaaaaattttgactaagaaaatattaaaacgacttataatatgaaatagaggaagtagtagtgatcatttgatcgactggaaaacctaaatgatcctacatattgcattgacaaagtgtatcccatcgtggtaggatgaatctaacaaatctttatcatggaattaatgctaatacaaattgataattcgcgacatttttgtcaaggagtatttttctaatctaaattatctattcgggttccggtagtcaatcccctccatatttacattacgtcatatatacaattagtttcctcggcatttctgtggttctgtcttcaagtcaacaaaatccttgcatgcagagaaccaagctagcacaatcgtaacgggaatcacactattatagtacatcatatctctagtgatatatctctctcatgcattcagtataggtcaaagactcaagacgacccaaaaatagtcttctttcgcaagaaaataaaatgccacaaaggtgtgcaccaataatagctgtcttcagtcaaaacccatcactactttttttcttttagtttgaagaatagaacccatcatttacatatatagatcaaattaaggttacacaaagtgtgctaattaaacatacattgtcatgcatgatcctcacaaacaaataatatgtataatatatagcatactatctctatttttaataggtgacgccgttaactttttaacacacgtttaatcattcaacttatttgaaagatttacgtatcatttatcttattgtaatttgttttataaataaaaaaatatactttaagcatgatttatatatttgcataatttttctataagacgaataatcaaatgcatgtctaaaaaatcaacggcatcatcaattaaacaatgaaagagagcataaagtcctttagaggagtacgtgaccggtactcagtagcctagctagaacatacatgctccatatagttatacttgacatgtactatggtgtaaattaaagccatatatttgatcagttgaccgatcagaagacattactcatgttgaatgttattcctaaatatatatacagcatagtcaaagtatatcaaaaactgtacacccacacacatgcctttaactacagagacaacgtcacactacctcttgtgatgttgcccctctatatatctttcatccacgtacaagactgaccctaaaatagtctaacttctggataatatatagtagcatacatatatataattatttggtgattctctcttgatcatcagggaattcatttcactacttctaataagatatatatatatatatatatatatatatatatatatatatatatatatatatatacacaatatctagaataaatgaaatactagtaattccctacatttagagggcgcacttattggtctcaattggttaattagttcattaattatctaggatgtgaagcaaaactaaaacacataccttagcttgcacctataaaaacatgctttagtcaaagggatgacacatttacatgtataattaatgttgatatacaacaatcaaattctagttcagaaaacataggtttgtactgtagaaacaaaacatacatgtcatggttacaatatggcaacaatatagttgcagctgctgaagatcatgttccttggagtgcatagcatatattgtatcaaagtgtgtggatcatgcataatgctccacattttgatatttgacatgtaattcatatatttaatatataaactaattcgtatgtgaagaaaacttacaaatgcatataacattttattcccacattggtagcatcatcatagtatccacgtgattatactcatgcctatatggcatatttggttggttgtatcaggctggcttgcttctctgggtgcaacttctaaatcgacggctctagtggtcaacttctaaatttgtcatttgcaacgtgtcaggtcatacaatggttctatccttgcctcagcaaaatcatcacgcaacgccaaagcaaccgtaaccggtaacgtatcacactatctgcagtgatacgtcttatctatcccttccgtactaagccccaattccaaaagaagtcttctaaaaaaagaatagattgatagacaaatagagtaacgcacacaggcacttatttgatgctccatttggtgtacgccgcggcgtgaatacgtaccaccctatcttgtagtatctacagatggcgagtagataaggtaacgcacaatgtagtcgccaatttgatgcttcgttcaggttcaggtgttacggtgtgaatacgcaccagtctattctataagatagggtaactaacgcgcatcctataagatagagtaaagcacatgtatagtcacttatttgaccctccgttgggcatcgcggcgtgagtacgtaccacccacaccctatctctgattctccccaaaatccatactttggtagtgtcttgacaacgttatactagtagccatagtgacgtggccgtggtggcaatggtggaggtgcaaaggctataagaacacggtcaacacaacacggccgcaaatcagccatgtcagcgatcgagcgaggtgtgacatagcaagagatagagacgtgggcagcaccagccagccaccgaggtgctcctcctcgtcagacagcccagcccagggcccgctcccccatggtgggtcccaccgcaccaccccctggtgggccccactccccccttccccaatatacgcgcttgtattttaacccttctcctctcctctcgtctcctcctccaaaccaaacccctcgcctccgctttgaccaccgccgcgccgcgccacgccgcgccaccgtgagagagggagacagatggatccggtgacggcggcggcggcgcatgggggtgggcaccaccaccaccaccacttcggagcgccaccggtggcggcgttccaccaccacccgttccaccacggcggcggggcgcactacccggcggcgttccagcagtttcaggaggagcagcagcagcttgtggcggcggcggcggcggctggtgggatggcgaagcaggagctggtggtgagagcaacaacaccatcaacagcggcgggagcaacgggagcggcggggaggagcagaggcagcagtccggggaggagcagcaccagcaaggggcggcggcgccggtggtgatccggcgtcccaggggccgccccgccggctccaagaacaagcccaagcctccggtcatcatcacgcgcgacagcgccagcgcgctgcgggcgcacgtcctcgaggtcgcctccgggtgctacctcgtcgacagcgtcgccacgtcgcgcgccg

SEQ ID NO: 8017 - DNA, 4283 bp, Oryza sativa
tccgccaccggcctcaccgtgtacgtctccggcggccaggggcaggtcgtgggcggcacggtcgccggaccgctcatcgccgtcggccccgtcgtcatcatggccgcctcgttcgggaacgccgcctacgagcgcctcccgctcgaggacgacgagccgccgcagcacatggcgggcggcggccagtcctcgccgccgccgccgccgctgccattaccaccacaccagcagccgattcttcaagaccatctgccacacaacctgatgaacggaatccacctccccggcgacgccgcctacggctggaccaacggcggcggcggcggcggccgcgcggcgccgtactgatcaacatcgatctcgccggagagaaaaaaaatggaggagaaggatcggagcgagccgtgcatggtgtaggatgaattaagctaagagttaatttcttcttccgcctttgctaatcatgatgctctcgtgttgtttaatctgtggcaatctgcttaattgcaagctcatcactgcaattaagcagcagctaaggatggttggatggttaaaactagtgctctctgttagtgttgatgttaattaattaattactttgtgttctttttaccttttatttactcttgaatagactaccttaagctagctagcataatgcatgattcatgtagcttaattagttaaggtagccaggtagtagtaattaaggaagggaggcatgatacaagtactactagttgctagctagatagtggtaattagtcaactaattaagggtctacaagccaatcaatcaatcaattattaaactaatcatgtcattgtccacctttctctcttaatttgtctgtagctgggagcaagggggtagctagcttagtgtgcaaagctgcgtattttatggagaatgatgggtcagttcgttgttgtttctcttggggttggctcatccggtcacacacacatacacatatgcatatatgtcaaacaaggcatctctggatggatggacagatggtatcacatgagcaaccacttcaccaacgaatggatgaccagatcgatcagatgattattacatggtagaataattgcttgattagctctacttttgataagttgatatcctctgttcctttccgttttggttgtgttcagatgggattaagcacaaccacttcaccttctatatgatgcatatgcatatgcttgtgtggcaccacatacgtgtacacacagctattgctatattttatgtctccggaacagacgtttgctggatcctcacaggtgtgtgtttcatcagctgttcagattcagctgtgcgtgcgtagctacaacttgcactccaacaattaggttgggcgcatgcatttcgtcattgttgtgattatttctttgagccaggatcgaggactactatatatatgtatacaaaattacatatatgtatttatgtgcagatatttatatccaggattagcactattgaatttaaggaatttttttgggtgggggtggaaaattttccgaaatttcaagtggaaaattgttgtttcatttttttactcaaatatatatatttgggtatttaattcgttgcttcttttaaatatattaagattatatgctactaatatatgaacaataaatttgaaaaaaattatggacccatattttggcggtcttgaccgccagtaatttttttttgtcgatttgaaaactttgacattgctgtattttgctttgaccgccaaaatagatttccctaccggttaaccgcaaagaggaaaaaaaaaaaggcattccccttgctctatagatttggtgtgttcattttccttgaaggttggccgacaaaagtgacggtttgtggcactctaagaaaattcatgatcctggtagtgaacatagaattattaaattttttgttttgtctgctagcttgtatggagtatatcattgcccactagatgtgcatggttcgtataaaatcccaatttttttacaaatataaatctaatgcgcattgcctactttgtaataactccgttaatttgtctcgcaaattcgtttgtcaggggatttgtgatttcataataaagaaaaaaaaccggaggattttaataccaatgcatttattgcaatatttccatttgtgtatttgtgttgtaaaaggaagcaaatagatgtaaaactactgggcatataggctgagaattttcttccactttgagcaaacacatagagaacaattattataaacatgttgaacactagataaaaaatgtataggccatcacagttatgaaacccaaaccatcccgggcaacttgtctggttcacacatgccttgggcctgccgttgtgtacaatgaagataaaagcgaagtgagtgtaacttaactggttaggtttctagtggtggaacttgcccacacaaatttgagccctacactaggcctctttggattgagggattttttagagaattttcaaaggaatattgtagatagaaaatatttcctttcctgtcgttcagttcataggaatcaacacaaaggaaaatcggaggaaaaattcctttcccgtggaatcaatagagaaacaaagggaaatttccatccacttctacctcattttttccatttcttacgttttttctctgtctatccaaacacatgtttaccaatcctatctacagaattactgtgtttttcaatcctctgttttttctctattttacagaattactcctgcatttttacaatctcgtaatccgaataagcgtaacatggatgatcatacttacggctaattattcctttatggtacttagagggatacctctcagtatctcagatatcagcatgtatcatttttttttttttaaaaatgaattttatggtccttaagaggtaccataattaatgtactaaaaggtaccaaaatttatactaaaaaaatatgatttttccaataccgcaaaaccaacatttacaaaatatgatacctggtcccttctcgcgtaccgcgtaccgtaaatttctcaatagataccccatgtcttgagtgaaattagtgctttgtaacagtgaaccatttttctggatccgcctcctgcggtgagtaaattagctgcacatattgtccatgcatcactgcacactcagttgatgtcttgatgatcagtatatatatgcaattggatcaatcgagctagttagtgtgcatgcatgtgtgtgtacttgcatccgagcatttccttctcctgcagctaaggtagcagggagcagccagtgctggacatatgctgcctcgaagcatgagtacactgttcatctttgcatgcatggttgggatcggaggactagtgcacagtgcaccccctccgatcctgcatgtccagcagcagcctgcatgatgcatcgatcgatcgatcaatctgcaattgtacatattcaatcgatcgcatgctcgcatgcatgcaagaattgaatgaatatgcatggtttgttagccacagagcaggccagagagcaatgttaaaaaaaaaacaagaagagaagcagcagcaaatgattctccggtgcctgcactgcatcgatctagctgcatgcatgcacgcttggcatatattcagatcgatcgatgtatatgcagttgcagttaattcgatcaatttgtttggttactttttttttactgaaaatgcatatagatgccatgatcgaatctgaatgtgaatgaatgatcgagccgcgtgagcaaaggcagcagcagctcgtttgcagctttgcgagagggatcgttcgatcgagtagctagcgcgaagtttgaggctgatgcaaggaacagtagatagctagcagcagcatgcaagagagtgagctgtgagcagcagatgcagatgcagagatgcagctagcagctgctgctgctacccagtgcggtaatttaacaggcatggagggcgacatggatggatgcaatatgcagagaggtgaggtatgggccactgaagaagaattaatcgaggtgagctccgtgaagaagaaagaattgatcacttgtagagagtagagagagagagtgaaatggagaattcagatggatggatggatggatgcgtgtgatgtgatgtgtgtgggtgtgatatatgtgatgtgagagtagaggagaagatgaagagagagagaggctggaggtggtggtggtcaggggcacaagtgcagttggcgcctttttgaggcagcaacagttgggaaggtatggcg

SEQ ID NO: 8018 - DNA, 2316 bp, Oryza sativa
tttgagcatgcatgatgtgatcgtcatgctcatgcatgcatgctgtacatgcagacgatccagcagtgttgtgcatggattgatcgtataaaattgccgatcgatgacgatgagagagggcgtttcgtgtcatctaaatttgtgtgaaatcaagactcaagcaaaggcatgaattattcagtactcagtcccatgcattgcatgcatgcatggccgcgagaggtgaatgatcgagcatcttcaggccatgatcttttttttggggaaaaaaggagcatcttcaggtcatgcttgtgactgagatcgagttcatgggataacgcagaacatgttatgcatcgatatgatccatattgctgcaggagattcatgtggagatgcaaaagcttattgatacaccccccttcgatatatctgataatctgaaaggagttcttttttttttcataaagaaagtctgaaagaaattaaaacaccagtactctaaaaaaagtcttaagagaaaactactccagcatgcagggcgtgatgaactctcgcaactaatttcatgcgattttgagtcatatatattggacagtgccagcgttggcgatcggttatttctccattagttatccagctgcgtgaactgtgttgatacacaggatttcaatagaaaatcaagagtgcagcaaaatactatgtggaaacacaagtgcatgcgtgctagctccggccttagttttttttttttggagatcagtacataccaccagctagcgatatgatcattcagcgacgtgcatgtcatgactaactgaattttttgcttctgaattcggttcatctgttgccggcctccctgctagtcagctcatcaaaaagactacaatttttttcagagatgctgaattcccgtacgtaattctcttctcctccagccctttccattggacaattgcagctactagtagcttaccagcaattttttggggttttcaaacaagttgctttgtactctctccatatcaaaatatatataaacatttttagactctgacacgatctccaagatgctattttgaccaacagtatctataaaaattaagatgttttaaataaaaaaagttatatattatgatagtttatttaatgataaatctagtaacatcaattttacatgagtaatattttttattttgttgctattaatagtcaatgttgaaatagtttgacttgtcactatgttaaaaatatttatattttgggacggatggagtatttcttaggtaatctgatttttttttcgattacatggaagacgcgtacgcacacataacacactcacacactggaaaatatatgtgtttcttaattaaaacatgcccaaattagagacgatggaggtccaactatagttcccctagcttcataaaaaatatgttaaaagcgcacaagtatacataatattcctcagcgtcaatagttaaattctgatggatggagtcatacacccataactttcaagcacactatactagtgcttcccttaggtcgccaacttttctcttatcaaaattttcattttgtctgaatattaatgtgatgaccttttctattcgacctaacggatgaaaaagtcaccaactttataaaatccggggcctctgctgccccgttgtccctctgaaatctgaatccgatccccacccaagattaatccggccagttttgcccgatgccattggttgccgtcgttggcgaagaagctgccggagagagctagctggaggtcgaagaagcacaggcaataaactgtgatttcttttgttctcagccttccagtatcagcttgtcccatatatccaaaatctcttactccctttgtcacaaaatgttgctatttaagatgggatttgaaatcccatcctaagacaacgagaaccggatttgactcatcctaagataatgaatctggacagaggttctgtctaaattcgttgttctaaaatgtgtcaaatctcatcctagatagtaacattttgtgatggaggtagtatattttaggacggggagtagctagaagtaccaattagttccatgaataaaaaaagatcgttcttctcggtgaaaaagatgcctaatttaattcttacaaagggatgttttttctactatgtattatatcatcatccatatcatatactcatattcggagtatatatgtactgtatgtctgtatatatcttttgtctgaatttttcttacgtgcacgacgaacagccggccggccggcagagtagcgaggctggagagattttggtcgtctcggat

SEQ ID NO: 8019 - DNA, 2420 bp, Oryza sativa
actgcatgtatgcatgtgaaagtttattactgcatgccaatgccactttttcgttgggaatccgcggcttgtcttttgtctgaactctgaacttgtttgtctgaattgacaagggcagttaccattaactactcggtaatcagttggggatatttgggatgagcagaattgttctcatcagtttctcacactgactgaaagccgaaagctggaagcctgaagccctgaagcactggaggacaaggatgttttaaagtactcatctctccaaactccaaagctgtggaagcatagtagtagtaccggcagagaaagaatagatatagatagcctatagctatagatgatgagtagtaggagtaggagtacatcctaggactggatgagcgagtatcacacactgcactgacaagagagtgtatgtgtttctgcttgcagatgcagaggcagggcaggcaggagtggctcaaggctgatgttttcctgcatgcttgcttgctttggttgtgtctatctacgagcacgtttcgggagctgagattttaacaaacagtaggtaagtagcccgccgataaaaaaatatatatataaaagtaaatattaggaaagtaactaatatcaaataaatagaatggatgaggtttcgaacccaaaccaactagcccatcaccttgtgagaatagtccgaagaccgctgaacgtttctcttgaatgtatacaactactactgattctaagaatctaagagctgaagttgtagctaggagggtgtgtttagttctacgccaaaattgaaagtttgactaaaagtgaaagtttgaagaaaaaagttaaaagtttatgtgtatagaaaaatttttatgtgatggaaaagttaaaagctagaagaaaaagttgtaaactaaaccaggccaaactcactcaaacaaggtcagcagtctcatttttccatctgaaaaaaagtagtctcgtttttcctctgcctgtctgtctgtgtgtggtatgtgcatgcatgccctgcaggtttatccttctcaaccactctgatgaatgatgatgctgaccagtgaccactgctgggacccacacccacaagatggggcccttttcatgtggttttcagtttaattaatttcctaaagtctcctcctcttgctttccttgaagttggtgctgtgaaagaaaggccctacctgaatgtcattatcacactaacaaactgtgctcttatctgcttctgttttgtacttgtcggcagaacaagcagatgcagacatccaccttctactattcggccggatttgaagggccatgcttacttgcaaccattcaatttggcctctgaattttgaatagtactaggtcccaagaccctgaactaaattgtggcacttactgaatgatagaagctggagcttagcaaacaggttctttgttcatatgttcataaaaatgaagagtttatgatgatagataggcactgctaatgtttggagttgtttcacattttcatctgtttcagcaacgaaatcctgcagcctttgtgagaacagtaaatgtcaagcaggtttgttacaatctgtggcagcttatttgggctaccaagaaactatttttcgcctaccaatccccatctctcacagaaagcgttcattcatttttttctgacgaaacattctgcagtttttttttttttgtgtaggaagtacggtaggttgtcaccaccagggttgctttgagcctttgacctttgagaggaagagtacaagttccagtcccagttcccaataatttttgaagcttttttgaagataacaaacatgggccaacgcatacggaacatgtgcacctgatataactactccctccgtttcacaatgtaagtcattctagcatttcccatattcatattgatattaaatatgtctagattcattaagatcaatatgaatgttgaaaatgctagaatgacttacattgtgaaacggaggaaagtattaagtttgaaacagttgtgcagccaagaattcttcccctttggaccttgccctgtgatcactagcatgtgtactgatacagagagttcagttaggagtatcatattgcagaccacagcaacctttctgcagattttcaggcaacgaacacattatttaacaagaacattctcgcctgatatcacaaaatgtatgacgcgtctctcgatatgtttgacaaaatgagatcaccagaatggcaactagagtaccgtatttctcttatgactgctacaacattattctctcttttaagtccaataccaatggagacagcaaaacaaatctcatatctccacatgaactcctgttgatgaaataaagcagtaggatttcaaagcaggagtaatgaggggagaacaatacaatctaacacgtataact

SEQ ID NO: 8020 - DNA, 17491 bp, Oryza sativa
agttcttgatcctaataagttcatttgcttcattttctattttatcagcctgcagggaaaaaagtgggcaaaaaaccaattcaattcaaagctgtgttgccagacactcccaactttaaccacttagcaaaccatctacgaaaaaccccgacctgccctcgagctgctccagcaggtgactgaagtgaaatccggcaaagaggcatacccgtacgtgaacccttatcataaaaaagggcaagaaaatgagtataatgacttagcatactcaagacaaattccaaaatgaggttgatattagagtagtgataccttttcaccagctgcaagaataaatcctgccaagttgaatgcaaagcccaggcaatgagtaccaataggactttttaggcttagcattgtatcatataatgccatgcatggtgtaagctgcaacatcattgatgaatacagtttagaaagtcactcccccagaaaaaaatgcagtgtgcgacatagattagctaacagtaagttgacttggttagatatctcggttaactagttggaacattgaaacaaacatttgacatattgataaggtatacttgaggaacataggttttaaagtactcttgttatgctcagtgagcattgcgcacattgatttccagttgattttgaattccaataaactttctttccataccaggtctgatatatatcatctaaagtaaaacaattttccaaacaattgaaggatcatgttgtcataactttcccccgtcctagattatcatgactagagtggccctctttccaggataagtgttttgatccaatataaatagttagatacataagtttttgtatcggttttgtcaacatgtacaacactgaaaaataagatcatatattcggacaatcccaaacattctaacttacaaaccacaaagtagcactggaacgcaggaagccccttcaatgagctatacatgcggtgttagcaactgattagttcatcccagttttattaaacttttgaaataacaccccggttcaatttcttaaagtgacaatgctacttgaaaatcacaaaatcatggcctggcatatccacatatataaaaatagagtaaattgcgccagttgtacaaaaacttggcaggtgggtgcgatttagtgtaaaaacttgtaaaatgagcaaaccggtacataaacttaacaatcacgtgcattttgataaaaacactgttacataccaatgattcatcgtattttattggttgtattgtaaacatatataactgctagattaattgttggcaatgagaatgttttgcagtgctcatcaccgattttttttattagttggatcgctcagaaattttgttagttggcatgcacttagttttgataatcattatttttttccaattttaaatagtagattatttagtatgataaccaagcaaatgcaatacatctaaaaccttgttcagaactcaagatgatctaactggctgctttttctttacatagctgaaaaagtatggtttggaagagagatcttttaaccaaaatgcacgcactaaccaagttgttacacctgtataatcatttttcaaattcttgcactagatcgcacccacttaccaagtttgtgtactatagacgcaatttactcataaaaataagtggcataaaaaaaaggctaattgaagctaacacaaggtgtggtatgttaagttcttacatctcctcctggaccattaatgtatagaagaatctttttagtgttatcaacgctgtcaagatacaacatgctcgccaatacttggttactaaactcttcatctatactgtccccaatgaagataattcgttcgcgatactgcacatgaacaatttgaattagataaacattaatacagtcacacagatagaaatagatgcaccacttcaaggaagcatcatactccattaggcattgtgtagtcttactagagcattccatatatcaagccattgccaagttccttcaccaggtgttctgtaaggcacccgtggtgtaccaacaggcatcattgaaatgcgcgccctggtagccctcttgtttgataatctagcaaattttaatttgaagtgcaatgagataaaataagtgaacaaacaattcagacaaactacaccgacattattcagatattctttggctacctcaagcgctaacaaacatacatattattgttagaacaaaatattgcctataaacctgatgggtgttgaaaattggcttttgaaaattgcaaaattatccatcaacacagacaaatgcccagagctattagattttacaaaaagtatcctttcacatactaacaaacctacagacacttgcatgaaaagtgcgacgcataacaaaaaaaattgaactagcacaacaagcataatcagcacccagaatgaagagttgctgaactctgaagattgtgcagtatcacaatcccatttatccttcccacattataacacatacacgatgccccccaacatcaagttgagcatatcgatggctgcgcacttgtgacgtaccccagagagatcctccggttgacggcggtgtaaaacccggcggtgacattcgggcacgacgactccgacgagcctgcaccgcaatttccaaccccacaaacaccaaaaatcaaacaatcgacaacaatgaggacgaatccgacataaattcgagaattaatctttttagctcctcgctcacctagcttggtctgggccttcaacccgacgaagaccttggtgcccacgctgcaaaaaggggagagatattaaaatgaaaaaaaacgaagagcagaagttgcagggagggttagggttttgggggtttggggatcggagaaacggggaggagttagcgggaggcggctgacctgaaagatgagggcgcgctgcggcgccggcgcgcgggtggaagcaggaggagttcgccggcgccgccgcggacagcgccatcggagtgatggggaggagagcttagctcgcggggagtgactgacgcagtagtggataacgaagatgcgcgttgagattcgtgcgtcgctcgatcaccgtaggtgcagaaaaggaagcgtgctgtcgtttgtctcgtttctcaacagtgaatttcgtagttatatgctggttattttaggatgaaaacaaaataaatttcacatttgaatgttcgcattagagagaaatttatgtggtcaaaatgtaaaaaaaaaatcgattataagcataatacaggacgtgctggaggcagcagtaatctactcgtctactccatccgttcaatatgccataagtacatagaaaaaacataataatatgtataacaatcaaatggatttttattaaatctagtataaatatattttaatagtatgtttgtttccttttcaaaatattgatatatatttatataaatttggtttcacttagttaaagtgttttatgatacggaacaaaaggaatgccttattacaagttggcaaatataagatgtacagtcatttgacaacggaacaatatgaaaaccatgtttttcttttgagtcgtgaccaccatttatagtacgtttttactgaattttcacttcagatgttgagaaagaaaaccatgaacatttaaaggttattattacagtgcaattcaccttcacatccagtgatccaggcatccagcattgcatgagttctctcccatgtttcttttttttgtcaggactgaactaagttaaaactcaataaatatagcaaggccagatgtttgtcaactacactaaggtcagatgattcagtagttcttctctgaattctttgttaggtttcatgcaaaaaatactcaacgacctatgcaaagtacattaggcaacaaaatagaagtgttgtgccatcaggtaatttcatctcaatactgttctagcaagcctgaatagacattctataagctcaatttcctgcatgtagcgcgtccccttgtcaacaccaccctgtcaggcaaattaggcaagttcaggagaagagatcagccatgcaattcctatggaggatgcaacgtgatatgaacgtatcatcagaaataaacgataaatcaagcaccttttgctgctctgtcctaacaggtggacttgagcgccagagtttcagactgacaaagctagctccgctcgtgtttctatcggttttcttgtcgtccctgtcctttgcctctccttccaattttgcttttgtggaagcgaaccaattgagttcatcaaatgagttatcttgctccaaaaccttagtgccatcacattggaaatgattaacagaagcaagatagaacgttcatatacgttaatctgggagcaagaacttgtgtgcagagggaagaagccttgtatcagaaactgaataaattaccagcagggtaataccgacaacaagaacatgttcatagatgttcctgtaaaataaactggaaggaaatgaaaactgcatctgaacaatgttaccttgaggacaaaagcaactccaagtaggaaaccatcgtaagtatgtgtgtatctcttgtcttcatgcccccgtcttaataatttatccttgagaagaagtctacattccatcatgtgggcaattacggatggaacaatttgaaagaaatccttcatttcgtgaagtttattgctctggagcttctacaagcatacaagaaaagtatgctgtcagtgataaagaaataacaaatcttcggttggtatcctacgcagtggaccttaggaagcaactaggtgcgagcggatcttatccatcggattacaagtacacgatttagatttggtgggctgcatgagtgcacggttcacttaaactcaaaatggcttctcacttcttcaatattttctcgttttcacttcaaccactgactacccaagtgagccttcggctgctatgctccatggactaccaaataccagctagcactctggccataaccgctgattgcaaatacgacataacagcaagcatcaccctgaacttggaattcttgcatccactactagcattgacctgaactagtaaccatgcttttaacagtacaaaagtgcacactacacataatggaacttgtccagatttcaagtgtacagggtaaaagatggaacatcagttccctagtcgttgagaaacagatctccgacaccctagagctttggagtctcagagccaacgtgatagccaggcagaaaattcgctcctggtgttcgaggcttccctaaggaacagtctcatgtatatacctcttgtaaatccacccccatccctctccttctctctgtctctcttctctcttgtttctttctttctataaccttgtaatcttttaaaaaaaccctgtaaacttcatttctatcaatgaaatgactataaggtagagccagctctaccttcttacgtcaaaaaaaaaagaaaaagaaaaagaaacaatgttacaggtgaatgatgcaaataccaaaccacaggaaaaatcatatgaaagtttggagttattcccttgtataactgttccaaaacattgtccaaacaaatataaccacagacagaatgcgtcacaactaatgcggtaaaatttgcttgttaactggaatatcatattttcaattggcatggaggtagaatatactaaagaactaaagatagtacctttgaaaagttggttgctaatattgaaaatggctgaattctatcgtctgatggatcattgtttcttgtgcccatgtccaaaactttactaatttcaacaatgtcatcatcccaccccagcagcttgcaacttgtcgtgtatctcaagtcaaatttgggttttctcacatatctacgattgaaaagaaggtcctgctgatgaagaaaaacacacaataataacctctacagatgaagttttgtacatcataccgtgacatgttgttcaaataacgggtgcggccagccgtaagtaccatcatgagacctagtacgctacctattctagtaacagcagcttgtacttgttcaagcaagtctagagcatggtctccaagcccaagctttcctagggcaaatttcatgtctccttgggtagcaggatgggcatcggacactccagtgttctgttgtaaagctacaagagttgattaaatttggtagcttaaatagtgcttatgaaaaacacatgcatgtgttctgaacaggatgaagtgcctaaggacaaactgtgacaacttcagtgacagaaatagtatgttttaccctgtaaactacgagtaacacgttgcgaataatttggaacagtggtagtaaatattacctctgattgtttgaaatcccttaataaatcaatttcaatgttgctttgaagcaaagcatgaagatctacaaacatccggtttaagaaaacaaaaatggaatctatatatgcagaaattcgctgtaaattgcacatggcagctgaagatgcaatatgatccacacataaaactctcaagttttttcggccttggccacccagatcattctcaataaacatctgcatgaaataaaacattagaaaagatcagttcgaaaaaaggagggaaagagagggagggagtggggatgaggaaagagggggctggacattacattaattagaaaaatatcctaatcaagtatgttacatgctaatacatcagtgcaggtgcaaaatatgtgaaatctatctttttcacagactagataaaggggatttgtgggctatcatcattctggtcagaaatacgaaattatgacctccacaggaatccatatgaaccatgatcactaaagcatccaattttcagggtacaaggggcattagtacccacctgcttgacaatgttgtaggaatatgcctcactaaatgaatcaagattttccatggattgttttagatcaaaatcttgatccgcggtatccacagtaagatggaaatcttccagttcaacaccatatttcagctctcctagttgatgcatctctgcatacatctagaatatactcaacaccagtcataagaaagtatttggaaatatatttaagtttcatacagttcttatctatacatgaaaagtatggtgcataactgcgtaccctgttgtcatagttagacatcactgagtaagtatagaacgcagaatttagatggttctccacaagaaatttaatatcaacaaacttggaaggtagtctcaagggcttcattcttaagtaccacgaaagattacgaaccccagtctggccaacagtataagcacagatagtgtcaccataagaaaataaatggcacactgctcaattaatttagggaccattaatttaatgcacttcataacctttgttgggttcacaaagactgatccttttaagtgagtggaatgaacatggagtcggaggtctgtctcaatatctctacacagtggggcaacaacctcctacagagtaagatagaatgaagttaagtataccctccaaagagaacctgcaaaagctagaaaatgttttaaggcattgcccgtgccctgatttttttagtatgaatattctgcaagtgcatttgctactttttttttagaaacaacatagtagtagagtactgactttattttgcaaggaacggtgttgtacttatgctagtgacaaactgcttttataggattacaattacaccaaaaacaggccttcatttggttcttatacaaaatggaattgcctagcttgtccacaccacaaaattacaacagtacacgagcaaaagaaccttggtccatacctttcgcagagcattctcaatttcttcctcatagtgctgaagagtaacagttcccacattcccaagtgtaagaagtgacattccatcagaaaatgcatcaatgatgttcctgtcaactcaaaataatgaatgccaagaaaaaccagtgataatggagatttctcaaaaaggttgaacaagtaaaaaaaaatcttttgatgttcggttcaaacttatgttcagctatcaattacgagaattaattccatgactggaacaactatcatccaacattccaacttatgttgtaaaatcaaacaagaacattagggcatcatcttcatgattatctgtacttactgtagccaagataatttgcaggcatctccatataccattgataaccaagtcacaagcatctcttttctccaatacaaaaagctgcagttcgtcctttcatcaatcagagaccagaaattcgaaagaatgctgaacttcgatataagctttctcacaccaaccaactcaatatccaagtaaccctgtttcatggctaagacattagtgtcacaaacatcagagaaatcaggctatgcattaaataacaccagcaataaagaaacacataatagcatttactgaagttcaagagaagtctgcaatcaaatcgttttacaagaactctaaaagattagttcgcaatctgctccaacttcagactaaatggagatgtgcagatgtaaattctacatatcttaacaatatcccattttggttataatatgtgctagctccctaacttaattagttcatgtgctatacactgcactcgcataggaaccacaaaaggctaactgttttcccttggaacaccctctaaccagctaaaccaagatggtaataaaggttggatttgaatgtgtagtgtaccagactgtgcagaatatccattgtaatagaaagtgtcagttgcctctgagaactcccacctccttcaagcaattgcaaggacatcagaacctggagtaactcagagatgaacccatgagcaaactaaaatttgaaattggttccaaaatgaaaatcttcttcaaaacaaatggactacaaccaatttaataacttaaagggaaaaatgatgattttgacgtttgaatctgacaattagctgaaaaagggtccatgtcaatacttgagtacaaacacttgagtgcgtcaacactaaacaactactagtcccctaattaatcattaacaaacataagatgaatagctgcaggaaatatctcccaacttgttatattttcctagtaacaaacaattaaacatcataaacattttgaaacactttcctcttcaatcaagagataaccaggaacaggacaggctggttcatatcgcaatgattaggcagaggaaacagacaaaggaaaataatagatgcctttaatgtgaacaaatagataaaaataggacctcattgaacattacatttctgcatttgctgcaatcctcataccatgaaggcaaacaagcagcattacagactcgacaaaatttgcatgtttatctatatgggtaattgttccaagatgtattaccaacgaaagtgaatcaataagccttgtctccgtgtctgtaccacctaaaagtcaatggaattttatatcaggagtatcaaaaaggaaataaatgagcaaataagtgcattatatggtatacaaagaaagtatgtctggacgcgttctttatgttctatcacaaatttctggaacactaccaatcatcgcttcccatagtcattgtaaaaattgaaggatcaagtagcacgctaagaagaaattaagctatatatgatgatccgttatacccttttgttcaaactgaagaagactttttagttgaatatgtgtaccctaaacggcacaatgtttcaaacagctatagttctaaactgctacatctagagctaaacatctttcgatggacagaagttcacaatgcaaggctgaatgatgcttctcatttccatgtataagaagcttctgaaaatagtattgtatgattctttttcacagaacacataaaaagaattgcttcacataccacgtatcaatgaactaagaaatcctgtcttgactgcctgactccccttggctatttcattttgtaatttagtctgcttaacacaagcaaagcaataaggacaatcagcactgtaaaaacaaataaaaaaattgtatagttcaggcagttggtgaatggaccttcaatgatattatgagttgttcaatatcagattgaatgatgttgattatgtgaggaagactgcgcactaagctagaccctttcatgtggaacaagtctcctatggcctaatacaagagagttagtacgatgttaaataacagagccacttgatatttcaaggaaaagccttgttcaggaaaaaaaaattccaaggatatgttggtagctttctactaccttcaatgacacaatcatttggcaaagagacttggctttctcccttctcagtggaaccttccaacgaggcaatgatcatcacagaaattagtccatataattcataaaaaaaaaatactacgtagtacaaaaaggaggtagtggtacagatgttaaagtctctgaaaaagtaatgctcgaacaaataattacaaatactaagttctctgttggtagtataaaggttatagtgtaatagtatgtatgtgtcaaggctatttgttatattctagtggtaggctaggattagagctctcctcctcttttttattttcccattgggctctcacaatgttctctaatagaaccgtgtcttcctcaaatgttatcaagttggacaatcaacttagctacatacaaaaataaaattataaattgatgacagctccaagtaacaattgaagaaacaatgagcccaaattggtattgcgtgattcaaagcagggtaataaaatttaaatggataggtcacaggatccacatggtaatcagtaaagactgacaaggcaaaatataaagagtgcaaaaggaaaagtgagaagtgtaggtacctcaagatgcatatgcaagtcaagcattgataggacaagcatatgtattctatctgcaagcactactccctgcaccgaagagcaagcaaaaataaacatgggctacttaactcatcaggaaagtgtctgttatcttacatcgcaacaatcgatatgtatgtaaatgggaagcagttttggcccactcacccaaagtgttaactcttatcaacttacagaacagcaaaattatattcttcgtaaaggatcaaaaggcattcatgctcaacaatcatgcctcagaaatactaattaagccacataaaacacaaagaacttgatgaaagtaagaaaccattttgcaggtcaacaagggcagcaaagttcttctatcctctgtattttggaaatttagcggtctcaatggatttacatgacagcattaggaaagagtcaaaacacaaagcagaataaaagttagaatatgacctgcaaaatttgtttctggagatgtcgaacccactcttcagtcagcatctgcgactgaaaccatgaaagatcaaaacacataatctagtacagttcccagaaatgtaaaaaaattttaccgatggatgaatggctgactggaatgaaacagaccagcatgataacgaatcatttatggcttgaatatccctgcacatgccaaacaacacttacagtaaaactgaagtgcccgaaattatactgaacacttagcagaaagggccatttggaaggatgtcatgttgagatgacaggctaatgctaaattggtcctggcagaagagcaaaataggcaaggcatgtaacccatccaaatgttccctctctgatgattatctcccaaaatatacttatgtaagtcaatgagacatacagcttcaatatttaaatattccacaggtaaagaaaatagtaattgtagtggctaagaatgtcgagcgaaagggatcctgttaagattgatatgtaaagatgaccaaatagtcctaccttgaatgcatttcatttaaccgtgccagatagctattcttcatgataccaaaagcttcacaagcttccttaatgggtggcaacaaagaaagtgatggagagcaatgaaacctaattaagtcagatagcacaatacgctttccaccttcaacatagaccactggaaccaactgaaatatctccactaacaggttcattgatttcttatcaggagcttcacctaacaaaatatgaaatttcagaacattgtaaatcttagcaatcttattatgaggcacaatgataggttgacttgaattattggttaaaaaattaagctgaatagaaaggcaaaaggaatgtacaaataatagtgtatacagtatctaagacaagaagaattatttcacggagaaggcaaaataagaaatgcatgcaagaggactagaaaagaacatatataatggtattaataaccaagaacattcatcaagtaccagttgtcgttgtgaagaacaaaaaaaggcctagaagatggagtatagtccttcgatcaatggggagttccttcaaagaacctgaagtgtaaaaatcaatattggtcctattggataacataactaacaggcatttgaaacatacaagtaaatgtactgaactaaaaaaaattgcacgctgctcaccgatgcgttgaatgatctcagaactgctctcagagaagaaagaataaaatgtgtctaacagtttcttattagatctaacgagggttattgaagagcacaaaggtgaatcttcttgcaccaaccgctgacatagaaataaaaatacagtgacatgaacataagaataatttaagctatatgtttataaaagaaaataatgaaagaacatgaaggtgatgcagcaacactcacttggaagaagccaatgtcaaaaagtttctgtaagttgtgtacaacttgatcaaggaaatctacatcctcgaatgacatactaaatacatcgacctcagatttcaccttgtccagcatcctatgaggaaaccaaaggtcaattttctgaacatattgatgcatgatgataatgagttgcatgggtggatagcatatcatttgatattatattttctcaatggaccaagcaaaagtagaagactttggctatagcattaagaaaatacttcaatgatagctcaccaagatccacaacaatttttttaagctatccattgacacataactgaaacactttggagtcaatctttatctagatatcttaagaaattttacctgttttataacaattaatactccgtattttaactttcaagacaccaattataagtgtttaatgaatgttaaaagacaccacttatcagtgttggtaagttatggatggttctttgaacatattgtccattgaaaaattatatccccaccgagaaactaaaagatgtgctttcagtgttacatatgtaattaatactcccaggctgcatgtgtagaatgacccagaccaaatgaacctaataaactagagaccattaataccttgagaatagagataggtaactcctggtattgccattgtgcctcaaaatttcatctaccaaaaggaacaccataagcccctcgccaagtgatccaaatacggttgtcaaatctaaacccttaaatgagttcaatggacgcacattcttgtcacggactgagcagattgcgtccagctgccggagcaggttcccaaggatcatcaccagcccattgatgatttcatacacctcaagtaacaatggaattgagtgtgcaaatgtcttttgtggctccccctccagaagtgcctcatttggtccctctgcagtgtgcccaaagaggagcagttgccgatagagattacttgacgcctagaaaagaaatggaaaataaggtagcaatcacatactgtatttatcgcttgcattccttgcatgtgttcaacattgtaacaataacatttcaaaaggaaaaggtaataaagcagcaatcacccatcatttatggcttgcatttgacatcatttagatagtggatatttcattaagcacttgcaatcatttcagaaagtaacatttctcatttgacgcatttgaattgactttgcatcctagtatcgccactgatactaaattgactacaaaattactccaaaagtgagtcccataattgaatagcaaaaatcaaagatcatggaacataatcgacaagaagtaatcctacacaagcttaaaattgagtaacacgtcacatttaaattcgagataaacggatcaactttagcgcgcttacagcatcagagaggcgggatatctcaaggcacgagtgggagagcacggcaacgaacttggagacgtcgacgttgtcctcggccgccgccgcggcggtcaagagggacgcggcgcccacaccgacgccggggtcggtgggggccacccggagcctgaccgaggcggaggacaccgaggtggacgcggagcggggcccgatctcggcgacggccgcgcggcaccggaaccgccactcgtcgacgtgccgccgcagcttctcctgctgctcgagtaagactgccgccgggagcaagagcaggcagagttaggggagtgagtccaaccgtggtacggagagagagagagggaggggaaccagcgaggtgcttacgtgacgccatcgccggcggcgagcggtggtcgccggccgtcgagcagatgccgcgaggggaggggaggggagtgtgaggaaatcttacatccaagcccctgcaatctccccaattcttcttctgctttgtgttttattcagatgaacccccaaaattacgagaaattgtaagcgtggctctatcctttgatgcgagtgggccgataaggcccgtgaattgtttgggctctttctcgaaatttccagccgattgggccgaaacaagtctcccgtcacggttgccacaggccatccagtttgtccgattgggtcccttttgagttttttttgttcacgtccctcaacctcaaaatcggattcaaagatccaaaaacttatgaaaccattgcaaaatgagtcccttaacggtttggatggcgttttcgtgctacgtgatgcttacgtggtgttgttgtcctggtctttaactgacatggcataggttatcgaaggcccaaagcccatcttgatttttaccaaaaaaagatcaaacgaaattacaaatgcaaagtcaaaatcgttcaaaaaaagaattttcgtttataatggtgctgtttgttgatgtaacagaaagtattgcatttgtttcatttttttttgtccgaactttgtctgaaccaaccttgaaatggacgatcacatgagaatgacctcggttacgtcaatagaataaaagtgaccgaggacgaaagaattgcggttgacctgagcagcatttttgacaaagttttgaccctaagttgttatgttgtttcattggcatctgtcagctttgattcttgcctttgagttgagaatcaacccaatatacatgcatggaacggtacgatcgagtattattagtttattacaataccttctaaatttttattttttctttttatttgaaaaggtaaaaaaacacaagcgctcataccacgcacacactcacacatattttttcaactttgatatcgtttgcttcgtgaagcacggatacagcaacttaattactaaacaaacagtgccaggtgtgcagtttttttagacaaaccaaaggcgcatttgtccaaaagaggggagatcaattaaccttaagctctatggatgatcttgtcctgcttcctggacagaattctcttgccgattggaacaacctagctagcattttactatatactcatatcatcataattgactgtcactgttgatgtctaggatcggacgatcacatgccactctgcctactgatagtacctgctaaattggcgcacacacatggacacatactaataggtataattggccgaatgaccggccgcctattactcgtggattacctgggggagaagagcaatgacgcgagcttcacgaaaatatggggtatcttgcccatactccaagaagatcatagcttgcactccgaacatcaagagacactgacatgtgggccctacacagaaagaaaatgtccacgcgccaagtggacccacgccatgcgagccacctctactcttgaaataaccgccgctgctcgtgtcagtgcgactcttcaggtggaagccacaaaacgaacgcgaactcgagcggcgaagaagatgagagagagagataatgcggcggcagcgagatggcggtgacgatccagtccgtgaaggcgaggcagatcttcgacagccgcgggaaccccacggtggaggtatacgcgagacattcattcgatcccctggaattggaatttcaaattttgttgcgtcgattcggttctgtttttgtatctatccggttcttgattttgaagcgctgagaagttttctgtttgtgttcaaatctggggtttgcgctgtgcgcaggtggacgtgggactcagcgatggcagcttcgcgaggggcgccgtgccgagcggtgcttccaccggtaagcagatggctgaggcactggctcttccattctgaagaacaatgggtgtttttttttgtagtgataattcgttatatgttaataccatttgatcttcgatttccaagaaacgcgtatcttcgatatcatcgaatggttggtcccaataattcttgggcatggcagtaatgaattggtgtgtgcgtggaaagagatgtttgcatagttatttagatgggacaggggattgatgatttttgaaaacactcaaacagtaatagtaacacgatcatctctgtctgtcaaggctgtgtattgaaattcattagctcatcgcccaaagcacttgcaatgtggaccgtaactgaaacaagagaaacctcttcagtttttgtttttttaagaaagttgaaatatcttcagtttgttataaacttatagagatgacaatattagcacgttattcaagcgctgatggtttccttcttaaagatcttagttcatgtgtttttttacgctgatcttagatttgtcgtttaccttggcaaaggtgtacttaaaattcattagatttttctgtttcctgctttgactgtaggaatatatgaggccttggagttaagagatggaggatccgactatcttggcaaaggtgtactcaaggttagcttattggctttccctcgaatgttaggactattttacaatctataaataacttgttcgtttatattgcattttgattgagcagatcatatttcagctgaacagttaacaatccaaagtctctgtaatttatgtttaagtaaggcagcgtgtacgaagataaccgtcatatgtttgtctatctcttgtgtgggtcacaaaattggttcaaaggaactatttggacctgcatttttcaatttgcaagtgagaaatcattggtacttttgttggaaaaactgattgttaggtgttttctaccattttctaacaactgatggcacctatgtatgcctatcaagt

SEQ ID NO: 8021 - DNA, 4082 bp, Oryza sativa
cccgctttcaatgtgatcaatggaggatcccatgctggaaacaaacttgccatgcaggtaaaatattgcttgaataacaagaccatgtcgatgcatgattcagtcatattctctgctcatttagctgctgtacaggagttcatgatcctccctactggtgcatcctctttcaaggaggccatgaagatgggagttgaggtgtaccaccacttgaaggtgaaaaaaaaaaatcaaccttttcattttgtatctgaaacttcagaatgtgttatctgaacttctttatacagagtataatcaagaaaaagtatggccaagatgccacaaatgtgggggatgaaggtggctttgctcctaacattcaggtaatcctccataaatctctgcacggctttcaagtcaataaaacttcttagaatgtcccagtattttttaggcaaatctgacgggtttctcattatgaagtagtagaagtgtagaactgatcgtaaacataagcagttaacgtcacttaagatgttctgagaatatgagtaaagctaaactattcagatactatcaactaaacaacatctgtattagtaaaactaagtagctttatttaaaagttttgacaagagttttcaaatgttttaaataaggtggtggtattggttccgttcagaatactttattagagtagtagtacagcgagttggaccgtacgtacttgggccgtctacggctaatttcggccggatgtacacaaaccagcccaactaatatgagccaggaccgcaccctgttctgggcctagtggtatgggccgcataaacaccactgatcccattcaggtccaactaatatgggccgcaccatcacaccggaggaataagttcactttggctcccttaactattggccgaatctgatttatacccctaaaccacgataccggaatctcgttccagccgaagtagtatggactatggacaaaacattaatctgggccggatacgtggatctaacgatggatggtagtcggggcccactggtcagtctcatgtgtccaaaattgtgcgaccccttggatcttagtgaagcaatatttgcagttacttttcatttttgttgcatacatgaactgaaatattcatgtgcaggaaaacaaagagggcctcgaactgttgaaggccgcaatagctaaggctggctacacaggcaaagtaattcccttttttctcttaatttagctcataattcaagcatctctttgattgtatttgcgtgatcattatgattcatcaatatctattgatttcgtttatatggcaggtggtcataggaatggatgttgcagcttctgaattttacagtgaaaaggacaagacttacgatcttaacttcaaggaggatgtaagatcggcctgcaacttcttgtcaaatctttatctgcacatagttctttgtgttgttccatgaaactacaataagaaataaaactcagtgtgtattaacatgtcttaaatttcttgaccagaacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacagtaagttacagttagttaattaattaattgctactaatctcagttagttctctcgaagtttatgttttaacaatgcaatacttgccttttacagagggttgccaaggcaattagtgaaaagacttgcaatgctcttctcttgaaggtattgtatgctgttcagagttgctagttcttttgctaggacattgaatgtagtgcaatattgattataccatctgtttatgctgtcaggtgaatcaaataggctcagttactgagagcattgaggctgttagaatgtccaagcgtgctggatggggagtgatggcaagccataggaggtaagagttgcaagttgtaactctttcagctgttttcattgtttgtaggatttgtttcatttaactatttttgtcatcttttcagtggtgagacagaggataccttcattgctgacctctcagttggtctgtctacggtatgggttttggttaaacttgaatttgattgttctgagtaccttcaatggtaataacatcatatcccacaattttgtttcagggtcaaattaagacaggagctccctgtcggtcagagcgtctggctaaatacaaccaggtaagcctcttgcctcaaacccaaattagtcattactacctcctttgcagccaaatacactttgaatctctgcttgttttcatggagccttactcactagccactactagtaattcatccgacaagaccattaaaatactccttttgctgtgtgattttgtaatctatagtggaagtgattatgtgtgtgaattaaattacatttcatttagcatggcttgatagtttaagcaggaatctatgatagaacactgggcaaagaacggcgatttgcaaacttgtcactaggtagtattatgtttcagcgggagtctgtttgcttgtcctgtaagaagcatcattttttttttccagagaattattttagactttttttcccagaaaattcaatgaagaggttccacacaacactattgttttggtgatatatacaatttgtgtcgttgcttgcttgtggttgcagctgctcaggatagaagaagagctgggcgatgctgcagtttacgctggagaaaaattcagagcccctgtggagccgtactaaaccttggcaccttgcggtgatcttgtgcctatggaccatggtgccatcaatctactactgcgtttttacacgagtctacaagggcaataaaattagtacttcttccagtcccagaaattgcttagttaccctcgctttttcgttaatggccagattgtttgcttactactgtgttgacacacttgagcaccaatatgtaagatcaataaaagagcaaatcgcttgatttttcatcataaagtatttttttccccactcaacaagttgaattcgttgtgctgacttgtgctgtgaagctcagagttggaagtgaaatggaattcgtgttgccaagctgagagtgagattatttttggttttatagcaccgagagatcaccgtttagtaatgaaaaggctaatctgttgatgtagtggatagatagcttcagggttcaagttttcgacaaaaatcgatcaaaaactgtgaaattttgaggttttgacgtgggatggaagtagatcccgagtgaattttgaagcagatcctagttttcaagaatacaaatttgaagcagtaaatttgatcaaaatttggcaaaaaaagaagtcgtaccactaagggtcaggatccagcactcaatcggaaaggggatagcacgaagttcacacaaaatttcaggagcaagttcggataagagcattggacacatgctcagctctggggctgatagcacctggcatttcccttcgtgtttgcatttcagaccgacaacaaaagatgagaacatcaagtttagaggaaatgatcttgctaaacaaaaatcaaaccacacaaaatcaacataaaatcaaggccgttctgcagtgcaaggcaagacaacgcacgcacaacgacgaagttaatccctttgcccccacgagaactgatgcccagtagctcctaatttacatgttacatgcgacaataataggagcttcactataaatcggagaaaaaacagctccacaagccaacaatacttttggggcacaatgtttttcacttgtcttgcttctccagatgacctgcatttgacgaaaacaattttggtatcgattaataggactgcaacagggtgttcagcatgcaatgaggataatgttgtagtaatacctaactaatggttggaacttggaacgccaatatgagctaccataggtgtttttttttcattctactcatcctcctccaataatacagtcc

SEQ ID NO: 8022 - DNA, 7189 bp, Oryza sativa
aaaggcggcgttttttctcccggccaaaatgattaaatatttctgttacatctacaaaatgttgtcgtcgttggtacctgcagcatgcaaagaccataaaaatgttcccagtcaagtcgacaaactgtttttgatttcttttaagtagcagacaagtataaaatcatcaacagaaaacctagacctatagagtggtgacagttcagggaaccttagctcaagtttatcactcatgtttctttctgaaaaaaactgctaaacctagctctatagaatggtgacagttctgggaaccttaactcatgtttcagtcatgtttctttcttcaaaaggaaaaaactaagtgacaagggatgatctgactacagttctaatggaaatatacaatacactgacaaagttcaagcccttgaaatttgcacttttgtgatacagccatatctcgctatagtgctgatactctgacaccagcatgttcacatctgttccattaatagcgcatgctgtttacatccgatattgaacatgataacatatatgttgattggttggaattaaagatttgcattcctggataatcaaataatagttaacaacaaaagttgagcaatatgctgccttctaaaaccatatttacccattaccttctaagtgattctaacttctaagacctcaattcaaaaccaacctaaaatcaggcaagaatctttaaccatgatgtcacatactacaccaatatgcttacaggaaaattacaatatttagtttctcagtagctccctgacatggttaaatctgactgtatgctattagatccaccctagttctctcagtcccatgttgttgttttttatcacgaacacaccaataacagtcaaatttcgtgatttcatcactacatcatcaaccacaagcaacaccatagcatggaaaacatgcaacgaacatgggtccgggtgggtgggaaggaattaattcatctgggacaaacattaaacagcacgagactgaataatctcaccatactagtacatggggtcccaagcatcaatatacaggtcgtctaagaatttagcatagcatctgctttgtaaattccctcttcttctttgtttttttttttttgtaaataactttcttttatctaatctaatatatatagcacagtaggagcctctgcctctcctgctgtttttcgtcaaagaggaaaagggttggctaagaaaagatattcacaaagttaggaagggtatatagattgtgctttctataggactatgaaatatgatggttttgcagatgtttgtaggaactacttttcagttttcaggcattcttgtagatactgcatgcaggagccagcattatcccttcatttgttcaaatataagatataagaagttatacacctatattatcgatcataagaccacttaccctataaaacttagtacaacaagaggcacaaaaaagctacatagaaattcagagttatcaaataaagtaaaatcatggtccaaaacaagcatgcctgacacacatatcagaacttagtgcttcctgaatgcagataagaaaatacagtaagatattagaaggatgtctagtaagttacactaataaagatccagacgtgtgcagtattaaggtatatcaaaagtcagaaatcagggcaatgcaaaagtaggtcatataccatattatgtgtaaagtacaaaacttgttttctgaaggagaccaagaacttcactgaccattttaatctaaaattttctgaacaaacagcctaaacagctttataaaaggtatctcaaccttgaacacccatttccattttcaaattattgttttggttctcacataatagacatgaatgactgtaccatttctaactttcagttcatctgtttatactagtcatggcaaaataataacttaggacaaagaagacagcagtcccggacttttcatttggtccattttgcactataaaatgttttaaagactgaaaggcggatagaagacagcagcacttacagcgtatagttatagtacaccatcggggcagaaagtaagaacattgcccaatgccccgataggaggaataatacacttagagctgcttgcaatacgaattctggaataaccactttatttatccgggaggatgaatcgaatggattgatatagtcaaactccagatctgccaagcacatcagctgcaaaacaaaagaaaagggtagaactaaaacatcaggaaatgattctctaaaccaaattccacagccaaagggatgaataatgtaaccaaaattgtaagttactaaaccataatttactacacccaaacaagaacaaagggatatcgaccacggtgatcgcacattgaacagtatcgcgctagaacacgcaacatataaaagcaaaggaattcctcagcccttctcgactgaccaagaatacccaccaaaccccagcaatttggaatcatgagtcgctctaaccccccaaaatcattcgagaatttctcctcaatcgatccacaaatccgcagccctctccatccaaacgaaatcccgtacgggtcagacccggagacgggcggagataccgaggaggcggggggtagctagctatctccctccctccctcacctggtagatgacgagcacgatgagcgccacgacgaggaagaacgcggtgagccacacgaaaaccatctctccctggccctccacaggcggcggcggctcgctctgggggaggtggaggtggaggtggggggtgggcgttggcctcgccggaaccctaaccgaaataaccgtagcgccgcctactgcggcggccggcgaggcggtaaatcggagcggaatggaggggggaggggagaggcgagtggaccagtgcgatggacgcggcccacaagatgcagattctcttagaagcttgtcacaaaataaacggctctgattctcttagggtctcttttggcttgcagccacagtttaccacgtctaataagtactccatccatcttataatatactctctccgttttgttttatttgacaccgttgactttttagcacatgtttgaccgctcgtcttattcaaaaaatttaaataattattaattcttttcctatcatttgattcattgttaaatatacttttatgcatacgtatagttttacatattttacaaaagtttttgaataagacgaacggtcaaacgtgtgataaaaagtcaacgacgtcaaataaaacgaaacggagggagtagtaacctaataccaaataaaacgtatcataatactataaatctatatagggagcatgtccagattcatagtaatagattgctttattacgatacggagggagtatgcaaatttcttttcttttaacttcaaactacaacttacgcatttttcattattatcatacattttaaaatgttaaatggcggtacgtttctttaaatactttctatatacaagttattttcaaaagtcaaataaacctatttttaaagtttgtaataattaatacttaattatttatgtgctaatgatttaccctaattttacgtatggttgataagctaaatcaagtgaagatttgtcaacaactcagcaaagtgtaacaaaaattctcttaaatttgtcaagatgcggcaaagatttttagcacctaacattaagcaatgttagcaagtttttggtggaaaacggtgacaatactagtacctgaactaaatagaggcgagctgtaatacataatttttttgtgtaacatgaaccttagtatgatcgaatctgccaatcagtggcaaggtgggctgtttggttgactctgtcaaatggaattggataagctggaagcctggagtggtgttttttcttgccgttcactgaatgttcttgtttccaggaaactatattgagagtttcagacgttttacacgcattctgcattcatcgtttctcttatatgttaagactgtttgagcattcagcattcacagatcgcgtcccctccacgaaatgtaatataattaaagtgaatggcaccattaccctgtgaatgctgaaattaaattttaaccaaacatctaattttaacgtgaactaaacacaccattcacagctaaaattaaagtaaatggcaccattaccctattcctgttcgagtgtttgataagtatatactacacttgcatgatcatgagcagcttcagcttactagttatattgtagactgctctgacctctgagcctgacaaatcaggaacaactatattgttatattttaagagacggatcgagggagttacttcgaaaagaaaaggtcacaataattcagttcagtttcaggttttcagtctgttcagaaccctacgtacggcgcctacctgatcgaatcaatcaaagagagacgacaaagaaagccatgaaacaacacgtatcaccagctcccgtgttccacttccacgtgcgtgcggcagcgcaagaagcaaagcctactcctacgacacagcttctttcagatagaagcaagacgaggaagatatgtgttgggtccgtgcaaaagtttcgttgatagctagccaactgttgcctgccacggatgctatgaatcgtactagcggactatatacatccaagaataacaatgatctcgcactaaaccaaaaaatgacataatgcatcaaaaactagttacttgatgtagtacatgggatcgtccaaaacgcgtctgatatgtacgatggacgatctttttaaacagactattacagtattatgtttctttgctttcatataaagctggatcaatcactcaatcatcaatgcaatgatatatccgttcttaaaaaagcttagactaactcaacagggtctccacgtcgtactcgaccttgtcccacttcgccggcgccgccgatgaggagcccacgtggcagtaccacagcgcggagccctccggcggctcgatgatgaccaccgtgaacccgccgccgtcggtgggatcgccggagagcgtgcagctcgaaccgtccgccggcggcgtccgcccgaacgacggcaggacgacgaccatcttgcgccgcccggcgccgccgccgccgccgttgctgctgcacctgcacagggcggtggcgagggtctccgcgtcgtaggtgatcacccagccgtcctgcgatgtcgcccacatccgtttcgtctcgccgccgccgccgccgtggaggacgtcgccgtggccgaggacgatcatgtacatctcctcctcctcctccggccacgacgccatatggtttcgcggtggcgcgttacgtacgtacgtgaattcgcgtggatggattcgagtttggtttagagagtttgtggtggttggcacgatcgatcgatcgatctagcgtacgtacgcgacagattatatttgcgctggtacgtacgtacgggaatcggtgttggactgccggtgatcacgaggatttcagaccggaagagggttagccgtgtccgtatgtgatttgcactgatctctcaaccgtgcgagcgcgtacgggatggagtcggagaccgataccgaaaataacttgagaccgaaactgaaatgatggagaccaaaattttcggttagaaatttgctcgggctttaattcaaataagaccgttgctttgaaatgtcacttttaaaattggatacatgtattacgagcatatatcttaaagagtgaggcctttcaataattttggaatgtatttagcacgaggtgttgtttcagttttagtttcagcaacacgaggaagcacaaaaacgcagccagtgcgtacgtacgaggtgaacatatgtaacttactaagttggccatgtgggacttaggggagagcggttacatcttctctcaccccctctttctctctctcaatcccaaagagaggtggatagagtggtggtgtttagtgtcggttgttagggttaagttttagacgatctcggttgtagttccatgatggcctagcggcggctggtcatgcttagcggcaactgattcggtactagtcttctcccgggtatatgtattgatgctgtcggtacttgggtggttttttttttcctgattacggcctcccacagttataaatttattttttttcccattctattaatatgaacattgcacgtctggtgtgagtcgtaaaaaaaaaaggcgaacagtttcagtttcagcctcgatcgttctggggaatcaagagagagacagtgcatgttgcctagttctaccgcaacttaggtggtgtgtgaatccagggacttaactttagtctctgtatttagagactaatttagagattaatatagaatacttacaaaactaattacataattgaaagctaatttgtgagacaaattttttaagcctaattaatctataattagggaatgtttactgtagcatcacataggctaatcatggattaattaggctcaatagattcgtctcgcgaattagtccaagattatatatgtgttttattaatagtctacgtttaatatttataattagtgtttaaacatccgatgtgatagggacttaaaagttttagtcccatctaaacagggtattattatgtttttcctgcactccaacagctagcagtacaaacatgatcttcagaaaagaagagaaaaggaaaaaaaaaagtacaagttcagtctctccacggctctgaagatccatcaaagatgaacagtagaggcgacgtcgcgatgagctagccgacggcatgtcaagcacaacacgtatgatcacgagctcgtgatgcagcagctcgtgacgagcaggtgatcagttgcatgctctgctcgcttgaatcaattaaggtcgtgtttagttcacactgaaattttaaaatttagaagcttggttgaaattgatacgatgtgatagaaaagttgcgtgtgtataaaatgttcgatgtgatggaaaattggaagtttgacaaaaaaaaaatttggaactaaacaagtcctaagcagcagagcagaaagcagatgcttaacaaaaacgaaagcagattgaaaattaagcagcaggtgttctccgtgcgcaaggaagaagttacgagagcccagatccaccagcttctcctccggccttagacctgccaagaatcgaatc

SEQ ID NO: 8023 - DNA, 1207 bp, Oryza sativa
taccatgaggagtgcatgactacgagaagactcagtattcaacttcgtgtttgcagcaacacgatgagcctccccaatccttagaagatctacaaaactcttctgatctcgaacctcaactactgtagccccaggtaacgaaacatcccctgtcctcggatcttctacaatggctatattgtcatttacaggatcaaggaggtcttgtatcatttccatatacaactgcaataatacacgtaatatacatttactacaacgcaagaacatgaaagccatacgttgaaattggagaaagtatatacaatgccatgggaactcctagaatcacaaacctgtaggtaagatactgatactgtatcagtttcaggtgttatatctgccaaaatatcctccattgcacggaccatgattccccgtgcagcagtatcttcttcaccaagtcttccaagtgtaaacgttttcccagtaccagtctgcccatatgccataacggtaccattgtatccctccaaaacactctgcaaaatacaaaaaacactacattggtacagccattggtcagaagagaacaaacatgagtccactaatagcttgcgtggaagaaagtttgcagaaccactagctacaagaggactcaaggtttcttttacctcacagaattgggtcaaactttaataacattgcacaacctctagcaagattcattaaaagaaggatttctctgattatttcatcaaaaattaagaaaccttcaattgtaccaatattccatgctccagctgggttgtgttacacccagcatagtcgtatattccaatccaacattcaaaccatacttgtgttacaatttgccaaaagatttcattcacgaacaattgaaattatgaataacaaaaacaaggaaatgcgaaaaagggttcgactgtgtcacatacctctacaactgggtttgcaacaacctcgtacactctcttctgtgaagcaaactctgtaagcacttcatcaaattcatatgtttctgactcccagttgtttttacgaagctttaaccttttgagctttataaagaaatcatcaagtaagactgtgagcaaacacatgttctttttttgcattgcatgctaataaatcggagggaggggaggggagtgcaaacctttggctggggctcaacacaatcaccaaagtcagaatttgcagccaa

SEQ ID NO: 8024 - DNA, 484 bp, Oryza sativa
tttggccacctttccggccagagccaactcggcctgctgtttgttgccccagaggaggacaacatggagacgatcgtcgcgcaggatgcgcttgtaatcacgtggaactcgtcgccagacaccgcagatcttgcccgggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttggtaattaaatgtag

SEQ ID NO: 8025 - DNA, 434 bp, Oryza sativa
gacagctgataggtagctttgcaactcggattctattactctaagcagtgaataggcgctagctatgtttttcctttcaagctggcaagcaatcttcagaaactggtgtctggctagctgattagccaagtgactgatgaactgcagaatgaagacagtgcagaatcagaaggatgtgtaataaaacaatcatatgcctggcagtatgtatgaccttggcagaaaaatgtaaaacactgttccatcaaatgcaaaagtagctggcttaaggtgatctcagcatgtattggtgcaagctagcagcacatttttcactgatcacttaaatttgtcttctgagtgtatacgaaaaacaaatagggtcaacaaggtgtagaacaaccagattttctaatgaatactcccaggggccaactaaatctaaacattgaaag

SEQ ID NO: 8026 - DNA, 3416 bp, Oryza sativa
  unsure (1)..(3416): unsure at all n locations
nnnnnnnnnnnnnnnnnnnnnnnnnnnnnnnnnnnnnnnnnnnnnnnnnnnnnnnnnnnnnnnnnnnnncttcctttttatgaagaaaagtatccaagttcatcctgacaactagtagtagggtgtatcaaaatgataaaaataagagaagacgataccatataaaggatttaagttagtaaaggcaattttgcttctgttgaatattaccttggttccacgaatagggattcagatgtacaccctgtccatctgcattaacatgaaaaggtcccacttcttccgcaacgccatatgcaattgatgagcaacctggccctggaagattaaatgcagtaaaatcagtagtgtgctctcagaactcaaggatcgtagcactgcaaccaaatgaatttcatggagaaactaatgcataatatttcagttaaggttcttaattatcatttatcaataccacaagaaaaaaaaatcagattcaccgacaacatcttgcctcatgtaagaatagaaaagttgtcctggtcatcttgaaatatttaagagagaaaccattttatgccactgagtttactctagttcaacgatttgccatcgactccatctacaatatgccactgactttttcaattttttatacaatacaccattggagtgtatatttttcaaaaactgcctaaaatgcctttcaagacttacaagaggttacaattgattgacctacaaaattttaaaaaaatttgcgtaaactccttgcataatataaaactgtgtgtatatatcaaaattttcattttgcatgtattatctttaaaaatatataatttatgttttatatgctaatagaatactttgtgttaatgttctttttgtacatcatcattcacatgttatataattttttttatgcaactatctttcgtgtatgtgattcctctttcatatgctatataaaatagttttttagaaaaaaaacatgaaagaaaatcttaaaatatacacacaaactttaatattttgtaagaaggctaagtacacaaaaactttcatgtttttagaacttctagtgggtcaaataattgtcttctcttgtatgacctgaagggtattttaggcatttattgaaaagtatccaccccaatggcatgttgtaggaaaaaaatgataaagtcagtggcatattatagagggagacaaagtcaatggcaaatcgttgaaattaaggtaaactcagtggcatagaataaattctctcatattttaactataaaaaattataataagctggctttagaggatgtatatgaatgctgtgtagtggaaaattttgataggtattgctggaagcttggaggttagttcagtaaagcctagtacatgtgaaaacaaaagggaaaaatcacaaaattaaactataagagttctagataagtgctaattgtggtgcccaaatgtgaaatatgatatgaatcaataataagaaaaactataccaattttaagaacccgagtaccatacaaaaaatatttgccctttcgtatctccaaaataaaaataagtttttttagtaagaaatgaaaatgagtttgatccggaaattgtgtagagacaacagcccctcctcatcggaagaagatccactgacgttactgttcaccgtgactgacatgtggacccatcactctcgggcccacatgtcagccactatgtctgaggatctcaatcctcctccgtctgcggatacttcccccctcgaacgaattacagttacttgtgcatttctaccacatcagtaataactaaaaccctcgagatatcaaatcgactaatctccatgtactagtcttagcataatccccaccccccaaaaccccaaattgtgcatccgaatcctgcagaagaaagctgctcatcagataaggaatcaacggaaggtagcgactttcccccaaccacgaacgcaacagctattcgtcgtgcgtctcggactcggatgagaaaacagcagcagcagcagcagcagtacaagtcaacaagagaccaaatcggaaaggcggggcggtggcggcggcgggcgctcacctccgttgagccagagcacgaggggcttggacgccgggtcgtcggcggcctcgaagaaccagtagaagagcgaggcgccgcgctcctcgctgacggcgacgtacccggcgtactgcgcgaacccgacgtcgaagtcctgcccgggcacccgcgccacccggtcccgctcctgctccgcccgccacgccttcccctccgccgcagccgccgcccacggaggcggagcacaccctcccaccaccaccacaagcaggagcacgaggagggagccgatggcgctcgtcgtcgtcgtcgtcgtcatcgcggcgatctcggagaaagtggcttgcgtgctaccaatgggggtaccagtagtagtagtagtagcttgttataatgagctactattcccctcgaaattttatttgattactacttacaccgtttcaggttataagacttttatcaatgtctatattcatatagatgtcaataaatctatatatatatatatatatatatatatataaaagaatgtgggcaatgctagaaagttttataatataaaacggatatagtatttttttaattttaaattttaaaaataaatatttttaaactactcgctccatcccatgataagctcatttttagttcgtcccaaaataagtttgcttttaaagttatatcatatcaaagtctgtgaaagttggaaataattgtatcggaatttgatcaagtatggatgagtaggatgagtgaaaaataaacttattttatgacggagacaatataatagagtttggttttatgagatatattctaatactagatcaaagaaagtgtccctttcattctataaaaaatacaatcctaactacgaatctagattttaaaaataaaattttaagtagcatatttttaaaaattaatacagtacttaataggcaaaattgctacaggacacccgaaaatcgtgtaattggctgtgagacactgcaaaatattggctttgcccacggacattatgaatgttgtgaaattggctgtgagacaccggaggcaatattttataatttccgagataaaagaggtcagataattttctaaaagaccaatccacccctgcgcaactggtatgccacggcatgccggcatggcgtgtgcgcgccgcgtcgcgccgcgcacagacgcgaataggcccgttcctggcgcgttcctgacatcaagctagcaggagattccgcatacaaagaaaatctctcgctcgtcttttccggctgcgccattactgtttttggctgcttcttccacctcaatcctgcacggcgatgatgcaactccttttataatccact

SEQ ID NO: 8027 - DNA, 17942 bp, Oryza sativa
caggactcgtcgggtttgccacaaggatcgatttattgcgtcatcatcgcagctccagtggccgccgtagtccccgtcctcaacacggtcgctggcaccgccaccgtcgccagccccaccatcgcctagggttagggtttgagactgggaaatcgggttggggagggagatggacagctgggcgcaggggtagattgatcttttaaaaaattatttgacctctttgtctcggaaactataaaatattgcctccggtgtttcacagccaatttcacaaatttcgtagtgtccgttggcaaaaccaagattttacgatgtctcaccgccaattacacgattttcgggtgtcctataccaaattttgcctacttaataagttattcccctcgtggtctctcgtggagtactggagtggtgggctcacctcacctgcgatggcgaaatgattggtgggtgggtggtacggctgtgtgtgtgtttttggtcgctcgccggcggaagcaaaagaggaatttttttttcgcgggaagaaaaggaggaatcttggggcatcatcggcgatggggacgtgcgacttggcaattctttttttcatttttcaattctactcgctttgtaaaaaaaaaaacttaacttctaaaatttaaattttatccaaaaaaaatacaacctctatcatcctatctacccttagcatataaaataagggtgtgtttggttgggtggatgagtctggatgggagatggccgccggattttctgtggtgtttggttggagggcaaggtggatggggcggcccggaatagggaatattctctcgatatgctggatgagtgcatccggccgatttggctggatgaagccattcagttttggtctgggtgatgtgtcttattctgattaggtgtggttagtttgattttctgttaagcaagctccaaatgatttttttctcctaaaccgtctatctaatttatgatttgattacaccattatatttgttataattaaatattaaaaacaagatctcggatgattatattttgataaaaaaatatatatgacaaatgggtcccactaacttatggctttttccatccatgctatatccctgcaaccaaacaagaaattggattgccttatccatacaaatcaaacaaaaaattggattgccatatccaacaaaatatggatggccatatcccatccatgcatgtccgtgaaccaaacacaccctaagatgttttatcacttcaatacattttacttcatccgtttcatattataagattttataacattatccatattcatatatatagtaatgaatctagccatatatgtgtacataaattcattaacatctatatgaatatgggcaaagctagaaagtcttacaacctgaaacggagggagtacctatctatcactcttactactttttttaatgattgaggatatttttgtcattcttacttttcactaattttgccttgggatgctaagaatggatttatttttttaaggactgagtgagtaggatcgaaggtgggacacgtcaaacaaactgacagccatagataaaatgaattcagattttagcagatattcagatataatgtgaattcaggtttgagcagatattggcccggcttgaaacagttttttattattttttttacacgacagattgtttacttgatttaacgtaatatcaagtggtctaaacaaaccactggaagaaatgttcttgagaatcgtattttcacgaaaatgacacaaatatccgtcgcaaaaatctagaaaaagaaaagcgaagacaacagggatattatgtgaattcatatctttatggatctttttctttcatagaaaatactcacacagaccactaaatacacaaacgctcaacacatgtttaaatggacgaaattaatactacgtcgagaactaaagattctaagaggatgataaaaatataaaaaaaagtttctcatattctaaactctacttcattttttaatttattgaagcagtttaatactccctccgtctcataatataagggattttgagtttttgcttacactgtttaaccactcgtcttattcaaaaaattttagaattattatttattttttttacttactttattatccaaagtactttaagcataacttttcgttttttatatttgcataattttttttaataagacgagtggtcaaacactataagtaaaaactcaaaatctcttatattatgggacggagggagtactagagtaattactagctataagtttgtattataggcaatatatatttttaagtttgtattactagctataagtttgtattataggcaatatatattttgggatggattgagtatttgtcccggtaggtaattggggttaccgctaggtacatgagtagtggtggtggtactaatgctaccttctgtattagtatagatttgtaattactaagatttttttctgtattagtatagatttgcaattactaagaaatttctcagataggatttaaatcactaatatcactaaattttgttgagagtgtacccatagatttagtggtggaagaattgaaaaggacatttctttaaggaaaaaaatccgtgccaattgaatttctacctaaccagaaaaattactttagagcacccctttagaaactctaccctccaagatttttttttttggatgatatttacctatccatttcacattcaccacgttagcatcgaaccaagtacatcaattcaactttactcgataccaccaaaacaaaaaaaaattgataatatctacctattcatctcacgtgcaccacgctagcatcgaaccaaatacgtcaattccaatttactcccttggaggctcattcgatttaaataatatccaaataatcattattgtatgaattgaaaccttacaattttttctatatgcatcattcatagatccttccaaattcacaagaataatggtaggattcttagcatgaagtgagatctcttagaaaaattcatatggattagagtagtgtcattctgttttttttttctattcctataatttgaaaatcttatgaaccgaataagcccctaggcgtgtttgagatgacgaaaaataacaagatacgcaaaactagatgagtcattacttattagcgcacgattaattcagtattaactatttcaaactttaaaaatgatgaagatgattttttgagtagcttttctataaatttttgggtaacacgtgtataaaaaagacaaggctgggggttagggagagtgtatgactcaacaaactgacttatcgaagtcggtaagagagaagacgctcatatacaaaacattggtctgtaaatttaactcatttctagttttccatacatattataacattggtcaccctttgagcattcgctcgggggctatttctatctaatattctttcctgagtattgatttcaggaaaattctattcgacattgacgaaggctccatgtctctatggttctacaccaagatcgactaagacgagtatgacaaatgttgacaaggcttcgtcgcagattctacaccttctcgatcgctcaagaacggttggtggatctcgacaaggaatacaaaatgaagaaatggtgtacccgtcgagataaaatttcttgacttcaatccaaattctcgattacagcaagacgggagacttagtcgtatgctatgtactttcttggttgacgtcggagattgactcagacaaaccctttaggtgcccgcacgaggctgataaaggaattctaacgttatctctgaactcaccgagaacggtcacgtgagcacgataacagttactccaaggtctgcgcgcggttgagaatatgaattcgttcatttgcatcgaagtcgggggctactgtcagggttatggataccacatacctaatagtagttgactaaatctcgacaggacccaccacataccatgtcttatacggatacaaccttcggatataggagaagtttcgcataaggaaggatgactagagttctacatggaaacgacaaggactactcggaatgtatccatattagtttccctaattctacttggacaagaggacacctatgggtataaatacaaggccccctaggaggagaggggacacagacaacatagacgccacaaagccacaagccaatacaagccaacaaacgccaagacaagccatcggatatcgacatcagagatacgcctggatcgaccctatccggtacctacagaggctggtcgtagggatctagcgttgtctctgatctcgccggacacgaactcgaggaggaagactgccctgttgtcgactacgagtcaaaccttcagaccgccatgtcgacaacagttagataggctaccccaaatattgtattggtgtgattatggtgaataagagcaataccggctttggccaacaggatgtagggttattacctgacaattcaagggcccgaacctgtataaaaatcctcgtctccatctcttttacctcagtctcgcatataccctagtaccaacgatccccatactttgcaaataccggaatcgcgccatcaaacgtcgacaatagttactctctctcttttttctgccgaacgcagccacagagctgcaaccgcatagcatagttttgctactcttactagttattatgatggcaaccaggggtggatccagcgtgggtgctgtgggggactcgagtcccccctaccccgctggatcaccatcgatagaaggggagatgaaagagaaagaataaggagaaaataaagagtagagagaactgaagaaggaagaatgagatgagtcccccttaaatcttaaatcttgttctaatccaccctgatggcagctacatcaatatagccgcagcaacatacaacaatcttaatcgtaacacgcctaagtatcgaacaaaactgactcttaatgtgtcttccctcccacaaatcgaccctgatgcatgagcaacgttacaaatactaagtgggttcccacttattcaaaacgtttatattcgatactctactttggttgagtttgttacgaggagatgggaacaattctcctgcgcatggagaacggagcggtctattaacacgtgattaattaataattactccctctgtcccagaatataagcagttttagagttaaacacggttattaagaaagtagatagaaataagtggtgaaggtttgcgatttgatgagcaatggaggtaggtgagaaaagtgaatggtggaggattatgattggttgggaagataatgttggtgaaaaagttgttatattttgggataaataccgagggctaaaaattgttgtattttataacggagggagtagctttttttttagcggtattcctgcaggtccaccctcgaagcaaagctgcaacagagagtgaccgtactgagctaatcagaaggtggtgtttggatccaggaacttaactttagaccatgtatttagacactaatttaaagtattaaatattgactacttacaaaactaattacataaatgaaagctaatttgcgagacaaattttttaagcctaattaatccataattagagactgtttactgtagcatcacataggctaatcatggattaattaggctcaatagattcgtctcgagaattagtccaagactatggatgggttttattaatactccatgtttaatatttataattagtgtccaagaagaatgcgactttctttggtgccctgattatctgtccgtagtccggactggtaattcgttcttaaagattaagttaggttttatcggtacagtagacttggaagcaacctgtatctgtgttaacaagggattcgatctggtaagctctctgcatcgtagtgctgtttcgtatagaagaaaaaacagattatagcaagcgtaggagtacacggctctctcacgaaattccagcttctaacagtatgttgctgaaattcaatccaatcaacagcatggacgctccccgcaaaaaaaaaaaaaaaaaaaaaaaaaaaaaaaaaaaaaaaaaaaccagcatggacgctgggttgtagttgagatcacattcgtttcgcatgttttccacaatgtttttttttttaaaaacaaactagcaaaggcaaaagctttgtctttttttgtattgatagagcaaggacatatttccacatttgagcctgtaatatttgaactttggcaactccatattgctgcagtttggcgttcaaaaatctctattgtgagaagaggatgcacgagttaattagttttaaaattagtaacatactcatacgcattacaatacaatacaatagatccatataataattagaatggattgtacctgaacgcgttctataacttaggaatgaggatatattaagagtatgaatacatggtggcacgatgtggtactctgatttggcaaacaaaagcgccatcaaaggtgaaattatttatgtggttggccgaaaaaggacgctgcctcacggcggataatctaagtaagcgtggttagtcgcactaacatgtttgccaactttgctgggtgggtgatgaagattgtgagcacctatttgtgtcttgcatctacatgaccaggatgtggagaatgatcaagagctagattggggttggcttcctgctgccatctgagtcatgcttagacctaggagaatggtggttagcaatgtggcaaaattttcagaacagctacaaggacgccattgacagccttatactgcttgtttgttggatggtttggaaggaaagaaatacgcgtgtgtattttagaatcagcagcgctcggcaggtttcctgtttggttcaattaaagaggaagtggcgatttgaaaggaagttgtggtttttagaaatataggagagcaatcccttagtgtaatctgttttcttttgggaggttgctcttgtgacaacttctatttacttcgacagtttattgttgaagtcaaaactttatatatttgtttatattcctcagtcttaagtaaatcaggttggcctatcttgaccggcccggcaatatcaaaagtatgaattgaaattcagctcctcgcggataggaggaggattgatatgcgaccgattttctgggtggtgggaggagaggaaggcggatgaatatgcaagtagtactacttgaaaaaaaaagtaaataacaactcaaaaatattttttttctgctattttatattggagtagtcctccccccaccatcgtagtttcctcgtgtaagaaaacaactccctaaaaatactaaaccaaagaaaatattattttcatgcaaaaataaaaaatatatattaaaaaactgaaccaattataattccattgctacacaatgtcatggtatctctactatcttaaaaattcgtcctcttttcatcccctcctctcaagtctcaacgtgcgcagcacgtccgtatacctaaaagtaatcactgtccatccttatcacatggacttctcccatcaatatacggatttcctgtctatcactaatcctatatacttatatagttcattcccactaaatgtagttaatgaaatttctctcttctctcattaatccacatcaccctaattatttttagcctttggatgatagatatatgattcaaattgtctcttctttattctgtcataaaaccatgcaatctcaattatttttagtctcaaaattgtactatcaatttgttttagttttgataatcatattacatcttatttgtacatataataatataacttaattttccgcagcaacatggcgggaaattcatctagttatattaacctgacggacatgtaaactagtaaaaaaaaacggagcatagggccaaacgagtgatctactcgcattcgctttattgggcctccatacccttatacatgggccgcaaaatccaaccattgggccctcattcccgcccacgcagactactcgaccacaccactttttttcttttccaatttcacaccggatccccgaaattctctttggttcgaacgaacgcgacgcgaaaaagcacaccaccacttggcttcggtttgccggcgggcgggccggccccaaccaccaccccaaccaaccaaccaaccaagcgccgccgcggttgcggctgcggccgccgggagacgcgggcggcggaggttgccgggcgagaggcaggcgagcgagcgagctgctgctgggtttggaatcgggaggagatgagcggcgcggcgctgtgcgcggcgctgacggagctggggttcgacggggaggacccgctggacgcggacgcgctcgagtggccgttccagtacgaggaggcgcggcccctcctcgcctggatctgctcctgcctccgcccctccaacgtcctctccccctcccacctcgcgcagtgagttggggtctcgatttggcggttgttgttgttgttgttgctgctgctgctgatgcttaggatgaaccagctgtaatgtcgtgattctctgctagttggtgtccacagtggatgcttgcagcgcggaatgggggcatatggtggtgttggtggttgcgggattcggagagctgatggaggtggtttgctagggttctagatgtgggtttgtgcttctatgagaaacaatatggggggattagtgagaataggcttttacagtagctttttttttgaagattttgctgtagatcttgatcgggttgattagttgcacatttgaatctagtgtttggcatctcggtaagttcattggtagctgcatttttgcttgttggcatgtttgattctgaagacagaggattgttcactcggaaagtgtgcccatttgggataatgaaaaaaatggattgtacaaatgtgacatatggcaatgccacatcgaaattctactggcatctccttttcctggcacaatggggctttagaagtgacctatgccacatagagatcatttatgatagtttctacgcttttgattccttgccaacctcattgaacctgcagctaaggttttcgtaggattcctgattttttacaaattcattttgatttgtcatcttaaacacatagcagtactcaacatcctgcggaactattgggcaaactctatcaaatcatgtgcggcattgtgttgaaaaacttggtttttactgtatcactatcgtgcatgagatgcttctaaatttacattttcactcacacctgcatttgtattgtgtaatcttggatgaaccaggacaatttaccattgtttggttgccatatttaattagtaacatatttgcatagatgacttctaaagcttcccctgcttcttttgcttgagttattctcaaatgacaaaatagattttgcattgcaggtatgagcaacttgtggaagagggtaggctgctagaggtatattcaccaagacctttctggaacgtataatttctgttatctttaacagtataggatgttgcggagctgctcctgtcagattgtgcaagcatggttccaacttccaaatgttggatgcctctaggacaggagttccagtttgtgaacaactaagatattaaaaaaatttcctagattttctggcaaaatataagatattagccagttttcaatggttgtcatgggatgctgaacctcaaggaactattcccatccaagatctgggactctgcttacaaactataaactcaaaattgggtttttgttctttacattctataacataagctgtattgtccacttgtgtttttgaacacttatatctgtgatcctgctaaaccttaaaactcatgctatcattggcattgttttctcagggtgaggatttggactctgcttttgatagtatttcagccttttcaagcaagaaagataatcaagaggctgtatttggatcagaagaaacaatccttgatatccggtatgcttggaagttcaatcttataaaattatagtggaaattggcatcaccattgaacacttactacatttacattgattcttgggctcaaatcctagaacccaactgaaatgcgattatacctcagtttttataggggaaaaaactttgtcctttcagaatttatattccaaacggagcacactactgagaaccaatttctcaaaaaatcatactaggaccagattttgaatcgtgctggaaatgataatttaactagtataaaacattgaaatctcaaaacaaaaaacaataaatcaagtaaaatagctgtttggtgaaaaagaaactagccaggtaacgcagaccataccactcaagtccatgactaaaattccaaaatgtggagagctatgtcaagacactagtaatttgtagtctggtttaaactttaaaactcctgtgcggagcccggttcctgccaaatgctagctagttgaagttaccaattggacattggatgtgcttttcctgacatgtattttattatgctaatgctgcaaaaaagaaaaactagcatacagagctgaggtttttgaattacaaaagcagcttgggcggcaacaagcacagtttgatttgcttgcagggcaagcttctacttttatccaaggcagacgggcaagtgtaactgccaagtttgcagttaatggaccacttatatcattggatgaacaactttcttctagaaacttaagaggtatatttcattatgttgcatcttatatttttctttccaacaatctccataattttgatctcctattagtatctccttaaaaagattgaatgtggaagttctatctcaatcatatgctttgttaaccatgattcatttccgaacagtggcatatatttatttatgcaataagatatttaagatatctagagtttctttcatgaggaaattgttcaattaagatgattcattatcttctaactttcagatgaatgcagttctcggaagaatcactgctactacccaggaattggcccattatcattcaggagatggtatgctctttacctatagataatagttctgttgtttttttagcttattttgcagaaaatagtaagggagtattctactggtataattatacaaacatatacgtaaactacatatatggaggggtccaggactccaggattaatgctacctttacatgcatgcaacttaagaaagaataatgcgccactgatggcttacgaatcatcagacaacaagagcatagagaactacagtaatcagaatggaatcctcttattatgtactgtggctaagaaatttgaaatcttaaaaacaagtacccatcccaaacagctgttaacattccatgttttcttagagctctctttcatatttatctatttcttaatactaacacttatatgaacattgtgttttatccaataagattcctctataactcattcatcattcatatgtgcagatgaaagtatatacttagcatattcagacttccacccttatgttgttggagacttggcttgtacaaaggagctgaaccgctggttctcgaagcaatttgagaaggtaggttctctttggctgtcatgttattctcagcttacttatttatttaacacttattctgcttacttatttatttaacactttctgtcaggggccatttcgacttgttgctgaggaagggaagtccaaatgttcctgggttagtcttgacgacatcaccaatggcttgataagaggtaaataccagttatagtaaattgtatgcaatgaatagattgattatattatttaaagagcgtaactctgatcctagattagtatgatgtgctttgaatgaactaattatgaaaaactcattcctattatgcaggagattctgaaaaatcacatcatcaccagcgtgtggctgaattgcaacgacttcgttcaatgtaactatcccttgatttatcgcttatccaaagttccaaacctttctgtttgaacatatcatagtttttttttttaccatgaaacagaaggggaatcctttatgttgaacacatcatagttgctaatgtttcatgcaatcttgttatatggtgcctattgagatattcaagtgattttatttttcttcctattgcacttctttttgcatcagtctgctggaattttgtcattgtgctatcctcttatatgtctagaatttgctttatatctttgtggtgattctaatgaccttgaactgtaaacttgctctaatttgggaacagatttgctacaagtgaaagacagtggattgaggcacaagttgaaaatgctaaacaacaggccatactctcgattttaaaatcacaagtgtcatctgacgaggctcatatacatagggatattcattctcttaggtatacattcgttactgttcatcactattattttatcagaataactgaaacgaagaaaagatagatcaattacattctccgtatcttatttattttaggagaaaaggttctgagcttgctggagaactctcgactctttctcaaaaagtacaggcttttgtatctgaggtatgctctacccatgtagaggcactgccttttcttgcaaaatacttacattatattccctagttacaaaaattggcacttcatgagtctgtttagctggatgcatatgggtttgcctgtcaattgatgaaatgtatatggttttcgacagagttttcatcaacgtaatgccacatccatttaataccataagggttgaattgcatacttgcatctggtaggatttaatgattcattgcagattaaattcctatttcagaagaaaaagtgttccaagcactgtcataaaatagctttcagttgtgaaatctctaaaccacgggcagctagaaattataatctgttatgcagatattagctttgttctgctataagttctcaggaaaaagaaaaacactcatcacttataagatactttcagcacttagaggataatatgccaatagtaattcttactgcagtgcatcagacatacttcttttagcatatggttaaaattttcccgagataggcttgtttttcccagtattcactcgttctccccctccagactataccatgcctctgctcagaactcgctcaacttcaaggcacatatattttgcaaggtttgttgatgatatttacattactttcgctggcttacatgattctgttgtatcatttccttgatattctagcattcaaatatgtaggggactacgatttaaaggtcatgcgccaggaatactacattaacaggcaaaaaacggtatgcacattcatcacatggtatatatgtcatgtacacttatttattgtcagcagttcctttgtttgcttattggtggtatcttctataatgttatgaaagtttataatcgagataactattcagatagtgttattacctatttttccttctgccttcaaatctatgggtggtaagacacttgcaccaaatagcctagggggccaaatattcttgtgacaaactttcaatgtttagatttagttggcccctgggagtattcattagaaaatctggttggtctacaccttgttgaccctatttgtttttcgtatacactcagaagacaaatttaagtgatcagtgaaaaatgtgctgctagcttgcaccaatacatgctgagatcaccttaagccagctacttttgcatttgatggaacagtgttttacatttttctgccaaggtcatacatactgccaggcatatgattgttttattacacatccttctgattctgcactgtcttcattctgcagttcatcagtcacttggctaatcagctagccagacaccagtttctgaagattgcttgccagcttgaaaggaaaaacatagctagcgcctattcactgcttagagtaatagaatccgagttgcaaagctacctatcagctgtcaatacccgtttggtaagcaatctcatttgttgagaacctcctatgttgtcatttcttcttttttatgtgtctacatgtttcatgctacactcggtagtttttgttcaatctgcccttcttagttttccaagaaatgattcttagttgacctaacaaagaaatgttttttttaattctttagggccattgtacttcattaattcaagctgcgaccgaggtgcgtgagcaaggtgcaattgatgaccgtgacactctcctccatgccgtacgggatctcttatgtgttcactcaagtaagctgacaagtgacaactctactcagatagctgtttgaacgttttaatttcgatattcaatgtttcatgtcacttctgtagatgtccaagcaacaatgccaacatacatgtcagcgcatgccttggttcagcagatatcagcccttcaatctgatttgctttctcttcagtctgaacttgaaagtgctctgccagccgatcgcaaaagatgtatcaatgaactgtaagtgatactatagctcacactatgtctaaatatcagttgcctttactttatctcctgcctgaaatacgcaaaatcaaatttttgaattgttgcttttagtgtttcttctgatctaagcaaacctacccacattcttggtttagtgaatagaacagtagtgtcccatgttgttaaggcggtaaggcatcctaactcctggcagtccataggcagtatggtaaggtgggccagacgccattactcctggcagcgccttacagccatagcgacgctatggtgatgccttgataaccatgagtgcgtcaactgtgactgactctgaggtcctcatgtataatcaagttgaatattgagacaaccatgagtgcgtcaactgtcactgactctgaggtcctcatgtataatcaagttgaatattgagacagatgatacttttcaagtttgcaacggatctttggttggtacggtttgcttgttggcttaactttgcgtcttcacctatacatgatgaactgttgtctcagccccctcatctactgctcaaatataaatttccttttagctggtggtggtgaatcttccacggtgccaccaatcctctacattacattttctaaaaactagcccctacagtttttagcattacggattatagtccatttatatactgatttggcctccttaaattcaaatttagcagtcatttttcatcctttccactcttgcagatgcaccctaattcaaacagtggaacaacttctatttgcatcatcgacgactgcagaaccaatattgacaccttgggtacattctttcatccttaaaattatcccatttcttatatctcccgtgttattttcagcactccttccttttccttttgaaagttatgaattgtttttacctgtgcttgtgaactaaatctatgcttggcacagcctctgatgcgagcactcgatgatatggaaaatgccaacgcacaagttgaagtttctgtggaagaagtaacgaaggctcgcacccaaaagataaaggtattatcatgtgcttcttttccctagtccctaccaaataacatggcaaagcttgtgcgttacatattcatcgataagcatcatggtctcaattgcacattagatctttgagaatcgcgctcatgaagttgggagggagaggcaagtgttcgtcgatttcttcagcaaccccgagcgactcaagaatcaagtcagagagcttacctcccgtgtgaaagctctccaggaataaatagatagatagatatccctcgtctagtttggtaagcacatgagattcaatctctacccctgttgctcatatacaagccataaaatctcaccctctgtttctagcatttgtgtgccaggtcgtcccgcgaaatgggaagcaacagccaagctcgcaatgatgctgttgcttgcaaagtttcccttcctccaatgcgaagtttgggggaaccatcggttagtttgttggatgttgaggtgcacagctgctgttgttatattttggggatgcagtcgtgattgttgtaaagtaaccacgagcccgtttcgtcgtctgattgatattcaggctagatggtggttgtacatttgtgtactggtgttgggagactcgaaaactagcattgcttagtgtgtatattagattgatcttcaattatttgaacactgctaatgagccctatattagattgatcttcaattaaacactaacatttgatgccaatgtgcgctgtgagggttccttcatatttagactgaaaaataataaataattgggacttgttcttgctcgccggtggcgctggaagtttcatgctccgggattagagatcaggtgaccaaatcaaagtcaatatacctcagcattgaagaaagttgtaaacaatttgacttgaattctaattttgcacaagggcaagcccgagttaaaaagaaccaatgaacactttatccacgacccatagcaatcctgaaagataccgacacgatccgaagcaacctaatcgattacacatttacagggtggatactgaagactaagaacagctctctcatctcatccacagaagacaagagagggggggtcgggctggcttattgctcaggtacaaatctctttttacagaagcttccctcatttagggaatgaggaattgaggatcgaagtcctgggatatccagactcaattctcagaatcctcgggtatcttgaaaaggaactggggcaacgaggcgatgcggggaagattcatcagcagatctccgaaggagtccttccttgacatggctggtggctgagcgggacctgtagttttcactgtggatgcagccgagctaaattcttcatcggaaccttcggtgccatcgcctccaatgctatcactgtcgtttggttcaggctttggctgggccaccggtggcgtatctttctgaatcaaacagcagagggagtccaccctcgccatcagcgatctctcgtcggatgtcgatgccggtgggccctgtgcatctccgagaaggtactgagcgatctcctccagtgtttcttttgttggcacctcgttgctgggcaatgtaggattgactgatgtgatctgctccgagatgcagtttcccaagtggtttaccaaatcatccactgacatagacggtctaagcccaggcactttcagttgactccaccagctggggatatttaactctggagcaccatttacgtttctgctgactccctgaacgttcactgcactaggtcctggtaaataactatagaattagaaaattcaatcttgaacacaagagaattttgtgtagaaggcattgtaacttataatcatattataactagaagtactaggtcagcacatcagtctaactacatgtgtaatttaattgaacagatatgacgcatctcagatgaccaaaaaaattgtggtggagaatctattgaagtaactaaatgtagtaattctgagaaaaattgcgatgcatctaccagcaatatatctagtcaaagacaggaagtgcaagaagagggacagtggaaatggcatcatgggcaatttacctgggtttcctggctgagcaagaaatcctgcttgcgttgcaatggaatcattgacttcaatcttagcagacatggatgaaccagcacagggtgacaaagaacctgaaaacccagataattcatgttcgtccttcaaattagtaaaaccttggcacttcgattcaactgggtcctcaaatatagagcatctgggttcaaaaacgggagagtccaatatgatgtctggttgctgactcaattggtttagccgctgatcacactggagaagcttttcaaagtttttg

SEQ ID NO: 8028 - DNA, 1393 bp, Oryza sativa
cttaaagtttatgttgactttctttttcggagctgtgagctttaaatatttcttatgacctttttacctccagaaagaaatcagagttccctcagtaaatctactaatagaaaaggcaccataaaagtaatcttaaattaaaaaccagattaaggatgcagtaaccatagactaatgtactacaagacactgataagtggtaagcatagttcgtgttctgtattaccctacttatagagacaaaaataacaatacttgctgtcctgttactgtaatgttgggttctaagatgcaattttctatataggagttattttaaagaatcaataaatccatttttcaaatttataatagttaatacttaattaatcatgcgctactgatacgccccattctctgagacaacaatagctacaggcaaacatccctgccaaactcaccctaagatcccattacaccctagcacctacccaaaagaaatgcattcaaattttgctctagcatacatttaatgctttccttacctgttcatacttgcttggccacctgtgaaatcagatgtagcttgccacagtgtgtgtttccttggttgaggatccgtctctttgaagaagagaggaggtcgggccaacttcattaataatagaaacctctcagaaaaaaagcaagataggaaagtaacatgaaccaataatctttaaaataacttaccaccacatccaaggttccctgtccattttcagggcaagatgccttcaatgcagtaatatccgaccactgaatttctatcttactcttcaaaccaccttccagaacttcccatacaagcttatgttttgcgaagtaacattttgccaccaaatcaccttcataccgtgatatatactgctcagagatagaatacagttaagattatggccaacaattgttcaggagaactgctctaaatgtgactaaacactaggtcgtagattcaacaacatgcaggaataaggcttttgggcaaatgactacctactgtagcaaataattggccattaggacaggatataggatgttttaatgttgcattaacatctcacagtggtgtacaatataaactatagtaagtactatgcttacataagatcggaagtattacatgcaaacagcatcaccacaatgagactcagaaactaagaatgtacctcaacaaaagaatgtttctgtgtagatagtaaataattttgattgaaagaaataaaaaagcaacagaaaaggaggacgccaaaattaaataaatgtcaaggttgtggcagaactactaaaagctatatctagattcttacctccatgtgccaattctcaaaatatttgcaggaaagtttgaagctttcaagcgctccccagctgt

SEQ ID NO: 8029 - DNA, 5393 bp, Oryza sativa
cactttgcatgtcggcctggtaatacaccaacgcaatttgcatatcagcttgataatatgccaatgctctacttgaatagaacacagtcagttccacaaataaacattgatatccaagtcacatatcaacacctaatcagcaaatcctgatacggatctttttccatggaatatagaatcataaatcattgaataggttaaaagggcagacatttataagctatttcaactattaggattgctctagctcccaagcgttagaaaatgcatgcatgggatagtcatatggcatatttcacctattccatggttcataaagaataccagctagagattttatttaagattgggaaaaaatgaactaacaacgcattttactgcccaagtaggaagcactcaaaatggtgtgctatgcatcggttattgattatatcacacacatcttactggattctgacgaaaaatttttattcaagctccaaataggtacactacttgcaaagggaagttagcattgatgattggtcctagaaaattttttataacacgcaaagtacggaacttagcagtttgacatactataaacaggcattaccctattacattgaacaaatgcacatgacttgtgacatgaatacacaaagttaaatatataaataagtgtgccgctgcagcaaatcatcggacgtcaatgaagccccatcagcctcaaaatggcacaataataccaggctcctgcacagcatattatcatagagatacatccaaaacatatccataaacttgaaccccaacaagcagactgtgaccctacctgattcaactaagaacagaacaaccatttctcagtacatttacaacacaaaccgtgcatgcgatctctctaacaacatcagctagcgattccatatccgaacaatcaaatcactccaaaaaaaaaactgtactattctattccatccacctatacccctctattccatccatctcgagtccacatatatacagtattttcggatcaaacgcgtcaaaaacacgccagggaagaaaggattcccctccctcaaacaatccagcaccaaaacgcgccgtctcgccgccaagcattacgaatccgacgcgctaccacctcatcccccgatcaaaacccaccaaacggaatacgagaacacgaaacccccccccccccccccggatctacctgctgctgcgggggcggaggcggaggcggcggcgcgggcatctggacccccgccttggcgcgcttgctgagcgggccgccgtcctcttcgccgccatgcagcatctcgtccgcctccagcttcaccgtagcccccgccgccgacgccgccgccatggccggctcggccggccgcttcccggagctcggcagctgcaccatgggagggatcacccccggaaaccctaaccctaaccctaaccctaactccccccaaaccgacgccgccgccgccgccgccggccgaatcgaagtcgaaatcgaagcagaaggcgaacgcgaggcgaagcgaagcgaaatcgaatcgaagtgattcgagaggaagggaagcgaggaggaggaggaggaggtgatggcctttggggagagaaaagggtccaaaaataggcgcccacgcggggtgcgcagagaggcggcgcaccagtggatgacaggtggggcccacgcggagtgggcccggcgtgtcggcggcgggtggtgcggatctcggtgtggataaagtggcggggccggggggcgtggaggtggaggtgatggtggtggtggacgggtgtcagtggctagaatggatgacaggtgggggccactgcgttgatggtgtgtgagggctttggctttcacgtgcaaaacgttttcccacccaacctactctcgtatacggcactactactctactggtcctctacatcctatacatcctagagtatttactaccaccgtactacactactactagcatgacaaagtcgtcgtgggttcattttatattatagatatgtaacaagtatttaaggtatataatggatttaataaaataataaaaatatatatgtaacggatatttcatacatctaaaggattagaatctagctgtcgtctcgggttgcctcccgcggggtaactacagaggcgcctaaccctagttgtcatcaccattcccaaaatcttctcatcgttgtcactggcgccgcctccgacggggctatggcgatgggccgctctctctccatccaaggtaagattaggcatatcatagttctcatcaccaaaggcgatagaatggataaattgaattaggaaatggtttgttttgtcgccgttgtcgtcatggcctttctccgatgatgttccgtcgcctttcattgccagatgatttgatgaagggcgtaatgagattgaatcaactattagtgggttgtgaggtgtcaccgccgctatcaccgaggtcaacaactctttagatggggtggcgttttgttcatattttgaccgctaagggcccctttgattcacatgataggaaaaatataggaataggaaaacacaggaatcgaagtagtaggtttctcaaatcctacaggaatcaacaaacacatgaaagacaataggagtccttttatagtgctgtgagaaaaacaaaggaaagttcacaaagaggtcatacctcttgctatttttcgtatgaaatgcgaagcataggaatacaatcatatggaaagtttactttctttcctatgaatcaaaaggacatgtaggaaataaatccatagaaatttgaatcctataaaagtcctttgccaatcatatgaatcaaaggggccctaaaggggcttggtgcctcatagtcatgtcaatctgaacaataatcaagaggagatccgatcgactggtgaaggggcgtggtggcgctttcttgtcaagctggcatgatgggttctatgtagatatcgcatatgattggttgggatacctattgggtgtatgcctcactacacttggtaggggctatgggtaggatacttggggaaccaccattgtcattgttcctatttgggacagcaaattgatgataggtggagtcagaagattcctaaataggcttatttcattcatcaatgaggtggatagatgaggtcagtgctttgcaaatggtgttcaccctttgattttgcttggttttagcctttggtgatcggatgacagggactacatagatggtgaccgccatttggatcatgatgatcggggcatgaccgctgaattgagctcgccacaatcaaatggcaacatgaggtacaattggcggaggctttagggtgaaaaccccgatgtggtcatttggatttgacaacgtagtgtttgttttgtcattcctttgttgaaggtgtcgtttcagattttggatgaaaatctagaccagacttaatatgacaatggtacacattcgtcggatccttcttgaaggcgttcttttggattagttgtaaacttttcatactcattttggtttgtactagagtgagcttccacagaactgcatgatttgttctcgatgtccttttttttctatttctaggccatgtgcatcttggtagatgcaaaggtcgagtgtaattttgtttattaatgaaatcttcccattatataaaaaaggatttgaatctatacatatgatgggtattttaggtaatcaaaaggatttgacaatacaattggataaatccgaaatacagcttgtagatgtcatcattgtcgttggtcatcctcgctcgtatattgggcaacctctctttaatttatatctagtggtttataaagtgttataccaatgtgaagggggaacaaaagggtgaatcttcaaatatgcaaagtcttacacgggcaattcacaaaatgtattgaggagacgctgcgtggggtaaggctaaatttatggcgcatgttctagatccaacggtctacaatcttgttttgaaaattttcacataggtatagatttgcattacatatttcccccctaatacgcaatggacatttcaggcgttgaaatgatttggcagtacaatgagaaataaatatattatataatggtcatttcaggcattcaattgatttgggaatacaacgagaaaaatctatattatataatggttatttgaggcattcaatggatttggcaatacaataagaaaaatatatgaacttgcttgttatgttacatgatctaaacaaaattttaggttgttattaggtctaaaatctgtttaacgagatatagttttgatttttttaaaaaaaaaacagaatggctccaatggatatatggggaagagtgtctgacaaaaaaacctttttagtccatgacaactcatagttaagagtgcatctaaaaaaactatagttaagaatgattgcatatatctgaaaaaggtttaaatttgacttcgagttttaagtggttttaccgccccattgtttcgcttatttctcgaataagcgaaacgacatatttgcaaacgaaaaataatttgtgaataaattttttatatatgtgtttttagcgatgtaaaagcaaaagctaaaaaataaacttcgatgaaataaccccaaaatcaactccaaatttaaggttgaaaattaaaattttggctaataagcataagcataagcaaaaagataaggccgtgattccaatcaaaatcaatatatctacctagcctgaaattcctgcttctaagaaagaaatcatataattgttttagcatccaccaaactgcttgcacaccgttcacctgttcatgaaaacctctggttcactggactatactaatttctcttcttccatcctgcaagcatgcagcagtagagcaggaagtgcaggactacctagttggagaagggaaaatgcttaccttaatgaggaagataaattcacagttggtaagaccataagtcgaaaattgctggagcagttcaaacatcccaagatcgaaatttcgggcattcgatttttgtcaaaggaaaatgttctgagtacaactgttgagtatctaatgtgctgccgtaaaatgaatgaatatggcacaaacaacaaaaaaacgtaaaactaatggtgtgattttctccttttctatatatcattttcaatcttgtcctgaaatgaatccatgcatataacctatcaactcctgttggcaagcagtgaagcctcgtcatcgtcgttttcgacaacgtcctgatttttgcattcttggtgcaaactaccggtgctcgatttcccatccactgtaagagaggttaactcaacattgtccatttgatattgggcagcatcatcctcaggtagcaagtcacctggaaggagattagagtt

SEQ ID NO: 8030 - DNA, 7272 bp, Oryza sativa
ccccaataagagaaccaactgacccaactgcgaagataaacccaattaatccctggcagtaaaaaaaaagtgatttggtcatgctgcaccaacgagggaaactaactagagatagtaaagctaacattatcatcaaagcaacatctttcctgataagttttcgtacaaaagaattactataggcaagctttattcccatgtaggccacgaaaaccacagagcatagcataagatttgtaaattataatatacctctggaaaagatagccctgcatttctatctgggtaccaatagaacattccttcttgaatgtcacgctcaaagcaagagacatgtacatgtaaacacatgggcgccatacttcaagacattttaagggtgccatcattggtctacttgcttctacaaacttcatatgggcctaattttttaacagtagacaggaaaatggcaatccaggaaaacaaaatagtacttatatctgacatgaaaaagcaaaattgtttaccagctcatatggaaagttgggcatatggacgtcctttatcatcattccagctaggattaccagggcagaaggtattgccaacatgccaagggcacccttgagaaacacaagattaatctatgatgagacaccgtcacaagaaaaactgaaaaagcagcagtggataaaagagagaagcaccaccaccaccacttcacttatatttatgcagaaacaggatctttcagtggagaataatttaaatttaaattgattgccaggactatagtaaagtggtataaccattgtgattctcatttagaagtacaaagtactaacaaacaagtaaaaccaacgatactcacttgagagcctattgcatggacaaggaaaccacttattgagaatccaataagccctcccacagatgcacagaatccgtttaagcttatcatgtcagcagcaagatgagggtgcactatactgttttcagcaacacaggcatctatagttacatcggctattgccacactagcacttccggccatcaatgccaacaacgcgaacaatacatgaagcttgctgtggagagataatacaagcatcgcgactactcccatgaagcctgcaattcctcagcaaacaggagggcatatcaataaaaatcatccataacctggtactgaataacagtcgcacttaatcaaaggaacattatgttgaggaaataacagtagaaaaaaacatatcatcagacttgtcagtactaaataagtcaccgggaacatgaaactatgccacgttcctcgtcccgggaacgccgttcccgttctgggaacacgggaataacctcgtttccccccatgttaaaacataaaaaatgtagcgtcccatgttccttgacccatcgatccgggaacttttatgacataggtactaatgctaccgtgctacggcaacagctgatatatttgagttagacagcaaggctgtttatagtaatgcacctacataactgcattgatccatccaaattaggtaatggacaaaatttgctccttcaacccttttatgtagttcaatgatccaaaatattaataactcaatggaaaactgttctatgaacttcggcctaaataattaacactcctcagctaaagcctagtaatgaaaagagatagtgtcccaaggagcatatcgaaactcgatacgcttccttgctacaatttcagcatctaatcatcagacatcactactctcaggtcctaaaatttcagtttgcgattcatgattaaccagtaactcgtttttttttaacaaaagatgattaaccagaagttttccattgcaatcatcatcagcagcagcaaaatgggaagcgtgaagtactgttaccacctgcgatgacgaagtaagggcggcggcggtagccggcgatggggaggacgtcggtgaggaggccccagagcggcttgaccatccacgggatggaggtcaccccctggtacacctgcgccgccgacggctgcacccgctgcacgtccttccagtagtagtccgacgccacccgcatgacgccgccgccgagcccctggctggcgccgtacgtcgccaccacgcccgccacgaagctccagtgcagctccctccccagcatcctgaaccaccccaccggcgaccacgcgccgccgccctccgccgcatcgacggcgaggaggacattggcctcctttgcctgctgctgctcctcccccccttcccctcctcctcggcgcggaggtcgtcggcggcggcggtggccggcgacatcttcttgcgcaaagatctctcgcctggttttacccgaattgctccggcttgaatctggagctcggattccagcaccagatttgggtttcttgaatccaaagctcggagctgcgaggtaggtgcatcagtaatcgaatcgatccccaaaaagtcttaaagaatcaagagaaaatgtcggggtcttggcaagaacatcaaatccaactgctgcttcaacctctcagctcctttcacatgcttactactccacacagatagaaaacaatcgccaaaacagacagaaaaaaaaaactatatgctaaatttgccgcagaatgctgcctaattgcatccaaaaacaccactcgagtatataaacagcagagatttggtgcctgaaaacaagaaagaaaacgggggaaagaagtggagccgaggagttattaaatttgcacgctagaagtgaggaagtccaaagaaattgagagatcccttctggttggtgtgcaggtgtagtagaggtatagatggccatatggcccgaggcccacggcccggcacaaagcccgcaattttggcccggcccaagcacggcccggcccgattagggtcgtgcccgtgccggcctggcccgacagccgggccgtgcctggggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctataagtagaggagaggatagccgtttgtcttattaaaattttaaaattttaagagaaaattcgatctttagtataggaaataaagcggtaccaacaaataacacaaaaaaaaagtttccactttcgatccatagcataggccaccgattttttttcgtcctgtagcacttccgtcgcattttgaagtaatagcgttagatcgggagtagagaaaatttttgtcggactcatttgcccttccttccccacattccccaccaggtctcctcttccgctccctcctggatggcggcgcggcaaccatcggcgtgctgggagaacgcctcgtctccccgccaccgccgagcgagctgcggcgctcgtccggcgcatttcttccccgccggcgactacttctcctcctccaccggcggtggcggctgaacagatgatgatgatggcgccggcggagtccgtggcgcacttcgactctgcgctcagctcgctcgtgtcgtctccgcagggcggcggtgatgagatggcggccatcggcgacctgatcggccggctcgggagcatctgcaaccacggcagcgccagcgccaacaactcgtgctacagcacgccgcgaacgcgagcccgaagctgtccaaggtcgccggagccggagacgacagcgactcggcggcggcggcggaggataagctggagccagccacaaagactacatccatgtgaggatgaggaggggacaagccgccgatagccatagcctcgccgagagggtaattaattaattacctaattaatcaactaattaattagatcctaattagctttttgctggtgcactaatccgcgcggctcagcttcgccaagtaggagcagcatctccgtgaagccgtcgccatcgtcgtcgaagatggccatgctctcgctgtagcagcagcgagcacgctgctcgacagcccgaaccccgtccacgaagtcggagagcgggacggtgggtgctcgctggagaaacggcggaggaagcgccacttgtgctgctccatggcgtggagctcgtcccggccgcggtggtagggcccaatggacaccagccggggctcgtacagctgctgctgttgtcacgacgggagccggcgggaacacggaatggtgtgcggctggtgacggagacggcggcgacgcgactggggacggggatcgtcgccgcgtcgctgtttggcgacggcgccatcgtcgtgggcaccgaccggagagaacgagatgacacaggaagacgaagggcaaatgggtccaaaattttttttctatacttcaatgtaacgctgttagctccaaacctgatggaagtgctatggagcgaagaaaaaccggtggcctgtgtttctaatcgaaagcgaaaaatttttatgctattttttggtaccgctttttttcctatgctgttgatcgaattttctcaaattttaactgtaattctgcgcgctcgctaactgaaacctacccctatgcaatctcacagcttctgacaggtgggacatgctggttgggaccacagagcagtgagggtaatgcgtgcctgtacgacgagtgactagcttaaaaaaattatacgagttgcttcgaaaaatcatattaatcatttttcagaaaaaaaaaatattagctaatacttaattaatcacatgataataagccacctcattttacgtgataatacgtgttttacgacctctaacataccgaacacagcattagacgggtacagttaccgaaaattggcccttttacaaaatttactgtaagagtgaaccatgtcgaaaactaattgtaaaagtgagtctgacctcagcgcatgtagatgtaacatcttaacactagggttggcactgtgctactccctccgtcctaggaaacccaacctagtatgtaataggtgagttttttttttttttgacagatgaagtattctccaacgtgactcgaattttccaaattagcatagttcagcaccatgagagctccggatcgaatgaacctgttcatggtactaccatgtatggtgaagtggctctagcctagtggtagagcacctttcactctcatgtcttggtggctgtggttgtggttgtgggttttttctttaaaatatcacatgttttgttccaattttattttataaatatcacaataaaaaatgagaacttaaattataatattaatattaatacaatatttagctcaataactataaatttgtattttttgtacatcttaataaataaaagttacatctttctgtttaaatttaaaaataaacttaagaacccatttgaatcgcaggattgaaaaaggtgatgaatagaaaaaatacaggattctaatagaaatgtaagtgtataataaaagattgcaaaacacggaaaaaatacatgaatgatcgtttaattgtaccacaggaaaaacgtatgaatcggatgagatagattcaaaggaaatttttcaagaggttgggctcttgctaaatttcctccaaaatctacacacaacgagtcatttcataggattttaataggatttagaaagtttcaattctttaaatcaaagggccaaatagaaaaattttctataggatttaagtcctacgagattcctatataaattctttgattcgaagggactctaaaacatagtatgaactatcagtagaaactagttttcacttttcagaacttgatggtaagcctcccgtgaaaagaaatggaaaagatgaagtgcatgggggttcaaatctatgatgcaaggataggagccacagacccgaactaaatttgaaaatatattgtctatttattttttctcagaaatattcgggattcaattttttttgcacaaatataccgtcggtatcgctcaacggatatgcgaaaatgacgtgggcgtgacaacgctgacaatgtcgcacgacgacggcgcaaaaccactcgttctcgcgcagcgctggcgtgagaccgagcggtctcgcacaacaaaacagattatcatttcaaaatggcttaattagtgattaattagcctgattagcgaattaataaattattaatcaatcactatctattattaattaatcaataatcatgacaattaatcactaatcaatcaattctcaaaacggtttcgctgtttggccgtgcgagacctctagcattgtcacgtccacgtcattctcgcgcagtggttaagtgatatcgatagtatatttgtgctaaataatttgaatcccgaatatttctgagaaaaaacaaatgaacaatatatttcaaatttaattcccactaaccctacaactgagctaagaacgttcaaacaaatatggcttccagcatatttggaggcagcagaggtcggcgccaagccgccaactgtgttggcactgagatctcatgacgtaccgaaagttgccacctcggacacaatctcagcgtcaagaaagcttaagtgattcagacacgatgccactacatctaattcgtttcccgaaagttgccaccttggacaatacaccaatagattgaactaggagtgtttttcccttaccccaaaattcttcttctcaatgtatgtcaccgcgaactaaaagcgcacaacgcgaactcaactggagcttccgacggcagtagaatccagcaccagccagagctcacccaccacgcaagccgcacaattaggaatatctgattgaaaataagaatcaatttgcacaattaggaatatctgattgaaaataagaatcaatttgccacaatggcagtgtttggtttggttcataaataattctttcgtgtttggttcataa

SEQ ID NO: 8031 - DNA, 8608 bp, Oryza sativa
tatccataatgaaccgtaaaaccaacccaaccgtaaagtctgtaaccaatatcccactaagactgcatggcatcatcttctgcttcacccggcacttcattgaacatgtactggctctgatactccatcaagtactgcgtcgatctcttgacgtccaggaacagctggtagaccctgcttatatcctccatctccacaaccttacccttgcgtttctggcaagctaatgcagccgaagtgatcaggtggatagcatacctcagggacgtctccactcctatctttgtgagcaaaaccttagcatctgcagacatttccacatcttcttcatcgcacctgatgtctaggatcttccggatatcatcctcggtgtaaggctgtgtcgtgatgattaacagacgatcaaggaaatcaggtggtatcccatgtggtgatcggtagtttgtcccacgtatggatgtgatccctcggttagttgcaatgactagaattggagccatgtcattttccaatgcacggtttaggaaggagaagcattcgatatctagcatgtggacttcatcaataaacagaacaccagggacaatctcagccttcccttcctccctccactcagcaacttttgtatcaatctgctctcgaacctctgcacgaatttcaccagtgtcaccagtgaaaagtgcaagaaaaccttgtgtcctggacagcaataacaaaaaacaaaaatgagtttgtgcaaagatagtctcacttaatttttatggtaggtagaaaaccacatctgaaagccaataatcttggtctaatgaccaaaaaactaccaagccagttataagttagatttttggtgattaaaaaatggaatgttcaaaaagattcaccaaagaatactatttagaacacatcagatagttgtttggctgataacatacttagagagagagagagagaggagagggagacagaacacatcacaatcacgatcagttcatgatttcaaactagttgaagcatattcatgtaccttgtcttggaacatggttcatttatgtgcacatgatactccctctgggctgataatacttgtcgttttagacaagggtgatgtcaaactttagaatctttgattatgaatcatttttaaaatatttttctttcaaatatggtgaccaccacatggatagattagtcttaaaaagcactttaataaaatcatatatttgttaacacttttatacatattataatgaaaaataatggtcaaagttgttttttgtacactgtgcccttgtccaaaatgacaagtattatcaacccggagggagtaattgctaagctatccaaagtaccattaggcttgactaattttcatcacattatgtcctctagcaacatcgtgcaggtcctttctttcacaagagttacaacaggaggctgctctctattgttatttctctacgggccaaaagaaaaattagatctgatttgggcagctgaattgtatttcagctccaagcccaacaagatcatatatgccatccagtagtcagtagaccatattttcttagtattggctaactgtgtggatgcggcacttagtagggagaaactgatccaactagggctgtccaaatccagtttaaccgagttctgtcaacccgcattttacatgtctgcaggtgaatgaatgagatgactaggtgcgacgtagtcactggaacactatggttagctatggtttggccaattttgctaatgcaggaatgctcaaccctttgatctagttccagcgtcattcaataggatttgggtggtgctgagaatgggacaggggttgtacagtataatgcagggacttccgtgcaaagagcatggtcacagtgtaaggcagctaagcaagattaaccgatttcaaatttattatgtgattctgatcactgcagatacacgacacagaaattattttccattcaggctcagaagcaaaatacaagattgtaaggcagtccttaatttggaatttggagcgacaagctgacaagtgatcctttgtgtgcaaacgctggaacagatttttcaagactgaaaaagaaactttggtggctaagctatcacctggataattaacatacaagcaagcacacagcacatatgtccagggtaactgaaagtcaatgtgaaataccagagctgatagaatttgaaatacttcagttggttatttcacttgtatctatttttcagttgagtgataccaaagctgacagagacttcacttttgtccgcttactcgttgcagtaagatgtgataacaaacgccctttaatatgtagttctctactatgccaaaatgattaaatacttcaatgtagatttcttgtcaggtagtatgaaatatctactccagtaatggacgaatttttgggaagggaatgtgaaattaccggctattgatgacatcaatttcatgtaaggtgacacaatgcacgacctccttgcgcttctggagctcgccctcggggcacttgacgaacttggtgtgaggaccaacagcatcgtaatcccgcgacctcccgattgagcggccaagcttggtcaccttcccggaggccttgtcgagcgcaaccacatccccgctctgcaccttctccttccccagggcctcaatcatcttgccgccgagctcgtacacggtctccatgtccgtggtcttgagcgtgaggcgcccggtcttgccagccgcggcgacaccggaaggcgcggagctgccggcggcggctgcggcggagacggggcggtcgatcgagatctcaacgacctcgccctcgatgatctccgcctcctccttgatgcggacgccgatggagcggcggaaggcctgggtgagcgcctcggtcttggagaggtcgagggagaagagctcggacgcggcgacggaggcgaagggcgtctcggcgccgagggacttggcgatgcccatggcgagggcggtcttcccggtcccgggctggccggcgaggagcacggcgcggccggcgatcttcccctggcggatgagctgcaggatgagccccgcggcgcgccgcgcggggagctgcccgaccatcccctccgacgagccgcgggcctccagcgaggagtccagccccagcccccggatgtgggagtgcgccccgatgcgctcgatccgcgtcaggtcgcggctctccgacagccgcttcagctccgccatggccaccacccgccgccgccgccgacgaggtgcttttggcttcccgagggtactaaaagagaagaaggtttaaggcgaaagggggggaacgagttctagggttttgccagccagcttgggttgggttgagtggatggatatatgaagacgaagacgaaaggggggagcacggagaggtgttgcacacctgcacttgtgacataatgggccgttactagttgggccagatgtctttttcggcctgtttggaaccaaagtttttcctattggattaagtccacatgacgttcctagtctattaatcgagtttaaatcgcatccccgaaccgcaatatctttgacctcccaacttgcaaaaccgggttgaattaggtcctccagtagcatataaggccggtttcgctgacgtggcatggtcaacctacctgagttagcatgggccccacatgtaagtcgcaaaaaaaatcccttctctccctggccgagagtagtcgccataatagtcgggtgtggcggcagcgaagctatgtgtccttggctgcttgcaggtccaccagccttgcgtcccgggtcatcgcgtctccgtcatccctgagtgggaacgatgatggatctaattttatgcaaattcaaatggcatgactacgtatatacgatttgtaatgccatttatctgaattgacatatctgcaatagcgtggatccaattaacccttacataaattccgaattcatgtgtttcccctgtaccctaccccatcattgaactctccctttaataacgggggaatttaactatttgcaactattaggtttgtcaattatctaaatgcccctcttagaattgcatttatttttttgccattgaagagagagaacttcttaattctttgccacttttgcatatatagcacgccaacaaggttgtcccgtcatcttattccttctccacctcctctctatcttctctcccccttctctctcaccttcggcatcttggtggacaaacggcgagctcctactcgtcgagcactgagcctcgctgagccctctgaagaggagctcgctgaccggatggtgccaagtatgccgtgtcacgtgagggtgggggttgcggcagacattggcgactgcagaagtgtcctaaggaggatgacgaggagagtccatggaccgaggcacaacgatgaaacggggatgcggcggtgtggaggagggaagggtggacttgaggaaaagaggcttgctactggcaatggcgctcattcgcggctccgcgacccgtttcacttgacctcactgttgacaatggcgctcctccttatcaacatccaccgcgagcacaaaaccctcatcttgtgcgccttgtcctcctttggtgacagcaagctcctgggtccctgccgcgccacatctccacctaaccagccaagacaagggagctcgctggctacccaagaagatagccgaaggtgaggaaggagagagaagatagagaggagggggagaaggaagaagatgacggggcggctttgttggcgtgccacgtatgtaaaagtggcaaaaaaaattaagaagttgtttctctctaagggcataaaattaagtgcaatttttagaggggcatttggataattgacaaacctaatagtggcaaatagttaaattccccttaataaccctctagggccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagaggtcagtgaaaattgtgctctgtggttattttgtagtcagtatggtaggcagaagttgattccgttcaattattgtttcgattcatttcaacttgcttgaactagccacattacgacgaattctagtgaatcttatagtcagaatgaggtagcattgagcagtaatgacgaactggtggtgtgattgtgtgaataggatgtgtaacggcgcatccttgtcatgatttagttgttccagtaatgaattctgcatagacaatcgtttgttctggccttgaattaggtctgataccccatgtccccagcaaaagaaggttgcatcagtaattggggttggtgcaagatgcacctggataatttctggatgtttatcgttgcaattaaacctctagttctctactgtaacaatttcactcgactgcttgtaaagtttgagacatacaatttcttaccaataccgttggttgcaacagtttatggagggagccagatggaatattctgggcaaaggtaagatggtatattatccctgaagagactgcagcacgaaggcagccacataatttgcgtagggagctgtaccgcaccaatgatcttgcagacattgaggtgataagttattttcgagtgataaattggttcctttggatggtatttttgttcattattcattctgttccttgcttttatggcttttgcagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgaggtacatgtactgaaccttggttatagactgttcatagtaggagtgtaggactcaggggcaccattctggtagtcaagaagtgaacctcatcctactctgttattgtagacaaaggaagatcctggcgacgagccatacaatgctggtaatgattatgtcagtgactcggatgaagattctgaatatgatgaggaggaagaacctactaaatgtagttatgctagaacacatcaatcacatgcgttggctgcggtaccaaccattcctcgtcctccccccctcttgcctgtctcctctctgctagtgttgcacttcatgctttactgaaatgacatgcccatttgcagaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataagtatgttagtacatttttgcagcttgtttcaaccactttcttttgcaaactgcttttgagttgaagtctcatgtcagagaaatggaggagatatctgcatttgtgaaggatgcaatttgcaatgatcaatgtctaggacgctgcctttatattcatggtgtaccaggcactggcaaggtaactaaccatcctttactgtcccctatgatggtttgatgtccttttctgtggctgaaggctaagcaatattttctgtgcctactttttcaacctgtagactatgagtgtacttgcagttatgaggaggctaagatccgagcttgattctgggaatctgaggccttattctttcatagagattaatggtcttaaattagcttctccagagaatatctacaaggtatgtgaacttctatcttggttgaatactatgattgtcctagtaaaccatatcagccatgttaaaaggattataatgcatataattttaatatatgcaggttatatatgaacagttgagtgggcatagggtagggtggaaaaaagcccttcattatttaaccgagcacttttcaggtggcactaaaattggcaaacaagcaaaccagccaattattttgctcatcgatgagcttgatcttcttttgacgagaaatcagtcggtaataatttgtagctgaacctgttgagtagttcagcaattttgtattctattgtttggaaaatgataattgtttgatatttcgttttgtttgtcactttgttttaccatgtagattcatgttcattgacatttgagctaatgttttgtcaggtgctgtataacattcttgactggcccaccaggccaaattcaaacctagttgtcataggtacctatacttttgtttgttttacgtgtgattttagatggccttttaattactctttggctgttactgaacgcaggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtttggaatgcagtgtcatgtgtaaatcttttctattattcacccatgtcttttctgtgactgttgctttgtccatcctatttgcaattttttttcctgaagggtgaatttatgcaacatgtcttttgttttaaggttatttcattattttgttctctgcatatgaattttccatgccattaaacacctttttgctaccgcttgtccgataacaaaaactttggatgttctgagttcctagtcaaactaataaatgagtggcaggtgctgtaatcactctacacttttcccttttccaacaaat

SEQ ID NO: 8032 - DNA, 1774 bp, Oryza sativa
taagtgtcatctgtcatttcatccccgatgaacattacttattacttcacttggtttcatcattccatattacaggaaaaagttatatgtttctatagaaaagtcaaacaacaagcaatggcccatacaacgccccctcctgttgtcacatgctgtagggttctgttggcatgtgttttattcaactgactattgcctacttgtacaggtagctgctatgtctggtgatgcaaggcgagccttagaaatatgtagacgtgcagcagagtttgcagattaccgcgttaaacaatctgggcacacttctgtgaatagaggtacggaccacatatctacaagccatttattgcagtcatggattctggatttatgtaatcttgatgaatatatattcaagtactatggtcttatgacttcatcccttcattcgtatccaattccagctgtgtatagtgatcaaactttaatctgatacctgtaggaaaaaatgttgtttgcatgggtgacatagaagctgctattcaggaagtctttcaggcaccacatattcaagtaagtgggcactgattgcttgttttaagaaatcagactcctagttcactttgtaatgcagtacattattcagttaggggttggttactgcacatacttagcttgcccttccctaacaagaccaattactttggctaggtacaccttcaggtgtagagaccaggagttatcgtccattatctaacaaaacttaaccaattactaatgttagctgaccttctaagcctcacctgtaacttttttcctctaacaggtaatgaagaactgcccaaaatttggaaagattatattggtcgctatggttcatgaattatacagaagtgggctaggtgaagtgatgttcgataaggtgagcacccactttttgttgttttaatttatagagcactgctacacatactagctttttcttgctaaatttttactaacaatcatcttaaccgtttgatttaggtagatggaagttataaaaaatttagatactcatagaatgacacatcagtgttagtaagaaaaaaaatagtacatagagccttttcctaatttatatgttgctggcctagctttgtgagcataaagaaaaagcaaggtagagattgacttttctctgattctaatgcaaaaatatcacctctgtttattctctagtaggtgattcatcaaacttattaggcctttttagacagctgtatccactgtctttcaagtttcaatagtacagcatattaccgtccttcacatgacttcagaattcactgtaacagtattactacaacacatactggttatttccctgaatcagtacaatggcctgcagggctgaaacgtgcaagtgttttgtactttgtcatgtattcttcattaacattttcaatgcatcgttttattttaacagcaccttgtatttatgtgaattgaggcagatacaaagtcttgttttgcttaagaagttcccttggtgtcagtacttttaattctttagtgaattacttttgagatgtcaataatcctaattgatgttatgctcatgcttaatattgttggtggtttgaaggaagaaatctgatgggctttcctattatgctgtaactggcagcaactgtcctctcttggtgccatgtcaacagagaaatattgcctggctatgatactcttctgaaaatctggtaaatgaatctggttttttgtttacttcatattacatgattttttccccaaatgt

SEQ ID NO: 8033 - DNA, 6419 bp, Oryza sativa
gatttcatcggaatataattaatgtagcatgggagaatgtgtgcatgctaagggtgtaattggcatggtgttttaatcgatatatacattgtgggagaatgtgtgcatgatgtcttgattgatgtgatttaaattatcattggccttggcgtataaacatatatgatgatcaatttgggatggaaggagtaatgaacaatgaatcccagttctagccaggcaaaatattcttagaatcatagaaatggatggggtattacatcttcgattaaatttcacaaaactacagatactatgaccaaattatcacaaaactacatatttaactcagtgtatcacaaaactacacatttaacatcaaatttatcataaaactacacatttaagatgaagtgtcacaaaacacatgtttagtaactaaattatcataaaactacgggtttagaaccaatttaatcacaaagtaataatgtttatagctccaccataacaatggtgctagggatttaaactccaaaagttgtagttttgtgataagttcaatattaaatatgcatttttgtgatacttaacctaaaatctgcagttttgtgataaatttggtactaaatgtgtagttttatgatataactccttaaatctgtagttttgtgataatttggtcaaaatacctgtagttttgtgaaatttactctacatcttctgataaaaaaaacacatgttaaaacatggcctgccctgctatcattttttttcttctgttactagttcctgccaagatttcattcaagtgacagtatatctgctggaacttgacctctctcattttcaccctctctgctagttgtatgggggcattaaaacattcacagtggtgctgttttatcttcattctcgaatgtgactaatttcgtttatacttatgtgtatgaaataacttggtgtgtgttcctattgcagttgcaagcttggtgaaggtaagataattctctgcgaggaaggcactaagcacaagttgcagaagcttcagcttaactatccaaggttagcttgcaagattgtgtttgccattgaaattggcattacaaggcacctttatgccgactctttacttactgccttttaaagactatcagagtcatcttttgggggaaaattcaatttgaatcatttacatgtttaaattatacatcgtgtgtattgttccctcgtcaacttaactttttgtttgaacgaattaaagcctagaggttctagttttaagacttggcacttagctaccccattattagtgatccacttcggtcattggtggagccttgacgtgagcggagaacttttggttaatctagctggatgaaaacttaatatgcacctcttttatcatgtaaaactgtactgatgattatttttcttgtctggcagtgacgatgtaacttttgccctgaaggaatccccagatattccatggttgtccaagtacctgtgaagtttacacttgcagcggttgtactttcccagcatttcattcatctactcctggagttggagagcaacgatcgcaactacttgcccttgatcagcagtaagtttgaacatgttcccttgttcattttttcgtacctttgcagaagtttgaaggccatctagtattttcttgtcatgaaccatactccacactggagcatgcaacactaacaagcctagcgcatcttctgcagaatctcggaatttatgtgggtccaattgttcatcttccaaaagatatcgactcgaaggatgccgctgcaacaaaatgtaaatgcagtgtcgcaccaggactgtaacatatgtatgattcgaaggagattgtaggtcgccattttattttcgccaatctgttgttacccaagaaactttgctctggcagtgttgttttctcttgcatccctctgttacgtactcccttcgttccaaaaaaagacaaaccctggtttccgtgtccaacgtttgaccgtccgtcttatttgaaaaaattatgaaaaaaattaaaaagacaagtcacgcataaaatattaatcatgttttaccatctaacaacaatgaaaatacgaattataaaaattttcatataagacggacagtcaaagttggacacgaaaactcagggtaaaactcagggtttgtctttttttttttacggagggagtacgtgcgagctgattgtactactgcacatttgtaactggttacctacaaatcatcatcaaattatctgttgtgaaacattgacaaatgtatgatggattgatgatatctgttaaaacattgacaaattatctctttttcgcttgtgaattcccgtgggatattaatctctcgtttggaattcacgcgggctctctcttcttcgttttatagcttggacccatcgccttcctctcgccgccggcgagcccattaccaatggcgaacgcgagtgcaacgcccaagacccctcgccgccgccgccgcgtcacgttcctggctaggacttgccaccgcctcctccgcttgctcgccactcaccgcctccgccgcggtggccatggccttaactccatcagcgccggtgacgactcccctccctccggtcagccgccgcgaggccgggacgcggaggaagccgaagcgacccaggcggcggcggcggcgcaacggcggcacgaggagcgacacggcgacgacgacgccgccgccaccgaggaggcggaggcggccgtggcggggaagtactgggcgcagcggcgcagcctcttctccctctacgaccgcggcgtgcggatggacgcggagggctggtactccgccaccccggagcccatcgccgccgcgcaggccgcccgcgcgccgccgggatccctcgtcctcgacgccttcgccggcgtcggcggcaactccatccagttcgccgccaggcacgccgccgccaccacctccatctctctccatttgcaacctcgctcgctaaccaccccgtctcccctgcaggggttgctacgtggtcgccgtggagatcgacccccggaaggtggagctcgcggcgcacaacgccaggatctacggcgtcgacgacatgatcgagttcgtcgtcgccgatttcttccacctcgcgccctccttgaaggtatgctcatccctttactcaatgatactgaaaaagaaacaaaaaaaaatgaagcgtcaatgcttcgcatttaggttcaactcctaaatttagtttcaggagttaagtttgaaatggagttctgaagcggcctaaacccagctctatctccctagtttaatttgtgagaaagcttcacccggcttggctcctattttaggtgaagctgaaactgttcgactgagagctatgccaaacatgccataaatgacgaaacttgagcagagctccagttcgtttattttctcctctaatttatttactctagttgtaaacttgcaataacgttcggatgtgcgtttctgaatttcaagctggatcaaagttttttttaaaaaaaatggattctgattgttcttgttgcattgatcaggcagatttggtgttcctttcaccgccatggggagggccatcctacagccaagctcaagtttactcccttgatatgctgaagccaagagatgggtatgttgttttttttttttgccgatttcctgtcatatccacaatatgaaaaataatgtgtttaatcatgcagatttacaattttccaagctgctcaggaaatatctccaaatatcatcatgttcctgccacggaatgtggacttaagccaagtagagcaactttcttggttgtcttctccccccttggattttgtggtacgatctgtttcataacctttttcttttttttcatcgagcatttaaaactttcaatatgtgaaaaaattgacatggtattcctgttgttttatagagcgaagagaattacatagaacatagattcaaagggataaccgcctactttggaggtttggcacaagaagttctgaagcaaggataaatttctttctaaggtttcaatgtctagcttcccctgaaattctggtctaatatcttgcaaatgccccttagttggtgtctcaacgcaagagaagctaaggcttgatggtagcccaacgtttttatttgattcagtatatggaaggtatatcccatatttttggttcactacaaggtctcaactgtgtcggtggcgtggtgggagatttggtattgtgctgctccacaaatttggcttcgattatttggcattctggccttttagcaaattgctaccatcattgtcaagattgcccctaactccacatgcagcgaagcagtcctatctcgtcaatgctaaatttagaaaatctataagcaaccccaatttactggagaaaaatacatagagggaaaaccaccatcactgcttccattcccttcagcaacaaagaaatagttcttttgggagatggatttttgtccctagagagaatgtccaatgtcgtctaaaaagtcattaaaagagctttaaaaaaatttggtaagatagaacttttaaatttgacttgtacaattagaattttacaaaaacaataaaattaccgtgaattacgtgttctatttgaagtcaaatttattatttttgtttctgaattgaccatgagtttattattatacagagtcaaatctattgtttttgttttcagagtcaaattgaccgtgaattatgtgttctatttgaaacctgtatgtttatggtgtggtaccatttttattattttttgtgcgacctaaaaaaaccccaagggaatggcccctcgagggataaataaactttcccattcttttgtcaatgtaaactttagaaaacctataaacaacctaatttacatgacaaaaatacaacaaggggaaaaaaaattaacaaaagaatcaattcctccttccatccccacaaaccccccaacaacaaaaaaaacaaaaatgttcaacacatatttatatattcactaatgctaactatactaacaatttatataatcgtcatcacaagcggctcctgaatgcgtgagttcctctgttgtagccgtagtaggagaggtaccaccggacgaacttcttgagccccatctcgaggctggtcgtcggcttgtacccgagctgctccctcgccaggctgatgttggcgtgggtgaagggcacgtcgccattgccgggcatctcgacgacgtgcctcctcgccttcaccatcaggcacctctccagcatcgccaccagcgccggcaccgtcaccggcgacgtgttcccgaggttgaagatcctgtacggcgccgccccgcgcttcctcccgcccccgcccgtgctccgcccagccgtgtccagcgccgccaggcacccccgcacgatgtcgtcgatgtaggtgaagtccctggtgttggaatataaagtgaattgtccatcttttctcaccagctcaagcttttgagttgaactagtcggtgcatgcaactcaatatggtatcagggttggaaatttcggaacgaaattttcgaaatttgatcatttcagacccctccgatacgatattatttcagctgaaatttttaaatttctacgtgaaattttggtaatatttgctcaaattcaactaaattttgttcaaaatttcggaccgaaattgaccgaaaatttcagcatttcggtgaggcccgatcaaatcggcctaaccgataggatcaaccctgactggctgactcaatatggtatcaaaagttagaggtcttgagttcgaattctggctgaattgcagcccacttctattccatgcaacttaatacctggcgatgtcgacgtgatcacggccccggtagacggtgaccggcttcccctgcaggatgttgcgggtgaagaagaagtaggccatgtcggggcggccccagggaccgtacaccgtgaagaagcggaggccggtgatggagaggccgtagatgtggttgtaggtgtgggtgatggcctcgccggctttcttggtggcggcgtagagcgacgccggcttgtcggtgcggtgcgcctcggagaaggggacggcgtcgttgagaccgtagacggaggaggaggaggcccatacgacggccggctgcgggtcggcgtccttgcaggactcgaggagggagacgaggccggcgacgttggagcggacgtacgacgaggggttctccatggcgtagcggacgccggcctgcgcggcgaggtggaggacgtgggtgaaggggacgacgtcgaacagcttggcgaggaggcggccgtcgttgatgtcgccgtcgacgacgaacacgccgtgcgagcccatgagggcgcgccgtgcctttttcagcgacgggtcgtagtaggagttgtagttgtcgat

SEQ ID NO: 8034 - DNA, 4714 bp, Oryza sativa
agcggaagctcaggtacgtcgccgtcatcgccaccaggaacagcgcccacaggaacatggtccccgtcgacgcgaagcaccggtgaacctgccggctcatcgccgccgacgaccgctgctccaccttcaccttccccggcgtcgacgggtacatcacctcggcctcctcctcctccaccaccacccgcatcctcctcctcctcctcctcctcctctcctcacgcaaccaaacaacacaccatcgattcagctcgaacgagatcaaatatttttgagttccgttgctcgaaaaagaattagaattttgagttcttgctgaattttggtggttttgttgttctgagaaatgatttttttttgttttctttaatttttttggccgtgggaaatgggcgggagggattagtggagcgtgcgaaggatgttgcataaatagcggtggttttgtgttcggaggctcggcgatgatggtgggggtccctgtaatttagcactgtttatttttaggccatatggtataacatttgaggatgttttgaaaatggcaggaccatcatccattgaatgcattagggcatctacaaaggtagagtcagatatgagctctacgttatctggagactagcatcctacaacagttagagacaatatggtctcaactttttcttacttttattttctttctttcaccaccatgcaacaaaatttgctctaataaatgctaagagtcgactctgagctgttgtcatgcataacaaccatactcctttctctttcttccatgtcatcaaacttacttgcatggcaatagagagagaccactaataaacaccgttgtacatgcccttatgcatgagatttgcgaagaaatagggaacatatgtatcgaggtttgtctagcattttaatcctttccttatgccattaggccaataccatatgccattagttggtttcagttttgtagtataacctaaacaaaacccactatatttagacttggtgccaatgcaatgatgtactccatccgtcccaaaaaaaggcaaactctgggtttccgtgtccaactttgactatccgtcttatatgaaatttttttataattcgtattttcattgttgttagatgataaaacatgattaatattttatgcgtgacttgtctttttaatttttttcataattttttcaaataagacggacggtcaaacgttggacacggaaaccagggtttgtctttttttgggacggaggtagtacctattatcatgtcatgcgctgaaaagtgtagtctgccgtttccgagcatccgagtgcctctcttttagcacatcaaaatgtgatggaggctagaacaaatttataaaaccgttgaacttagtttttttacttgatatatgtgttaagaaacttagagcttgaccaatgaagacatgaaccaaatatatttattgggtccatcaccaaacttttcatatatggatttgcactactgtccaaagaggagaggaattactcatttgtatacttgatgaaaggattggaataagagaaaataatctcacctctaaattttgtatctccactttgctcttaaattatacaaccgtgttgtactactctctatattatcaagcacgaagctataagggagaccaaggtagaagaaggaagagaaatctcttatacgatttgcactttaagaattggactaagggtgtgtttagttcacgcaaaaattgaaaatttggttgaaattggaatgatgtgatggaaaagttggaagtttgtgtgtgtaggaaagttttgatgtgataaaaaagttgaaagtttgaagaaaaagtttggaactaaactcggcctaaaaaatgaatttcttgtatcctccttgtttcgttttggtgccttctgacgactagccgattcgattcaccggcgactagccgattggggttttgggtgtgctccatggtaaacaagaagtcgatgttgcatgtatggagcagagacgacgtcggaccgtgccatcgaacgatcaggccatacatgacggtggaaatccaacccaacccaaatgcaacggtagaaaaactgtactgtacacctctccgtgctcagcagcatcgaggagtggacaagatgagcccgggcgtcctcctcatcatcgccatcctggacgtcgttttttttttaaatgagggtaaaagctttgcctcgtatattaatagagatggagaaaaaacaaaacaaaattagaaagggaaatatttacagggcaagccaaaagagctaaacccgcaagaattggccaagagactaagtgatatctccaaaaattccaaactcttgaagctttgaggctccagccttgacccaggctcgagcctcctccttgatcttggcgatgatggaagccggcgttaaggtggtgtttcggaagattattgcgtttcgttcgcaccaaacttcccatgaaaccaagatcaccagtgctcacaaaggaaagcggggggtgttaggagtgtctaccactacgttccaccattgctccaccgagtcgcagtccaccgagtcgtcttcttcctcttcggcattctcaacctgctggtgcagaatctcctcagacagacttcagagttcaaaccaaattggccctaaattttcggcatatcgagtggtgtgctctgacgctcagactccgcttgttttacacacaggggttcagactttcagttgcccctctgcagcaacagccaacaagcccacccttgcagaagctttgtcgctaggaatctagtttctgaacttttggaaattcggaatgtcgtcgagatgaacaacacatctgcaatctcacctccctcttgcagagttttagtgttctccattttttatttttgcccttgtctagatccacatgtaccaaatctagaacatgaacttcaatctgagtatccagtaaaacctatgacatggaccctagccaaattattcatgcttttaccaaatttcgagtagacttcaaaccgaaccacactaaattttgagaaaattgcatatctatcattgcataagttaggattcgctcaactactatcacttaaatgggcttagctagaataccataattaaccaatgtgtatttgctaaaatactatcccggacagaaataccctggatcttcttcttcatccctccctccaatgactgaataggtcgccagtggccaccgccggctccactgccgcgccatcgctcacgtcgtctgggctgggcaccgttgcgcatcgccgccccaccctgactcgccggctgacgacaacctcgccccgacaccttgctgccaccggcaattagggcgttgccctccctaccatcggtccatcctggtatgtgtcggcgaggcagcacctgtgaagccggcggtggccgccagcaacctcttcaagcatgggagggaagaagatgagctaggggcatttcatttctagatagtattttagtaatgatcgattgtggatggtattctagcgaagtccattttgaataattgtatttttatccagtagatatgcaattttctcctaaacttttggcctatctggacgtgtcaggggatggggtgacacattgatgaatggtgtgttctgactctgcttgttttacgcaggattcagattttcgttgctcccatgcaacaacaagcccacccttgcagaggtttgtcgctagggaatctgcaaaatttgtttctgaacttttggaaatccggaatgtcgtcgagatgaacaatacacctgcaatctgcagtatcagtatgctccctcttgcagagttctccaatttttttttactgacatcgtagtttgatactctgtgcaaccataagtttacgtgaccaactttaattgtacgtattatttaattttttttataattagtatttttgttgttatgagataataaaacatgaataatactttatgtgtgacttatgttttaaagttttttcaaaaaaaaaattaaataagaaggacgattaaaattgagcacggaaaaatatggctgcaattaatatatagccgcaatcagtagtttcattgcattgcgtacatcagcatgacgtcatcacctaccatctcttcttctctacgacgtcgcctcgtataacaacaagctcttcttcttctcgtgttaccatttgtgacaacaatggacacgtcggcgtccacctcgccgccgccgccgcgctctgtgctcagcaccatcgaggacaagatgagcccgggcgtcctcctcatcatcgccatcctcgccgtcgtcttcttcctcttcggcttgctcaacctgctgatccagaacctgctccggatgcgccgggcgcggcggcggcggcggcgcgtgggcgacggcggcggcggcgtcggcatgggcagcccgacggcgttccagggccagctccagcagctgttccacctccacgacgccggcgtcgaccagaccttcatcgacgcgctccccgtcttcgtctaccgcgccgtcgtcggcgccgggctccgcaaggacgacccgttcgactgcgccgtgtgcctgtgcgagttcgccggagacgacaagctccgcctcctcccgacgtgcggccacgcgttccacgtgccctgcatcgacgcctggctgctgtcgcactccacgtgccccatctgccgcggcagcgt

SEQ ID NO: 8035 - DNA, 32349 bp, Oryza sativa
  unsure (1)..(32349): unsure at all n locations
gacggcaatggcaatgccggcgacctcgccgtcgtcaaaggcaccaccaccagcaacgatggcgacatcggcggcggcggcaggggagatcttggacagagacggtgcttctccatgggatcctacgagtacgtcatggacgagcacgccgcgctccgcgtcgccgtcaggacgcccaagcggaggccgccggcgaggtcgaggtctcgccgccggctcgcgctgtcggagtgcgacttcgcgggctccgcctccaagaagggcgcgtgggaagcggcggtgatagaggccgcgtcggcggacgccgcggcggcgaggctgaacagggacagcttctccgtgtccaagatctggatgacgtcagccactaggaaggaagatgtccggacggcggcggaattggccggcggagggaggcgtgcggcgtcgttccggtggccggcgatggccgaggccagcaagaagcatggcgggatcaacgacgagcgccgcgacgtcgaggccggcggcaatggcgactcgtctctcgccgacgagcggccgtcgttggcgaggacggcgctgcagtacatcgtcggcggcggcggcggcgggcggcagcagagcagccgagttggaagccattcttgaaccatttggtttgcacattgaacacagaaaaaatgtccccttattttttttcttttcattgattttttccctacttttcttttcttttccaaaatgattatagtgattgcaaagcaacaaatttgtgaagaaaaaagcaattgaagcaactgcatttgtgtgttagtcatggtcatattaattagttaaagagacaaaaggcattcttggtcttcattggtttgaaatatcagattgtagtgtaacataagccaggttgatttgcttttaaagttcagcagaataggaggaacttggaagacactcatgaacaaaagaagcattggttgtttggatttgtcaggttgacagtgatggaattaaatcaaattagcaaaccttataacaaccactgaagattaatatttgtatcatatgtggcaatataatttgtcttatgcatcattttaggatggcacgaaatttttatctgaataaacaagtgcagaacacttggcttagctgtctcaccactgcatctgatctactcctaacttactaagcattcttggtttaaactgaaccaagaactggctaatacagacaaagtgtatacaggcatggcaatgcaactatgcaagtgagagaagtggattctctctaattaatgacataaacaaatcagccagtcaaatccctcattaaagaagctgaacccagtgtctgtttgcataattgctactactactactaagcatttagtgaaagtgctggcaacatttgacttgcaactgcctcatcagggtctggtgtgcatgtggtgagaaggtgagaggaagcttgattatcggagtttcaaatacaaatccatttttcttgccatgttatgcttgatttcatgagctgttcttctgttggagctgagtttctgtttgagtagtggactcgtgtgcaagatagtaatactgcatttacaggctgttgcaacttgcaacagtacaagcacttcgctccttttgtccgcaggctgttgcaacagtacagatgtgcaatactacttcactgtgatgtaggtgcacaaatttataagagtttaaataccaaccttgatgatgctgcggcaccgtcagatttttgtctgtttagtcgtcaggtaatatttttggcagatcaacaatttcattgtagcatggatggaatgaaattggatctccctattaaagaatggtggctgaatgcctctacctctgtaccttccctgaaactttatttcagaagatagaggttcagacttcagagttacaattctaataataggtttgctaaaaaagcttaagctgacaagaaaatgtggatgatataaagtagaactttcatgaacttttgtagtagcttgcgttgtgacaagtcacaatcgatatattttgcccttttcaatctaagaaccttcttgtaatatctgtgcatagaatatatttaatttgaaaggaaagtaaaacatagaattgcagaatggtagtttgtattgtgcatttgtgccacctaggtcactaagctaagctggcgagtcaaattttttagagagcagaggaccacatacagctacagtaaagcgaacttttgaattcttttcgcttgttttaacccaagttcacggtgtgttcatgctggatgcatcattagttcacaaatccgggtgagctaaagctgaatgcgaccggtcaatcggcacaaaagcatgtttggaattgaccatgttaggagaacaggagcaaagctagcatgcatgcatcatcttgagtagatgacaaggttcggacacaacaagcaaagcatgagtagttcagtattagcaggtctgaagaccatggagaattggagatagaagaggtcaagaaaaggagaaacaggtctgggccatcttcagaaaaaaataatcaaatataagtaccagtttacattacacaatatagaagcttgagagatgatcagtgaagtagcttaaaagattggagatttaagactgctagttgcacatgagtagttgaggaactgtcagcaattaccatgacaggttggagattttaagtttgaaatgctatccaataaacaagtgtggtcactcctgcgcatcgttttttttttaatatagtttgatattaaagtactgaaacatagttttagttttttttttgttagacaagttgcaagtgatgaacgtgagttttctggttttcttccacaattcctgcaattaaattgattcatgtataaatccagcaaagttaatgcataatatctactccacgaagaccctaaaaatttctaccattctgacagactcgacagaggttctctattgaggtaatattgcaaataaatgcttgcataaagaacagaactgatgcaaataaaaaggttctgcatattatctttttctatcgaaaaatgtgctccattgtcttgcccttcactggatttctgtacaacaattttaaattttcttttgaaaaagaattcatggattgaagtgtgggctactagatttaccagtggttaatcactgacaatgtttttctgccttgccatggcaagattgaaagaacaaaatttataactaagttattttcggtttgttaccctttacttacaaaatcaaataggctattcagataagcatatctggtgtgcttgtaaactcctgcatcctccgaaatcaaaataaaccaaaagaatccctgatcaaagtgatcatcaactcaatgtgccatagcccataactactactcctccgtttcaggttataagatgttttgactttgatcaaagtcaaaccgcttcaagtttgacaagtttttagaaaaaatagtaatatttttgacctaaaataaatttattaaaaatatacttaattatcaatttaataaaactaatttagtaatataaatatcactatatttctctataaacttaaaacagtttaactctgaccaaagccaaaatatcttataaacggagagagagtactggtactgttcatcatcagttgagcctgcaagctgcaacaacccccttgtcccatgctgccgtccccaatctgaacctcatattctcatcccatctgtgcgatcgatcgatgcacgcgctacatcactatcatccttcgaccaaatccccaaagcgtcactaatcctttttttttttgtcggcgtggatggagtcactcgcttactcacccctgcactttgacaactgacaacatcaccaggaaagagaagattatggccccatttgatttgtacgaaaaatattgaaaaattagatgattttaattctataagaaaaatagtacctattaaggtctttgaaacaaatgattgaattatttcctttcaaatccctatggaatagataatactatgaagagattttaaagaaaagttagcaagagcttcaatatgttgagtctatttttctcatctgattcctaagtttttcttttagcttattcaaataaccatttatgtattttgcaatcgtttattttgcagttacattcatgtaaaaatattacgtttttcctgttcttcctatttctttttttcaatcttttgcttcaaatgagccataagggtcccgtttggacgataagattatagattattctaactttgtgataacaattgtttttccattacacgagagacgcacgtgcacacacaccactacataggtaacaccatactcatacacccacgaatgtgttatgcacatgtttaaaggaacagaaatcaacgtcacatacttggactctgtggccttcacttattgggaggcaattatatagtaataaaatattagtattccgcgggagaagagaaaggtccccattgtttggcttatttcctaataagccaaaacggcttattaggaaataaaaatgaaattgtgggtaaaacttttgtaaatgtgttttttttgacttaaaagccaatttgaaaaaaaaaactacgttgaaaatatgtcaaaatcaatcttaaaattaagcttgaaaatttaaaatttagctttttctttggtttattaggccatccgatgaggctgaaaaaataatccaagacggcttggcgatgaacagctgcaaccagtagcagcaggcaggatgttccttcgtacttccagtgtagaccagccttgttttatctgggcctcttcggcctgggataagcccaggttctgctcctgcaggcaggaaagccggatgttccatacttccattctcgaataattgacacggttaattatgatcatgtcattttaaccgcattcttttaaaataattatattaagtaatgaatagaagttatatttatgattatacaacgctcaataatataacatgtttaaagtatttattagaaatgaaaattagttaatgctaaaactaaaataatatcgatatcaattattgaagaacagggacgaaatcatccagacaacactaatttacactacacaccacctttgggaagaaatcaggccagaggaaggtgtgctctgctttgggatcctttggaacaacttacacttgacaccaccttcccttcccttcgttctgaagcccttagagaaactgaggcaacggcgaaagatcttagggctcctttggaacaaagattcttagaggaattcaattctataaaaataccttcttatgtggtcctttgtatcaaaatccttgaaagttcctttggattaactaaaggcttcatcttttttgcttatgtttattcttatcaaccaaaatttaaattttcaagcttaaacttggagtttattttggggtcttttcatcatagtttattttttagcttttttttagaacacgtgtataaaaaatttatttataaattagttttcgtttgcaaatataggtattttaactgatgtggctttaaaaacataggtatttgaaccaaaggtccagtctcttagaaaaagaatcatatatatcaatcggttcatgtgtttttcctacgctccacctaactaatgattcccataactttcttattttttttaatctatagggacttctttaaaacatgggaatatgaaaaacacatgattcaaatgtcatcgcaccttgaatccaatggaatgaaaaatacataaacccgttaggatgaagcataggaaaacacataggatttagagatgtagacagaaaggaaaatttctaagaatttggagttaatgctaggaatccttcaaaattatcatgaaacatgtcatttcatagaaatttcaaaggagttctacagactcaatgctttgttaaaattagtctcataaaaactttttctatatgattcaaatctttttaagtttctctacttttcttttgttgtaaaggagcccaaagatttaaggtgataagacactttaattctgtatttttttttcctatccaacattataagaagggaaaattacaaaattcacctcataagtcacttgaattttgacattccacctcataagtcattttgctgcaaatacacaccttctatttagtttattgtaaaaatcacccgaatgcacacgtgcgtaaccgaatcaattcgttatcgctgatgtacagttaccacaggctaagctagtcaaatcaatcgtgtccaagtgcttgcattagacttagggggtgtttagatccaggggtgtaaagttttggcgtgtcacatcgggtattatatagggtgtcgtatgaagtgttcgggcactaataaaaaacctcatccacgcatggcacgggtcgcgtactcgcgtggccctcctcgctgccgtccattagccgccggaccttgctggccacctccatgtaggggtggtaatgggcccaacattttggcgtagaaattatgagggttgggtaaaaaaaggtttggctgaaatttagtagttttttgtgctaaaaaaatttaagggttaagatggattgtgaaagaacccacgggtcttgacccattaccacccctacctccacgcgtccgacaacaacagcggcgttcggcccccggaggaggcggtccacgcgaacgccagcgcagaggatgtccgccacatgcttcgcgttcgccgcctgctccgccatcaccggccacgtcagcatcggacgaacggcggcgaggctctccagcacggagttccagccggcgtgggtgacgaacgcgcgctgtggcacccagccacggacgatcttcccgtcgccgccactggaccggccgatggcccagaggcaggcgtggccggagtccactaccccgtgccggccgtgcgcgagcgtgccgaacgacaattctgtacttttttttattgagtgatttctatagttttcttgttcttttcgaataatagtattttgacacgataattctgtactttttttttattgaggtcctgtttggttcccacgcaaaaacttttcaccctgtcatattgaatgtttggacacatgcatggagtattaaatatagaagaaaacaaattacatagattgcatgtaaattgcgagacgaatcttttaaacctaattacgccatgatttgacaatgtgttgctacaataaacatttactaataatagattaattagacttaataaattcgtctcgcagtttacaggcgaaatatataatttgttttattattagactatgtttaatacttcaaatatatgtacgtatatccgatgtaacgcaccaaaatttttttatcccagtacaactaagggctcgcgaaaagaaaatttttggcgtcacatcggacgtttgaccagatgtcggaacgggttttcggatacgaatgaaaaaactaatttcataacttgcttggaaactgcgagataatcttttgagcctaattaattcatcattagcacatgtgggttactgtagcacttatagctaatcatagactaattaggctcaaaagattcgtctcgcgattttccccctaactgtgcaattatttttttaatttatctatatttaatactccatgcatatatcaaaaattcgatgtgatgtttttagaaactaaatggagcctaataaacagtgcctggcgtgcagcgatccggtgcaggcgtgcagcagcagcactgccagtgccagatgctgagatgggggaagtataaagtacaatctccccattcagcccaatcatgcaatcttcatcttccatcgttggattgagaaatagacgtctaaaattcgtccacgtcaccatgagttaaaaattaactcgcagattcaccgtgagttaaaatttaatgagagttaatttttattcaaacttaaaatgacatgacgtcgatcactcacagttaccactgtgtcgacgtgttctacagttcgctcaacacttgccactgccgccattcgccgagctcgccgccgccgtgccgtcgccggcgacgacgtagcttgaccgcagctcgtcgaccagccgccgcagcgcctcccgcgacgcgccgccttctcccaccgccgcgcgcgccgcctcccggacctcctcggccctggcgcggatcgcgcggccctcctcgccgccgtccatcagccgcccgaccttgccggccacctccgcgcgcccgacgacgacgccgccaccgcggaccgcgcggacgccggccccgatgatgtccgccacgagcttcgcgttcgccgcctgctccgccatcaccggccacgccagcatcggcaggccggcggcgaggctctccagcacggagttccagccggcgtgggtgacgaacgcgcccaccgccgggtgggacagcacgcggcgctgtggcacccagccgcggacgatcttcccgtcgccgccggcgtccaccggcggcgaccactcgccgccggaccggccgatggcccagaggaaggcgtggccggagtccactagcccgtgcgcgagctcgtcgagctgcgcgtcggggaggtgcgcctgcgtgccgaacgacacgtacaccaccgaccctggcctcgccgcccgctcgtcgagccaagcgacgcagccttccgggtcgtcgtcgtcgtcgtcgtcttcctcctgcttcgtctccggcgactcgccagcggcgaggaacagtgggccgacgagccacgcgcgggatccggggtggtagaacgactcgaggatggccgcgtagtcgccgtcgagcgcggcgaagctattgacgaggacgccccagctccggtggtcccagtcgcggacctcgtcgtggaggaactgcgtcaccgggtcgtcggggttgcccccctggatcacggcgtccgggacctcgtcggcggtgatcctcacgtcgtccgggaagccgggcacgtggaactccgcgccgccctcgacgccgacgtgtggtcgcctcgaggcgagggtgaagcagagcgccagggagaagggcgacatgccgttgaacgtgaggcggcggacgccggcgtcgtccgcgactcgctgcgtgaacccgaggaagaagtcagagacgagcacgagcggcggcggcgacgggagggacgcgaggaactcggcgaagggctcccggagcagcgccgtggcgcggaggaacgccgggaagagggactgcgacgggagcgcgtcggtggactcgacgccgggcgggatctgcgggtgcgccgggaacgggatggcgacgacgcgcaccgacggcgacggcggcaggcggcggcgcgcgaaggcgaggttggccggggtggtgacgagcgtgacgcggaggtggtcgccgtggtgcaccgcgagcccgcggcgaagtggaggagcgggatcatgtggcctttggacatgagcgggaagacgacgacgtggtcgcggccggccagggtggcgccgtcgttgccgccgacgccctctgcggcagggcgtgtggcggcggcggcggaggcgggcatggtgttcgacgaagcgttggacaatgggtagtttggtgagctacaataattggcaacaaagtgcagtaacgaaggctttatattgtgtaacttgtgtttgcatgcttatggttctatacttctctataattttatatattatgcggtgtttgaaaaggagggattaaactcacaaaaattttagtctctatgggaggggcaaaagctgtctagtctctactttccaaacaccatcttagatgatgccctatatggcaatatttcatatgaatttttgttaatattatactataaacgatggatagaaatattttgaaataatgtgaaaatgacatggtagatgaggatttgatatgcttgcatattagtaagctttaaaatatacccactttatcccattgcataataatttctagagtttagattttggttgttctaatggtagatacgcacaaatgaatatgcatagtgatagtgttgacaaactttaagttgctcaactgtaatgaatatctccgtcaagtaaactgtgacaacacctaataagtcaatttagtatattaaaaagacaatattgatgaggtcactgaaatcgtgagagcataactctatctctcgatttctcgattaaattaatcgtgatatctataaatattaattaaatatgtgaatacgctttaaatagtatcttaaaaaaatccaaggatttattgctggtccaagcatgcattaattaagaaaggtacactcatatgcctgcgatgccgacttattggctataaagttttttttcagccttctcttaacccacacatataatagttagctatttataattaatacatgacccacttgtctttctcacaattttttggttattgtgtccaagtcggctgtaagtttacagcccgcttctactctctctcttctcttctctcctccacctcagcatttagccgacttacagcctcttattatacttgctcttagtcgttattactacctctgtccccaaatattataattctagattatttagcatatactcacttcatccacaaaagttgcacatattatttttgtcacaaaaaccaagaaaaaattaaatcatcttcgatgttacaaaatcaaggagtgaatgcaagcatgcaaccagtgagtatttagatgactccttaagttttaatcaaacatttaatttatctcatcatttaagtcttgaatgtataaagactacaaataagaacaacttatttgaaaaaaaacttaaatatgaaatatgtcaaacttttgtggatggagggagtattaaggtttcaaaagaaaaactatggtgcccttcgtcaaatggtgcataggtaaaagttggggagtggttgagggtagaatatagagaaatttggatgagaaatcattgatgagaccattagtactttactatgacaactgttttggggcaaatttgaatactaaaaatacaattattatgagatggacgtagtactctatataagtacaactacaaacgaacatgaaggttgaactccgagttccaaattaacttgatactaccttctacaccctttgttccatagaaaataaatcatagctataaatctggatatgtgtgtcaggttcatagctatagttgaactttttctcagagggagggagtatgctgagtacaactataaatcttcaactcatttgatgtgttgtagtagataatctgcagtggacaacatactactcactatatctcaaaacataagaaactagtactggatgtgaaatttcatagtattaagattcgaagtactacaatgtacaatgtgtcacatttattactagattcttataatttgggatggagatagtacctccgtcattttgggacgaatggagtagttattaagatcggaccgaatcagtggtccaatcggaaaaaagacaaaaccaaagcctcagccgattcggtctagctaaaagatcggccatgcaatcagatcggagaaaaaccggttgaacccacgttgacgatttagttagagacacgtacatatttgagccgtgttgaatcggtggtcgaactggttggagtaccatactcattgtaaaccgagggctcaccggttcgacttctggtccagtgctaataactatgatagagagaattgcttaaggcagctagttgtattactaaaatgtcccatttttaggatcattcttaattattaacttctcagcgagtaggttattagcttgtattttaagagcacgtttttcatggtacgtacttccaatataatttttctttaaaaattaaataaattcaattttaaatttataataaataatatttaattaattactcgttaatgatcacctcgttttatgtgtaccagctgattagctcagccttgcctctgtgtccgaactccgaacggggcctcatcgtcatagttgaccactaatttcaaatacgaaacgaggaaatccaacaaatgtgagatttactcctgtccggcagcatgtaccggccagtagtaccgggagatacaagatcaaatctgactgtccatcttgaagggatacgattggaaatagaaagagcaagaggagcggaacgattccggagtcgcgccgccgctttcctccttgcgctctttcttttttccctccctgaatcgcttctttctcatctgttcctccctccgagcacagaaacggagcagttgccccgccggccgatttgatccccatccatctgccgtcggcggccacggtactggagaaaacctcacggcgcgctcgccccgcatgcagtgtcaggagcacaagcagatggtggttctttgccttcatgcatgcttaagctctagcaaaccagatgatgacattgtatcaattgattcaggcaggaaagaaggcgctccactcgctggtaccgtgacttcctcaaggatatatggatgctcctcggcaatgggtttggggcagagctcgggaattcggtcactggggagttcgttgttgctgagtggatgtggagccacagtcgcgacgggaacgggatgaaggtgctccgtagcagtgacgggaagaggagacgccgctgcgatgggccgccgcgacgacgggaagcggaaccaccgccgctgcgatgggcaggggagccgccgctgtgatgggccgccaccgcgacgggaagcggagcagccgccgctgcaatgggcaggggagacgccgccacgacgagagccggagcagcagccgccgctacgacgggcaggggagatgccgctgcaatgagccgccgccgggacgggaagcggagctgccgccgccgccgccgcccactggatacggatcccgccgccgccgcccaccggatgcagaccccaccgctaccactgaccggaatcggatgcatccctacacgaaaagacaaaattacccatccacccctctatctattccggtaccacctcattggcaaatttgtacctgaggtaccggataatttccaccgtccgatcgagctgaataaatggctgagatttggtacctggctagtaccgtggtacctgctggataggagcaatgctcaacaaatgtaccttgttcaacgtagctaaacctggccaaatgggccgtgccaagccgggccggcccgagcacggtagtactgtagccggcccaggcccggcccggcacgccagcctgtgggccatgccggcacggcccgttatcccgtgccgtgtttaggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcatttttttcctttatattatgttttttctgccttttttcttttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtgtcgtgctgggccgggccgcccgtttggcctgctataaacgtagcagtacactagtacagtactacaaacttgacgagggagaggaccgaatatgcagcaatcagcattggtaaaagcttaagcgcatgtgcgccaattgacatcccctgtgatactgcagacgacatgcgcaagtatgagcattatcaaccttcgagacttctctcccaccagtacactaactaaaagttatgtaatgttcccaaccttttgaaatgaataaaggtttaggctggcaaaagccagccgtagttcccttccgaagggtataagcatcgagatttctgacatggctctgtttggatttaagagatattttttagccctctcttaaatagcccaaatagctcaaaaagattcaaaagggtgagctatttgagagctatttggaaatagcccacccaaaaaaactatcccacccaagagggaagaaaatttggtaagacttaagtcctacgcttatccgaaagactctgcttcccgcacgacacctgtccgcacaaatcttaagagtagcgaatatctcttttgtaccctttcttcttcctccggccagggacttggcgacaaatccaactcgctcttaggaccgagggtccagcatcttcagacgtagcaaggtccgggggcaaggtctggagcagagtttccggttgccaccgcacccgtcatgcttcttccatggaaaatattcacctgacattgttgttggtcaaaggtaatggatgaacttgcaatgcactagaacttgggaaaacatcaaattgatagatgtcgccatgtcgatgtgtgtgtgaagcctctgtatacgttgcatcctagtaaatgattaggcctggttgtcaaaagagaaaaatgattaggcctgaccttaaaacctattgacggcggttgggttgagcacgaggtcgatgccgctgcgcctccttggcgccccctttcttcaacacatcgtccagtgctgctagctgtgacctcgccgtggccagagatgccagtcaaactgtgggcttgatgccttgccggcggccggccgggtagtacgaagatgggagattggagaagagagagaggaaagagaactgttgggagaagagacttgctgctctaagattcgtttggacaggtgtcgtgtgaggaagcaaagtctttcggatgagcgtangacggaagtcttaccaaattntcttcccccaatagatgctaattggggctattttaggtggnngccactgaaaaatgtcttttctgtttatctctctccatgagaagttacgttaaaagccaaatagctctcaaaatagctattggatccaaacaactcagagttattttattggaggactatttacttgtgctaaaaaatagctctcaaaataactcttggctagttctttaaacagggctattaattgatggagtcatacacccacgactttattcatgaggccaccatctaccacacaaaaactgtttcgtactattccaccgtaccgaaattgttccgctatagtattaaggctgtgtttagttcagcgcaaagtttggattttggttgagattggatatgatgtgactgaaaggttgtgtgtatgacaagttgatgtgatggaaaaggactgaagtttgaatccaaattttggatctaaacacagcctaatttttggtaggtgttgctggacaactaaaaaagtcacataaatcattgttgccacttgccatgctactattgcttgtgcaataacatttgctgtgcttatcacatagggatgaaatgtgaacaagttattagaagttttttttatgaaaaattaaataaaaatgaactaaaaaaacaaaaatcaaaatgtatagtatcatattggctataatgtatattttcgcttcaaattaataataactagtccaacctattatggcagtggtagtcaaatcaatcttctcacaagtcttaaaaataaataatggagtgtttagatctagcggccaaaagttttggcgtgtcacattgaatatatggacacatatttgaagtattaaacgtagactaataacaaaacaaattacagattccgcatgtacactgcgagacgaatttattaagcctaattaatccgtcattagcaaatgtttactttagcaccacattatcagatcatggagcaattaggcttaaaagatccgtcttgcaatttacatgcaatctgtgtaattagtttatttttcttatatttaatactccacacatgtgtccaaacattcgatgtgacagtgtaaaaaattttgccaggggatctaaacaggccctaagtttgttactatactctataaaccttgtggtcacaaattttaagtttccatgcacattggaaattctcatctcccaaccacggatgcaggtcgtttgcagtactgcacatacagtactgcaggggatctcaattgctgcccaatcacacaactactagtagcaactagcataactgcaagatagatgttcagatggcccaaccgaacaagccaactatctctcactctttctcaaaaaaaaaaaaaaagagaataagttcaccgatcgtcactcaactttatgttgagtttgtttcacatcccttatctccaataccagaaatcttcacccctaaataatacaaaaccatgcaattagagttccacaacagtatgtatctccggtttcgctaacgtggtatcctagtcagcgataaaaaggcccacatgtaagttataagagaaaatgtgtggtcttcatatcttctctattctattttcttttctttcttctcctttctttggtgagcccgggaggtcgccgctggcagaggggggggagaggtggccggcgagcccggccgagctccgccgctatcgacgccgcctcgagcgcccaacaaagccatagctaacctcgcctgcgtcttctcggcggaggcgaacgcccctgtggcgggcgtcgcaccgcaccactctagactacctcgccagcgagggagtcggaggcgagctccttgcggatgccgatctcgctattgcagaggagctcatcaagccgatccgctgatgtagccgctggcagccctggccagcccggccgagctccgccgtcaccacctcaagcacccactgaagccgcaggtgacctcacccacatcttcttggtggaggtagcggtgaacacccctgcggcggtcgtcgcaccgcaccacatcggactacctcggcggtggggtgagttggaggtgagctccttgtggatgccgacctcgccattgtagagtccccgcccgttgacgaggtcgacgacgtgaaaggatacgagggagggggcaggcagacgcgagggaggagctcgtcaagccgaaatgctgtcgctggtggtcccaacgtctacccctccggcaccggcaaccatgatgagatcccactctagctcgtggaacacgagtgggaggctacagagggcgaggcgacatgaggtgtcggtagcacggcaaggtttggttaggatgtgcagagctggtggtggtggagggcaatgagttcacgagcggtcgagggtgccggagctgctgctgtcggtggtgccatcctcctcaccggctgctcttcctcaccgtctgttgctgggcgctgccgatgatatgagcacagaggagagattgagagagagaggggggagggaggggggggtgaaagggaaatggtcattgacaagtgtgcgtcgacatatgctacgtcaacaaaaaccgaggataatatggtccatattgctaagggacttatttaacatggtttcgaatacttgaggggtcaacatttctaacattgaggattagggggacgtcatgtagactcgatctgaagttgaggtactgagagtgaacttattccaaaaaaactgaaaacaataagcccactatgagtccacgggcccaaagacccaggcccaaaccgcgtgccgtttccctgcacaagcccaaccccacacatatcatctcatcccatctctcccccgtcttctcgaactctccatctcgggatctcgcccacccaccactccaccccctctcctctccgtgcgccgccgcagaattcctcgccgccgccgccgccgccgccgccgtgaggtccatcgagatcgcgaccggagcaggtgggtgatccgctcccgcctctcgcctcccccctcttacctcccctccttcgtgatttccccggtcccaaaccctagatccgccgcacggccccttgcgggattagatctatcggtctcggggggcaggtctctacgtcgtttttgtgattcgttgtttaatccgattgtatttttgttttcttttggcgatttgataggtgcaggttgcgatggcccgcgtgtacgtcggaaacctggatccccgcgtgacggcgcgggagctcgaggacgagttccgcgtctttggagttcttcggaggttagtgactcgccccacctgtggtatgtattgtgtgcgattgtttcggttttctgctagagctgcgtgcgcatgtggaatcatatgggggaacatagctttagcccaccatcggaacagcaaaactcgttctagggccagggcctgagtgacctatgcagccacatttatgtaacttttggggaagacgattggccataccagcagtgcacggtgaaattttaaatgttgtaggcttttctgaaatcctgttccgaccctagtagattttactgtaatagaagaggtagagagggaatttgatggattcattttactcaagattatcttattacaagtcgttatttatttatttattttgagatgtattgatctttctagagcacaattacttcccagctatggcatccaggctttagattgcagtgtacccatctacctgacatcaatggcctccaaccaaacactagacttcaagcaccttggattagattttatcaggatacaaattcaactcattcagatatctacaacacttatttggctaatttactgtatgctggagatgcttttacggtttttctgttgcctaactttttcttattttcttgatgtgctgccaataagtttcttacctgaggccatgtatttgtattttgcacccacaattcaaattatgtttgatgctgattgtcctgatgcagtttgcttatttttgttttgtgcaagcagtgtatgggtcgcaagaaagccaccaggttttgcattcattgattttgatgacaggagggatgctcaggatgcaattcgtgatatagatggtatgtgaatgcttttatgagaacatagcctctgtcagttggatctatcacctctgagaatctttctgctctgattttcttttggtgagttacagggtggtctttgcttgcaaaaatatcttgtgaaagttaaacttctttcaaaggccatgatatatgcctattagtgacaacatgtgttaccattatatctatactttgttttagtaccagaattatgtgaatgtgatgtggcctgctgtttagattatgcttttcctcccagtccctctctctcatccaccaaaacacctccttgcactgttatgttagagcaatttcatgtttgtgcattaatcacttggacgtataagctgtttggacattgtcaagagggtcaagatcctacatttatgggggaagtggggtgaggcgataaggcgtaaaacaaacagtagtgacaactctgaatttctaatttttaaatggcttcttttataggcaagaatggatggagagttgagctgtctcgtaatgcaagcagtggtcgtggtggccgtgatcgatatggtagctctgagagcaagtgttatgaatgtggtgagactgggcactttgctcgtgaatgccgtttgaggattggttccgggggtctaggcagtggaaggcgtcgtagcaggagccgcagccgcagccgaagtcccaggtaccgcaggagtccaagctatggcagaaggtaatcaaaatgtcaaataactgttacactgttgcaatagttaaaagctttttgttactataagttaatggtcacaataccattgttgggactgttggttctgctatggatgtgaagtgttagtggtttgcaaccctactcactctttgatacaactaagttatctttctgtattcattgtaaaacattatatgacatgcacacaatttgttaatttagggttgcctatggtccaaatttacaaacactaagataaagcttgcaattttttctattcagtatttatccacctgttgccatttcccaacatctaggatagtaagtgctagcaaagaatagtgtagcatttatgccctgttttgtgtatgtaactagtatatttacacgaagaagaataacatatctgataatgttataaatgatttgctatgtgagcagaagttacagccctgcagggcgctctccaaggcgtcgtagtgtgtcaccggctcgtgcacgcagctatagcaggtcaccacaatacaaccgtggccgtgatgaatctcctgcctatgataacgggtaatgcagatttcagtaagcagttgtcattttactgtttctaactgagttaaccattttcatcgttcgctcttcgacaatctctaatatgttccatttatggtgtcagatatcgccgcagcagaagttagagctgaacctgatgtctaaagactgctgttacaaatgttactttgtgggttgtcagctatgaacaatgccctactccaaatatcatcatcaactctggactttgattaaggttctcataacttatctaccttattatgctttgtgtttgaagttatattactcgagaaacttatgattggatgtgtattcaactaagttcaactgtctttctgtgtgtcaataaggcatcggcctgcactgcttaaacgactcggccgactacggctaccagttatatcttcgtggttgtgttcttcgctcttcattctacgcgcgccctcgcctgcttcatgcaaacgtcatacagccccattagttgctgcctacaacacctcttcgtgatccatatacttcgttgaagatgctgctcatcagaaaacagtaatcgccttcttttatcgtaataaaaatttggtcatattgtcttcggaacaacagtaagtgcagcatctggaagtattggtgaaacaaagttcttcgtaggcatagactccagaaaatgaatctgcaatccgaggagctgcagtattcagttggatgatttacacccctgcccagtccgtcacgccttgtggcaggtaaatgaggtcaccagaggagtgctttttgacaaggccgatttcagctcagcaagcactgtatctgtgcaagcctgcttaagattttgttggatgcagccagaggttttgctctccatgatcttccttctgcactcgctcagcctgcctcagcctaccctgcgtgctgccgtctagccaagagccttcgccaccactgcttccccgacgtcgccttcgtttccattgcttccccgacgtttgatttcatttgcttagcatttgttcgtcaaattaatgtggtgaatggttatttcttagggatctacgggtgaaaaatgccagatgttattctatttcgtcgtcgaaatgtgatcattattcatatcatcgcatgccctttgcactgcattgccgtttcattatcccgactcggttggttgtgtggccaagatgcctaaccgaccatcaacgtcaagatgctcactgtagtgtaagacacgagcacatccaaaaggctggtggtgacatgaagaaagctgacgtttcttgccgatcaactgttggttgccgttcgcctaccggttcatgttgcgcgaattgtcccaagatcgtgacgctgttctccgttgcgccgttcgggttaacctttggcacacgatacgtagcgttcctgaaaaaaaatcgatacaatctcgcacgaaaacggggcaaattcctccgcgttcaaatccaaacagctctctcttgagtcgcgactcgcgacggcgggacatgagccgacgaccgggtggtttggttggtgccgcgcacgcagatgatgcaggtgggcgtggatggatgatgtatggggagaagaaagtagagtatggaaaggaggatgggttggtgatgcgaggcgccgccgcatcgcaccaggacattatcccgatcgaaacgggctcaataaacaaacggctcgaggaaggaggattaggtagatgatgatcgatggacgatccctttgctttttttttgtcgaccttagctggggctctgccgccgatatattgtattaaaaaaagttccatccgatgttaaatttttatattttgggaagtactactccgtcttaaaaaaaagacaaaccctaacttcgaacctggagtgttagacacgcatatgtccagattcatattgtcgaaacatgaattcggcaataataaaaggaggtagcgcacgagacctaaaagtggatggatgcagagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacagtagcccctgagaccttcacagtcgaaaagataatcttctctcgaactagattactccaaagctgagtgcttcaatcatcttcgccatggtctccgaagtacttttaccaaatatgaagactgtggagggctgaaaaataaagtcagatgcatcaactagatgcacctaataggtgtagccctcgactatgcggttaagtgaacaaaccaagcatatagtcaaggaataaataatccaaccaaccgagtggcttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttgagtccctagaagacacatggttccaccacacctggaaatatatggcatatgtggtataaaatccgagtaaataaactcataaaggatttaccaaccgcctagaaaatgaccacaatatataatcagcctaagccataatattggtcaataaaaatgcacacttacgtggcgaaaagcaacgatattgtatccaatcaattgcttaaaaacccaaacagcaccatgactatattaaaaagtcagcggggcagctatataaagctttactgtttgacaccttttaagatgcactgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagtcatggaggcgaagaaaccagtcggcggcagacagatcaactaacaatgaagatgaaggaacccagcgacaaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtaccaaccaatgataatgacaaagacactcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccatcaaattaatgttatagctgttgtagatgcttcacttggaggagagttgatgttgttgtccaactcgttcaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaacacatatctagaaatggattttttttttttagaaagatggagtatgtagtaacttgggggtcatattattttctttttcagatacttcaccagattattacaatggagtgctccacgtctttaaaataccttttcagaatgaactcttttctacttcctccatttcatattataagccgttttgatcgttttaaaatcaaacttttggaaagtttgattaagtttatagaaaaatatagcaacatttatagcactaaattagttttattgaatctaacattgaatacatttgaagtttatttgttttatgttaaaagtattgctatattttttataagctttatcaaagctaaagaagtttgacttagaaaaatatcaaaacgacttatagcatgaaacgaatgtagtacaatgttgtttgagcatatcacttgtttaaattatttatataatttacttatcaaaatatgtaatctattgttataataaaattaataatctgattcagatatggcctacgagcgtatattttagttataataaaatattgaaacaatagattaaataatttacttatcaaaatatttaatctattgttataatagagaatattatctccaatgcagatgcttactcccttcgtcccataaatttcagttttagtattgaagataatatttttaatacaataaatctatacatccaatattagattggatggagggtatatgttggagcctggagaagaaaatgaacttcacatgcgtatgcacaggcagacaggctcatatgaccacacggatccatcacagcctaaaaatgcattcttttaacaaaagagtagttgaccaggtctccgtgtcaatcaatactactactagtactagtagtctagtactggagtagtaccaaaagcagcagaccaaaagaaagaatctctctactcgactaaaaatcacaccttcacccttcatgtcagcacactaaccgcgatatttaccccaaatcccaccgatttaacagcggttagtagtaataataaagtaaggtttggatgcatggacttaactttaatctctatatttagacactaatttaaattattaaatatatactacttacaaaaccaattacataaataaaagtaaattcgcgagataatttttttaaacctaattaatccataattaaagaatatttactatagcatcacatagactaattatggattaattaggctcaatagattcgtcttgcgaattagtccaacattataaatatattttattaataatatatatttaatatttataattagtatctgcacatacgatatacgatatcatagggtcttcagcgaaaaggcccccatcgtcttccccctttccacggtagttttcgttttccgctcgccttcctcctccctctcccttcccctcctcgaactccgcgcggcggccgcggcctccctccctcccgctcgatcccgacagccgccgcagctccccgattcagcgcggtctctgctctcctgctcctctggtggctcacgcggggaaggatccggcgctggatggatgagaggaggatgaggtagtttgtttggtggtttggttgtggcggaggtaagcccatgtttgggtcgaggagggtgaaggacgagatggagctcaggaagcagaggaccgtgaggtgagagcggctactacttgctttgctttggggaatcggggtctttgagttttgagtttgtttttagcttggggggaagttggggggcgcggaggtgaaggcatgacaagggcagtctttctcccacttattagtggggaattcaagaagaattccatttcttgcgaggagaagatgaattcttgagtggatttggttgctggtggtggtcagttggtcactgctgtatttttggactagtgtttagctcatcagttatagttatgttcgatttaaatggttaggtttaatttcttgtgttggattatggataatcttgtagtgaatcccacaagttgtttgctaacttcaggcttaactttgatgagcacaattagagatatatttataaatgagaatgagatgggaaaggtagtctgataagcctaagaagatcatgtcatgctgattgctgatcatttcttgcttttagaatcactctaacaatttctctctctactcctgtataaaagaatctagcaaattaataatagtcttactttttgagtgaattctaatgctgtcttcgtccccagattccacgaggagagagcaaaaccaactatacccactcaccagaagcaggctgggctagctactagtaagcttggcctggggatttcggagaagaacaagatttttctagcagggaatgagctttggtacaagaaaattattgacccatcaagtgatttcatcttgacatggaactatgtcctccgtattgcatgcttcgtggctctatttatggatccactgtacttctatgtacctaaaatctattatggcactccgaattcatgtatcgggagagatacacgcctagccatcatcgttactgtcttccgatcaattaccgaccttttttatgttcttcaaattataataaagttcaggactgcatatattaatccaagctccacgttaggggttttcagtcgaggagaccttgtcacagatcctggtaatatcgcaaagcattatttgagatctagctttgtggttgatctagtggcttccttgcctctaccgcaggtaacttggtttcttccccctgtttttctgtcaagacataacttgagcctttatccatctaattcattgcataattgaaagcttgggctagcaagaacgctcttaccaaacatggaagtattggatctcaaatttcatatactaagatatttcctgctttagttgcgaggttataaatctttgtgtcttttaggtgaaacaatccacataggctgctcaagtccttttagtgttgtattattacttctttaatgcaactgattacattctcttgcattagttaaaaagggcatctgcacttttgtacctgaagttcgaggtatagaagttatctgacatatttctccctttcttgcagatcatcatctggtctgtgataccatccgtcaaatattctttgtcagaacatgacgatgatatactgcttctgattgctctttttcagtatgttctaagattatacctcgtattttcattgaactctaaaattgttgaagttaccggagcattttcaaagacggcttggcaaggagctgcttacaatcttctattatacatgattgctagtcatgtacggtactcatgcgagttctctacaattttactcctttcgccatttaatactagctggcatggttacttcgaatttgtgctaccgttttcttctgttttgctatttggatagtcaagatgcacttatccttttcaggttttaggagcattatggtacttgctatctgttgatcgccagaccgcgtgttgggaaaaatactgtagcaaagaagcgggctgccaaaacagatacctggcctgtgatatacagtctgattcaaattggaaaatcagcaccgctatcttcaataaatgtgatgccactaacaaaacaattgattttgactttggtatgttcacaccattattatcaaatcaagctcccgatcagggcttcctgaagaagttcttctattgcctttggtggggtttgcagaatctaaggtttgactctaaacacatcttctctgagacttgtaattaaggagaagaaatttgaatataagacacatcgtgctcactgttaaagcaaaagaatatacaattataagtcccatcattattacaatttttatctgattaatttgaactattatgatctgattcaataatagctaatatgaagattctaatatattctaacatgcactgtgattcttttttgttaaacagttgctatgggcagactctgactgtgagtacttatattggtgagacgctgtatgctatattcttggcagttcttggtctcgtcttgtttgcgcatttgattggaaatgtgcaggtactttcatggtgtaaactccatttacaaattgttaaaatgctttagttatgaagtaactttgttgttcatttttgatatcccattcctttgttgtctgatatataaatattttttctgaacaaatttctgtattgtaattttacttgcttttgtcaaactattttctagtgcctgcctagatttggtggtgataccatcattttccctctgaactattaatttctgattattattattttttgcattgctacaaactcctttttttgtttgcctaaaaaaagtgcaagcactagaaaatgtatgtttgcaagatgaaacgtaactccttatttcttcgtcactagggctagagggggctattttatgatgttttatatacatgcaaatttaaagtattgtttttaaaaagaacagaatatatatttattgaggctttgggtgagcatatcgccaatactaagtttgttcattgcaaattgtgattcgtttcttgcttctataacatttgactatggctttaggaatggtgaaacaaatttttcctggtgtccaataatggtgaacatgcataaagttttttttcccctgtaacaatcttatatttttgcactcacgcagcacattcctggtacattgtattatattgtattcgaactgatgtgtgatagtaccatagtggatttaaatagcagatgtttgggtttttgtcttgaaggaagctgatataaacaaggcttccaataatatcatgcaatgcattaattagaattgtttttacgagataacatcaacagctgtttatttgggtatttctatgacctgttctgttctagtaactgatttatgattatactagtaaataccattacaacctcttagcttcaaaggcgtacataattttctttaagaaatattgagctcatcacattatattgtttgctagacctacctgcaatctatcactgcaagagttgaggagtggagaataaagcaaagagatacggaagaatggatgaggcatcggcaacttcctcagaaactaagagaaagagtgagaagatttgttcactacaagtggcttgcgactagaggtgtggatgaagaatctatattgaaggctttgcctgcagatcttcgccgtgacattaagcgtcacctttgcctggatcttgtttgccgggtaaaattacctttcttccctttgttttctttacaaaattacaccagttttgcaagctctcctattatcaagtgaccattttaagaaatttagctgtgctgccaggttatttcattgccatttatcaccacatttgaatggacaaaagaagttgacacaagaaaaataaataggagaggaaatgagaaaaatgacaggattggaacgtgcctcttttcgttctatttttcctttccttttcttgaagcaacatatttttcctttctttatttcacattaaaaatagatgggataagataaccaaaaaatggcaaacaaatgctatggatatgctattgttttatcccgtatttttttttgtgagaaggatatatcaacgtcatggttgtctctttctcttctccaatccatgctaatgcaatgacctacacaaaatttgctctgcacatcgaacatattttggagcttgagtttgaatctgctacagccgacatgattcatctgaatcctattgtttgggtactcatttgcagatgcaccttttccttcttcccttttttggccagttacacacttgatactggcagttttttagtaacaggacaattgcaattgcctgttaatgtatctcttgtgaggttgtcattgccattaatgtagcatttcatttgatagtgagatctcgacattctatatcacttactgattctcaccaatctttcataccgcaatgcattaggtcccttttttctcccagatggatggtcaacttctggatgccatctgtgagcgtcttgtatcttccttgagcacagtgggcacatacattgtccgtgaaggtgacccagtgacagagatgctttttatcattcgtgggaaactggaaagctccactactgatggtggccggacgggcttcttcaattctataacgctcaaaactggcgatttttgtggtgaagaattgcttggatgggctcttgttcccaagcctactgtcaacctgccatcctccaccaggacggtgaagacaatcgttgaagtggaggcatttgccctccgagctgaagatctcaagtttgttgcgagccaattcaggcggctccacagcaggaagttgcaacacacatttcgctactactctcaccactggaggacatgggccgcttgtttcatccaagcagcttggcgccgctacaagaggaggaggctggccaaggacctaagcataagggagtcattcttttccaggagatcattcgaagatgatggttcccctgagcacagccttgtgttgaatgcagtcaggaaaggagcccatatcattaaagaacttcctaagtttaggaagccttctgagccagacttctcagctgagcatgacgactaagcggagagtagcttacattatttgctactgtgaaatcaccgtttgcgctgcaaatccttctgcttgttgtcgttccatgatcacgcttcagagtttgggttgacaggtaactgattgttgataggtgaaatgctgaagctcaacttaacacggtgaaagcatcattggtggtatgggagttaggatcttggagacagaatgatagatagtaaccacgttaattttcttttcttcttggtgattgtgttgctgtaggcttagcttagtgattattgtttaccctttggtcatgctgttaatccagttgtaaacttgtaattgtgttggatattgttggcaacagcttgggacctcgtagtagcatattgttgtattttgactcgccgagcaaattctagcgtctcggcgagtacaccatgtttctcgtttttgagtgtatatgtaaatcacaggaggaacactgaaattgtttttcattcattatgtactactgcttgctggtaatagtaaattaatttctgttatactgctcctgttcggcagcacagaaattgctctgttctacttctatatgaaatttgtgcgaaatttctactactaaaccgctgaaactctctgttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8036 - DNA, 30091 bp, Oryza sativa
atacgctgtgattcgctggatctcctttgcttattggctgaggatgaaacaggaaaggtaaggaagcctgaaacgttttgacccttatcatgttcaatgttttcgctggcctggttgtgtgaaacttatttaaatgctgaaacaattaccctgcgtgtttgttcaaaactgaaattcttcttcatgccttcatgacgtacaggaagtcatagcaaataccagagccattacaagaacaataaagctgctttctagtaatagtcctgatgaaagacatgcagccatctctttcttgctagagctttcgaaatcggagctattgttggaaaacatcggatcaacttctggaagcatattgatgcttaccacaatgaaattcaatgattcagatgatccggttgctgcagagaaggctggggaggttctcaagaacctggagaactgcccaaagaacattaagtacatggctgaaagtggttacctggatcctctccaaagacatttagtggaaggtaaaaattttgcctatgcagaaagatacacgactttctttgatgtgttaattatcatatataatatcaaataaggaagtttatattgccaaaagtcaacatcgtggactattaatagagaacttatttatttgtgtaaatagtgtgcttaacattagatcaatcaatttctgaatacatgtacttcagtacagggtgaacattaacaaagaacaagcagttataactagatatagtaatattgctctgatgactaatatgaaattcgctagcgtgaacttaacaccatgacactaccattagtccattacctgacatgaaacaccatataaaacagggtctgaagatgttcaaatggagatggtgagctacctcggcgagctggtccagaagcaggaaatgaccatcaacattgctgggagtgcttcagagatcctcatcaagatggtgcatagcggcaacactgtgatccgcaaggcggcccttgatgtccttgtccagatctcctcagatggccccaacagcaagactctcgtcgacgccggtgctgttccggtcatggtggaggagctcttcatccgcaagatcgacgacgagcctatggggtccaagacagaggctgctgcagtgctcgccaacatcgtcgagtccggtctcgatcccgacaccatcgtcgtcaacaaggaaggccatgtcatcacttcaaagtattcggtgtacaacttcacccacatgctcaagtgctccatgcctgatgatctcaacctgagcatcatacgtgtgctgctcgcgctcactgcgctcccaaagccgctcatgacggtggtgtccgtcatgaaggagcaggacagcagcctgaccgtgatcgagttcatgggctcgaagacggaggcgttaggcatcagcgcgacgaggctgctcattgcattgtctcctcagatggggcacaccattgccgagaagctctgcaaggcgccagggcagccgggaaggctggtgaagagcatcggccagcccgggcgtgtcaccgaacggcacgccgtggcggcgacgctgctggcgaggctgccgtaccagaacatcacgctcaacctggcgctgctggagcagggagcagtgccgacgttgctggccaagatagaggagatgcagcgcggcgaaatgcgagtgagccgccatgccaagacgtacatggagggcctcgtcggcgcgctcgtccggatgacgatgacgctgtacgaccccgacgtgctcctggcggccatggatcacaacttcacggcggtgctcaccgatctgctcgtgcggtcagcgggcagcgacgaggtgcagcggctcgcggcggtcggcctcgagaaccttagccaccagtcggtgaacctctcgcagccgccatcagaggagcaacggcgccccaagaagaagaacatcctccggcgcctgcgcgacgcgcacaccgggcgggtgcacgacaacaaccggaagccgccaccgccgccggcgcagggacgcctctgcccggtgcaccgcggcgtgtgctccccggccaccacgttctgcctggcggaggccggcgcggtggaggccctcgtcggcgtcctcgagagcaacgagaacggccgcgtggtcgacgccgtgctgggcgcgctctgcacgctcatggacgacgccgtcgacgtggaacgcggcgtggccgtgctcgccgagcacgacgccgcgcggcacgtcctgcgcgcgctgcggcagcaccgtgacgtcggcggcgacaccgccggcgcggtgtcgcggcgctgcttctgggccgtggagaggttcctggcgcacggcggcgagcggtgcgtgcgcgacgtgacggcggaccgcgcgctgccgagcgcgctggtgagcgcgttccacaagggcgacgccgcgacgaagcaggtcgccgagagcgtgctccggagcctgcaccggatgccggactactccgccacctacgtctccgtcgagttgtagcatatcatcttcatcttcatctccatagtttcttgccatgttcttggctgtaactactagaactacatcatatgggcttggtgtatttggtttggtcttgtaactatactgaacaagttcacagggaaaagagaagaagaaaagaaagaacactgcagatgcaatgtagctagtacatgttgttatagcaggggaagattatatgctctttgacataggtagtagtttctttttcttcatgtatgtataatttgtttcagaaattgtcttttgtggattggtgtttttgcttggagaaagaaatatttgcatatagatgcagcaaaaatgtagtgttcagacctcagattgcttcagaaacgtgccatgtcatgttttatcagattcagtgaaacaatgagcaagagtttcatgagattaatttccttggctgcttttgccatgaccatcagcttcagatcagatgattatcgcttcacaaggtcaccaataccagtgtgtagtgaattatgtcttaacaaggacacaaggtcaccagtaacactagatcacagttctcttttcttctctttcagaattcacagctttgctggaataaaaacatctgtgccaatatgcacccgttgcaaaattcaaatgcttgctacatcaggccaagcccatttattttttttttcaacaaatacaaaatcagtgactgcatttctgcctatgttgcttgtcagatggaacatgggctaagcaagtacaacaaagaacaatttctgtagcctcacaatgctagctagtgtatgtaataatcctggggttgacgagaccacagaaaaatcaccttcttgcaaaatgaagcttctcgccatttcaagactgtagactacttcagtggagaacaaattgcttgagatctccatgtgaacatccttttttttttatctcccaactttctataacagcaaatggaacatccaaagagaggcttccacaggaggtcaattgctgctatgaacatgagaaaaatagcactaactaagcattttggatgcttatacttcagtgatcagctgtgagctagtaccatgatatcaacatgctcatatatcacagttttgctgaaagcccatggcacatattgatctcttgcttcagttgtggaatcaatctcagggttgatcatttgatccatgatggtcatgagtaaaaggcatctcaatgacgtcctggaactctccattcaaattgttgggcatctgtccaatgcacaagtaataagaggattgcaaaatactaaaacagtgctttggtactccgctttccaaaaaaatgtttatgaatatgaaagcatatgttttagataactgtgaaggcaaatatgtagtgatgaagatacaattagatatataacaagctgcatttgtacatttttagttggtttactagtgaaatggttagtgctactgaggttacaatgtcggttaacatcaacaatgctcttcccactaaaatcaggttgaagagggttaatgagtcagaagctaaagagactgattgatggactaggttcaaacagcttgcatggccaaaagaatcaggcacaatctggctagttatgaaaaacagatagtaggaattttgtttgttgtctaaaatgtctcagtttagttatgttatctagtttgctttgcttttaagacccacgaactttttggaaagatgggtagtgaagcaagacccagcaaaaggatataaaggggactagcttttcttggtttaaaatattatgtggacattcttttcaacgactatctgtggagcagtattctcgaaacaccaagccatataacactaaattaggtcttggaacatcttgcagaaacttgtcctatttttcatgaacacagtatttggtataaagagcatgaaatgaaaatggccatttagccaaatgcaagtgatggtacaaacctgatgtttaggttctttgaatgcactgttagttcctaatggagcatggattactcttccaaatgcatcagtggggttcacaatgctgggcatcccaacttgtgtatattttggtgggtgtaatcggggatgaacaatgtctgggaagaagccaaaggcagatgatgcagtagtgcctcgacattgaaaaatctgtgtggatgaaacaatcatcatgagaaagacaaatctaaagggtcaaaatctataaagaccaggtgagaactatcttacatctttagataaaatgcgttctatgttgaagtccagtgttggattgacacttgctagcttcatcgacaaaaactgcccaacatgcacacattgggtataccagattacatcgcagcaggactatgcaagtaaaactgaaaatggccctacaagttttacaaacatcatacctcaacctgcctctgtaatgattgaacatagttaattatctcatccagcataacagccttaccagttacctagattacatttcacaattgatgtcataacagattaacagtcattcagtatggaggcaggggacagttaggaagcacttactttactacaaccaggaacaagatcctgaagatatttcatcctttcactgatcttctccctcctaacctgcatcccgaacaataacagtcaaaccagatggctagatacaccattttatgaagagatcattagagagaagaaaaaaaggacctaccctttcggcaagactatggctgtttgtagcctgaccgcgccgtgctcttacatgtatatagtcttcctttggtgaacctgcattatcctttatttgcttcccactggatttcccggacgccacagaagacctctttggttcacccttttcatcatcctcattcttctgcgctgaaccgacagttgctaattgctcaccaccttctgcatgcttcaccccaccatccttcaagaatcaagaaaatttcatattcttagctccacctaaatatgcggagattcagctctgtaaatatgtgtacatcaagcaaatacctgtcctgatcttttcctcttcttggaacaagacaccctagtcccctcatcatggccagcgccaccattgcgccctggcatgcttagctccttggaggaggaatcgacggcatgcgttgtctcaccatccccttgctgcttctcaccagtttgtgacacattcttggatccttcaatctcaatatcctcaatctccctacatggctcgacgccgttttggaaatcacccaaaggctggtggataccagggaaagggtgattgatcatggctccaagattgcctccattgtagcaaggaaaccccgccgtggaatctacaaacccgggagtagccacaaacggtggcggcgcgccggccgacagcatccccaacaaggatgaaaaactggtttcgcctaaacccatgttgtgtgaaggtggattccacaacccaggagggatagggaaaggattcgccatggaggtcaatgcattatttgcagctgcaggagaagcaatctgagcctcttgcaagaacatggcaccaccatggaaactcagagcttggccgtgctcactggcctcactcctctcctccaaatcagtggcgtccttctcattcatctccttttcactccctgaagaccaaaatctgggtggtgaacaaaagcttctagggtgagaaagtagcacggatgagcaccaaatccacctaactccacaaaagatggttcttttgagggaatcctactaatttattcgacctaatctcacttaaacaaatgtaagtacagtcagtcagtgaaagcaacaaggctgagctgagctgagctgagatgactaacacagatacacataaacctaatccactgacaccattaaataacaaagggaaggaaaataaaaatcctcggaaggcgcacacaaagaacaagaagatgacggacacgcgtactagcatccaagaaccaagaactactaggctagaaaaacacaagaaggattgtaaaccttttttctgggaacctcacctccgatcacacggcgaaatcaacggcctcccgcaagaacaacctccccccaaaacccgcaccttttctttccccctcaatggcctgatccagagaccaacctagaagaaaaatggcgagagagagagagagatgcaataaaggaaaaaaaaggatcagagaggacgccgctctccaattcgtcgtcgtgtccttccccttgcacagtagcagtagtaggaggaggagtattagtatttctcttgtcgctgcaagaaacggaggaaaagaaaggggaaattttttgagggtaggagggggtctctgaagttgaagacacaagcaaagcaagcaagggctctgtttgactgtagtctgaagtgtgtgatctgatcagtttggcaccgcaccgttactctgatcgaagtattcagaggtcccccagggagggtatagggtgtacccccactgctactgttctgtaacttctgttcatatatcatggggggccaagagagatatgatggggggttgctttggctgcattaatgttttgttagtgtccatacgccgctatatcacacaactagtgagatttattatgggggattatccattttactctcttgaaatcgtatggtggtctaaaatatacttagaaattataaaaccagatatgatacgccaactattagtataagatgatttaccaccttcgagctattttacggtgattgtactacacgtggatgccacctattgacctatacaatagatccacattggttgcataagagagagggtccacctgtcattgctacttacatcttctttctgctttgtgtcccctctttccctcttccccatggtgtggcctccgtcgctgagccgaagccgatagaggtgaagctttagatcggcgttggtaagagagctcgatgaggcttcaatggcggtgttggtgagaggcaggccttggcaaggcttcaaggacggcgccaacaagaggcaaagctccataaggcttcaagggtaacggatctcaccagaactcaacgggttcgctctccatgggatctcgtcagactgccaccaagctccgccttcctcgcgagccccgagctttgttgcctcgacatctaggagctctgcctaggctatgtcgaagccaatgagatctaaataagatggaggttggtggcagaagaggtggtctattcggaagcaaaggaggcggtcaacgtcgactgagcggtagtgagaagggttgggggcaaggaggagctgagcatcgataaagtgagagaggtttcacctaccgaggctagttgcacgtggaggagcttgagccctgcgtccgctgcgagcaccttgctccttctccaatccatgtcaagggagcggagggagggagggagctggggatggagggacagaaagtagtagtggtcggggaaggagggatataactcacaggctgcaacttcggctcctttgttcatcgagaagggaagggcagagagaggaggaggaggaggaagaagaagaggaggaggaagaggaaaaggagctccttcaccggcgtacggtgtggctgctcacccttgcaccttcccgcaccatcacagggggtcgatctatggagagtccatctgccatcactcggagctcctcgccaccctgaccatgtcgagttcgtgtattacagcgaatgtttcataataagttcatatatagaattatacccacctaaataaatttgtgtacaacaaatgtaatatactctttattccttccattttatattataagacgatttaactttaatttaagtcacttcgtgaagtttgacaaagtttataaaaaacattataatattttaaacataaaataatcatactatcaaaatctatttaatgttaaatttaattaaactaatttgatattaagatgttaattttttacaaagatcaaacttaaaaaggtttgaaaaaaatcaaagcgttttataatacaaaacggagtgttagttttgttgtatagatcttttgaaacaacgcctcaggataggccggacgcagattagcccattgaccctacccatgcctgctactgctagacgagataaacaagcctcgcatcaagctttgccgcggcgttcgcacggtgtatggtatgtgggcccttggcaacaacgccaccacgccattcccagccatcgctggcttccagctctcgccgacttttcacgaaggaaacaactcggtaatctcctccgttaaccttattcaaaacatttgatcatttattttattaaaaaatataaatatcatttattttgttatgatttgttttatcaataaaaaactatttatacttttatatatttatataagatgaatgggccaaagttatccgaaaagtcaacagtgtcatgcatgcattttagatggtgattgtattttcgaaaagtaacacataagaacacaacaactgatccagaatcagaaaaatcttttgaagttgaactggcgacaggtgcagcagttacagaattcagggaaaatcaacgaatcgaatcgagggggccaacgaatggcaggaaagttttccttacggcgctaatcaccgtcagagttctcggtccccctcaccaataacgaaagaatcaaccaagacaacaaaagaatcaacggctgatcttcttcttcttcttcttcttcagtgggcgagcttctttgctctcccggtggaaggctgggcgtcgtccttggcaccgggcccctcgggcttgcgagcccacgccggggcccggtcgggctcgtagcggtagtcgtagaacagctcctcgcccgcgctgatccgctctttggcgaagatccccaccctgtgatcgcctgctaccatgatgaccttggcgtagcagtttggatcaggggaatggttggcgaacttcagcttgtcgcccattctgtaggcatcaagaacgtactgcattcatcgagagggtaaagtgagtgagtgagcatccggtactggcgaaaacagcgaaaacactgcagcggatcataaatcgcgcgatattgaacaacagtgggttggggatgtaaacaactcggttcacgcaaaaggatgacattaggctagtcaaatcagtacagtatgcaatcctgaatgcttgcagaccgtaatttgcggggtgtctttgcactcacctcattgttcaagttgaaaaggaacgatgaattctcacggtcatatatctttccacgcttgtcagcttctttatgggagataagctccccagtgtactcgccaagatactcgtgcttcccaacactattctgaagatttaggaaaaggactagttagatgagggtacgtcctatgagggaggaaaagggtcaatagagaaatcttaccttgaggaaagctccccagccagaaacatcagatctcccaagtaagacctgaagagtgcacatagcaagtcaatactatttacagatatttagagatggaataggacctgtaatagaaaatgaagtaacaccccctggtgtttcataaattcaccaacataatcgatagatactttatgcaattattttcctgctaatgggaagttttttggttcatagttcattgcctgttttggaatatagttactctaactagtttctttggtattaaacttaagatcttttgtatttagacaactggaatttgaactcacgtgaaaaatattaaaaaaaaagaataaaactattgagaagtactgctgggtaattaacttagacctcaagcctcctcacacaaaaatatcaaagcatcgaataaaggcaaatggaagggccaagcaggcataaaaaatcgataggcttgacgaaattataaccaaggtgcaatagcatgaataaatcaaagtgcaaaaggtttaccctttgttgctgtttaagcagcagtttcatgttccggcattcataattatcacctctttggttagggactcccaatgtaccatcaccgcacctgcacaatagaaagtacaggtagaaaaatagaagttcaatgtactggcgctttgttctagaaaaattagggatgaagaaacagtaattgaaattgaataacagactatttcaacaatgaataacagaaagcatatttaaggttccatggagtgaaaaaggatcatgattggatttacacactggccggataatatactcatctttggtgtttgcctaacaacttacagtatctaaaatttcatttcctaccattagaagctcgttcataacaaattcaaattaaactcccccatcattgatacatttttcatggattaactcctggtaaacactcctataaaactcagatattgttataaataatttagatatagaatatcaattgtcaatgtgctggcacacactatcaagtatgctagcaaatggtatgagaaggaaatgtcaaattattattattgcaccatttttttaattgtggaatgtagctattgcctattgggactgttgggcaagcaattgatatgattatattaattaaattcaattctaccattaagatattttactgcagaactccgtatcttcagatactggaatatacatatgcaagattcttcctgcacttaaggataaatccatcatccatcaaaattccatccttcaagtgcaggcataggtggtaatttctcaactttcaaggtagatgtaaggttggagaagtgcaaagaatgaaaagcacattatagttggtgcctttctctaagatatacaaatgtgcattaactagcaaaatcattcaaagggtcatcagaatttaaaatacataccctacccagcagtttctacacacatcaggatcacattccctgtcagcagcaaagcatggacactgccggctgcgacactgactctttgcgcaatggcaacctcggaagcgattcttgcacattttcgggcacctgcaacgcagaaaggattacttcaacttgcatcagcaggatgcggacagcaaacatttgcactccatgtgtttgcatcatttattccaattaaaattataaattatcaaaataagtaatagctaatagccaaaagagcacacagaacaaaagagaagcatgtgtttgattcaccatttgggtgagaaatgcggagtttacaccctcactctcccaccatcaaggttcaagtcctcttcaactagaaatttggtgcctgttttcctcttaattgaaagggtgcctagttcctcctaggttttattttcctttccttttcagtaagcagcaatgattgcaaaactaagatgtgatcatacgacataattggtcggcactaaccaaacaatattgaaattgtatacatctacacagttttgttttcataagcaacattattaatatctagaagaaaaaatgttctcggagtctgcaatatgaataattgaagtagctcacccacagtatttctcacagcaggtaccatttgtgagacatggacattgcttcccacatgcagactggcaaccacaaggagtgtattgtcgacaaggctgatccttcctttctgtaatccttttccttataaaatggtagcctgcagttttccaggtgtacttcaaacggcggacccttcctcgccttctcacaaatcttgatcttgtccgtaattcattaccctgggagttcaagcattaaagtaagatgaaaccttgggaaaatacaagtaaatgagctttatgatgaatcctaccttcatatatcctttaacaagagaatcaacaccactaagagctccagatgcactgctgttttcaatgtaattcatatactgaaaaacatctgtgcatgttttcatcccacccagaaggttccgagcaattaaacaacttcaacataggaaaaacaagggctcagtatgactattcaaattagggaaaacaaggtattctactcattatagaaaggataaagaacatttccaatatgcttgcaagacatccaaagaaaacaggaatgagtttttaaggcatttgaaatgaacatacatcagaatttcttgtacatgaaacgctataactaacacaactagatactaaatgatgcaaacattagaaattccagttaattccgcattccaatacgttatgcatgacaaattgtagattgtatcttcatgttacagcttttacttgaaatgtagtagtataagaatatagtttcggggatgtctaattatgatgcaagagcatttgctttaaatatagacatttgtgttgaatacttttagtatacagatatattaaaagaaagcatagtcagtttcttgtgctgaactgaaaggttaatccctccaccccaaaatataaggtgtgcacgcattttaaaattcaaattttacaaatcttgactcacaactagtctgacaatatataggtttagtgatataaaaatggtattgtcagattcatatttgaatgtactttcatatgatgttggttccactatagagtatagacagtatacttgtgagaaattgacaattaaaagtcaaagcacgccttatattttgggacggagggattagacacattaacgtttactctgtcctgaacagatacagcagttagttgtgcaatagtatacaaatattaagatgaagtagaaggtagtgaaataattcatatgaagctgatcatttcaagggaccaacctgttctttccaaaaatctctaatcctttcaatagaagcccttgctcaatcactttccaggacctgccatgagcttcttgcctgcatatactctcatcaacacattcctctttccttgaactatcacaaccatctgttgctgaatgttcattatttgtatcctccattgaatcactctgagcatccacaaaagatgagttattctccatttgaagtgtgcccttctttctaaaactccttgtgcttggagaattacactgtgaggatacaacagaatccttaattccactcctagtatcagatctaagcttcatatccctaggccaatggcatccattaacaatagaattagagtccggtgacatttcctgttgcccctttttcacactcattagaattctctcagcaattcttctgttagtacttttcttgattccaccttttgcgccaagcttattttttgagaggccaggagagtgttgcggggatttattgcttaacagttgtacttcagactcactgctttctgaggaaacccttgcagttgaagaactttcactttgttgagattttgttttctgcccactagaaccaagctttttcttatttgaccctatctgatcctttagattgtccgatgttggctcctcaacatcaacaagcaaatgagaatcaatctccatgatagcatctggtttagagacctgacaaaaagattataaatgaggtaaagatcagcaaaacggcatatgcttatgtttcggatatctaaatcatcataaaagaagagctgcttttccacagtcatatgcctataaaatacagaccagtttgtaacagtgaataccacatggtgtaccctcatccgagctgcacaatggtgcctgcttttcagtctatacgaaaaggacactaattagaacaacacacaagtttaggaaataactcattggtttgaaaattaccggaaatactaaatcttgagaacacccatgtagcttgcaatcaaaaaccttccaacatcaaaatgagcagaatgtttcatcagtaaaccagagatattatgtaaaacacacatgacaattaacagaaaacgtaccaaacatcggcgacaaaagagattgtcaaaggaatccaatgctgcatccagatctttatcaccgtacacgtcttccattttgacattaagttcagacactttcttggaagaaccctcaggtttctccccttgtaggatctcatacctggcctggaaaatagacacgtaatttaatttttcagaaatgaaacaataagttggaagaggaaaatcccaaatggatcaaatgcaaatgtgacgtgagattgaataaatgttgtatgaacctttatatcatcaggagccctttcgatatctcgagctagagtttcaagcacagcatcagacatgccacattcttgaatggtcatcctggcaatcattgcacaaaatcacccttaagtggaagaattccatacaggagaaaccaaattattgtgatctatgatgtttaaggtctaaattaatccacaaacaactcagattaatgctgtaaccatacttttcttgcttgtgcaagggttgcacaaaacaaaaccaggtcaaatatgcagtgtgaccagctcaaggttttcccctggaacaatgtagataaaactggtaatgaccatttcatttaatgatataagacatatgccccaaaaccaaaccctttttcttacaagtttttaataatgtagttttactaaataatctcttgggaatatttcataccaaatgttacttgaccagtatatttaatatcatttctctattgcttctgtactatgttatattgtgacttcaaaaagagaatattactattttttattctttaatgaaattacactactaggcaaagtcctggtagttttcccagtcaaaagaaaaacagagaatatgacaaaatgcttacagaagaaagcatttctccatgaaactattactacagagtcatcagatctgttattctatggactgagcccaagctccaggtgctatggtaactgcacctgtatcttggtcccatgagcctgtaacggtcaaacaagttgagcatccttagtgaatgttcaaggcaaaagaaaacaaatgcatgtccaaagcatatttaccgaattatgcaatcttcagaatccttgaactcctttttctcttcctcgtcctcaacagcttcatcttcactatcactgcaaattaaagcttcgccacagtttgtatcatagtaaatccttcgacgaccaagtacagattggtcttcttgcatccgctggttcctgcacgaaagattgtaaaatcttatatttcaacaaaccttaagatgccctacctctccaaactaaaagtatgctggattgtaactgtgaccatgcatgttttgcattacttatttagaaaaatagaagtttgtcatatgagatatactgttaaattcatatcaacaaacaattcatcaaaaacatgtttcagtctgattttttgcttgctgctccacaaaatcacgcaatagcaaagagaacactaagaagcataaagcggatgaaacagcaaaagcaaaagaaacactgcagcaggcaaagccaatggttctggcacaatagctttgctaccaaagccaagaagatgaattcaaggcagtcaatgtggcatttgctgctcttgttttaacacacactcccagcctgcaagtctgcaactgcatgtgattaagagagaggtggggcacgtagcaaggggccgcataaggacttgttccatttttatactataccatttcccaagcttatagtaagaacgaaaggcaatatctccattacacatttacacatgaagagaaaaaaaatcaccagagacataaagcattaggtcggaaaaactatgtttgactgaatagattgttgcacaaaaaactaaagaccacaaatgagcgtgtgtttactgtttagcaagagaaatgaaatagtattgctatgttgttgctaatggataataaagtgtatacgctataactttccatgataactatgtaatttaagcagggatcttagggatgtcaagaaaatgcacctgtccaaaaatatccaagttgtatatggagggagtgttgccacttctggtagtctaatcggacggacagaattcctcgcggatagatttccacccacaataacagtcgatgaacactcatcttggcaattggcaccttcactttcatcaggagatgactcacgactattcacagcacacagggcatcttctttcctctttgtgagcaaattcgagactaaatctgtactgttggatgtactagtttgcctattttttgacaaattgtgagagtgcagtgtaatcgggctaagcttaatgctattctcctctacccttttctggaaaaaaagatcacggggaacaaaactaatcagctggtaaataaagaaaatacaagaaaatgaccgagatttgcagctccaaacaatcaaatcaaatcaaatcacctggatgtaaacaaagcggtccgatgtgattttcttcttcagcgaatcaataacacatagaacatagcccgattcactgctcccttcctcgcaaaacatcggctgcggggacagaacaagctaaatttcatcacaaccacaagcatacacagattcaaatttcatccgagcagtaaaaaaaggcaaaggagaaagaacccgcctcatttcgggaatcgccagccatcaggggcgggagaaggcggcggccgccgcggccgcgacgccgcttcgggaggcggtcggcgtgctctcggaggagagacgcgccgcggagaaagagtcagaaatggcggcggcggcggccgggggagagtcgggggaatgcaggagtcggggagccgagatagcgggcggtgcggggaggagggcggaaggccggagccccgtcacggcgggcggcggggccgccggagacctggtcgccggcgaggccgcggcggcgactcgtcgtcgcggcgtgggtggaggaaagggaagggggggatggggactggagacgaaggggttatatatggctggaacgtgttcacactgtacccggcccattcccgaggtaccaaaatatgggcctaagtttgggttttctgcgccaaaatatgagacataccaattgattggaataagttcatttgacgtccttaactttacaccgaatccgatttttgtccttaacccaaaaagatacaaccgatccctgaactgtcaaaaccggtgcaaacaagttccctcggcgggttagaaggtaattttgattgacgtggcgccacgtggtaggttggtcgtcatcccacgtggcgtttacgtgacaatttgatcccggaaaaataataaaaatcatagccccacatgtcagttaaaaaataattaaaaatgatgaggcacacatggaccccacatgtcaacctcacctcccttcttccctctcccttctctctctgcttcttcatcctcacttctctcttctaccctcccgcctctcttcatcttctcttcccgcaggtgagcgaggtgggcagtaggaggcgaccttgcgcgccaccaccgcactccaccttcgagccgctgccttcctctccccgccctcaccgccaccggtacctcaccttccaggctcctccctcgctggcccacctcctgcatcctcgtccccctgcgccgcctctgctcctcctccgtcccaccccaacggcggtggggacgacatgatgcgcggcgcggcgacaatccaccgtgaggtccagcagcggcggctcgttcgggttccacacggcggtggacgcggcgcagcatgccatcgccaccgggcacgtggagaccgagggcgcagtgaacggcgtcggcctcaccaagctcatgggccggagagccggccgcattgcgctccacgccacgctcatcagccgcgacgtcgactgttggtggcggatgcagcgcctggccaccatgggcaattgcccgggctccatgcgtacaacaccacaatgctccaatgcatatgcagcatattactcgttaatcatatagttaatcactttgtctcgtaggttataatggagattaattagatgaataaatagaaaacgaggaagcaacgaccaaaccatcaaactgtagctataaagaccaaacaatacaacttactcgcacctatgttcaagataatctaacgaaagtcaaaagacctctagctcataattcgattggacatgtaggttatattcgtactggtttctcatgtggaaccatagaaggaattcaatataaggaaatgagacgactctttcttgaacaatttcataagcagatcttcccctccacaccaatcacgagtttttttttattcctctcgtatatcgtcgtcacgcccttaatgataggttttgaaaaagtggttattttggccgattaatcttccaatatgctagttttaaaaactctcgttctttacacttcttcttggctgcttggcctgtagtagggatttggttcactgctttaggtattagtactatggctttcaatctaaaatatctgagaaagcaaagaaaaaaaaagagagacaggtggtttatttatcaccaaatagagatgagtattatatgatagcagcaggaaattctttgatggatcaatttctgtaggtgggtctcaactcggatcgagacattcggatttgccgatgaagagtactgccttggaggggtaggggttgtaggggaagaaccaaccttttcgggttacgggaagtcctatcgagcgactggattaaagcaagaagaaaaaagtcaaaacagcatccgttcctcgcgtatagagctagaaattcttgaattagatccatcctaacattggatgtcctttcttccattaggaagagcctcagccgcttcaagcaagtcatctcaagtttgaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggagtcaactgagcatctcagcggtgggattgaatacccggatcgaatcagagttcacgccgttcgtgcgggaacgtccactttgcattttaaagaaagggggctatggatggcgagagaagccctcatacccactcttctctcccctccccataccctgttgttagggagagttagcggtgtttacaccggtgtcacgtgtacggggatacgtgtattgagaaaaaagacccagaaggcctgttttcgaagctagagcataggtttagtgaggtttaggtactttgaccgaagtaccagtaccgaagaaagcaaaagctttcgagcgagcagcaactccaatgtttggtaaagggaatgaccctagatactcagtggtcgcaacaacaacaaggcctttggtcatatcatatctcggcgcctcccttgacatgttataatgcatctataatttaaagattagtgtcccaaaccctggtccacctgaattccattgtgtgatcagaatatgcaaacttgagaagtggaaccgctaccaatcccagctctggtttctgaagtgccagcagcataaaactgtgaacaggttggatgtgccatctagccgattgcctattgcatttcgcggtaacaagaaggtgctgttatgaggtatatcaagattcagtcttcgattcatatttcgtcgaccaatccttcctaattcacatttttgttgaaaaaatttttcatggctcgatagagaatttgataagccaatgatttttttccgtctttcataatacggttaaccaccatgttaactaatcgattaaaaatctacgaataaccaacttagtatgtagcagtctattctcttcgctttccgtatcatataaaagatcgttattcccattctcccgatgcagaccagggccgtacaagaagaaaagaggacatccattcgttgccggaatttgctcccaattctagtccggcttcaactccaaacagccgttccgtgccacggggcacgaccatggaagtaatgaaaaagaagaagttctgtagttggaccatccgtcgtatctgctcgccctcttcttcattcatccaattaggtcagaatggatccagggtgcggcggttaggcatccttagacgaaagagtggtctttcaggattggtcgttgtgtgtcaccacctcccacctatcctacacattcgatcaaggttgtcactgcgaagcctctacttgtggtggtatagtgctgcttttagtgatttggagggtgcctcccgtgggcatgcctgctacgctgaagaagtaactaagctatacaaaaagaattcgaaaaggtatgcaagaaagcctccaaatgcaaaatccgccttcccactgacatctggcttatccctttgatccaagactgtgatctattgattcaaccttgaccccaggggtctcctctccccaactacactaggctcaaggtggaataacgaaaggagggtgcgtgcaaaaccgagcccccccccccatgtaaaaaacccatggaagaatgtctttggtgacgattcttcgggggaagcttcgaaaacatgccttctgggccttttttcttaatacacgtatccccgtacacatgacaccggtgtaaacaccgctaactcttcctaacaacaggactaacccttttaacaacccgatcaacgggggaaagaagagtgggaacgtgggcttctttcacagtgcgtacctctctttctcttctttctcgctctgttctggaaactaactacttggataagctgctctttcgaaaagagctctaacatcagcagctgggtcccaaactcataacacataacatagcagatttctttgatttctagtgccccaatgcgccgccataagggaggaaagaaagctcaagagcagagcggtttggtaaggccatcagcctattgatcatgttggggtggcccctctctgataaggttttaaagttttcaaaacgaaaatcaaatgatccgaaaatcgtataaaaatgtgtggttccgaatgcgctaacacgcgccgactgattcacggaaggccccccagaagaagtactcgtcgtgtccatcagtacatccaccagtgtatttgtggtgtattccgaaggaacgcttcaactgcagagccctgaatgcgtcagtgaggttccctctatgagagaaagagaggttgctaatcttggatcagacggcgtgttggtattattgataaggcttggattagcaaattagcaccgcttgagtttaggtattcgaaatagcgaaatacataaattatctatctcaagtacgtctccaacttatcttgagccatctgattacctcacaactacttccatactttgtttatccctattggcccgctctggctaacccaaaacccgctcataatagcggaaagagggccgcgcccggttccaaggacaagcataagctgtcaccactaggataaatcaaattgaatcctaggctgtttcgatagacaaaagaaaatagaaaaaagtagtgagtgagaaagaaataagtagcggcgcacctaccctgcatagattaggcatacaggctttccaacccactttagtagaggggcgtactatttgtttacacccattagtatgtaaggggtatcatcccagtaagctcgggtctttcataggaagggagctggcccccgctcccttccgtccatcagtgatttattcaaaacctgaggcagttgcttgtttggtcgttagatcagagggcgctcatcccttggtcggtccctgaaaatgagataacataggcttttgatatctgctctgtcaacaagccctggttcaatccctgcttcttccgggctcaacccgttgcttgttggggaggaagatctaaaagtatggggcaaaggatcaagcgctttgactttgctttgtcccccgggaggcagcaatccaagctctttttgaatcggatattggataggctaagctaggtgtaacctgctttctctacggttttgctgaacttgtcaagcccggggggcctttagggatttttggagaatgatagattctaggataacactttccaaggttgaaagggatggcatgggttaagtatcccttgccaactcttgaccagagatacaaagcacctgcagctgaggcatatctcagtagattgcaggaagagaaagatggacttaaacactatagatcttcgtgtgatccgctttccccagaccagccaatagaagaaatagaaaagaaaggagttcgatcctcaactatttctcgcgatatcttcttatgaagttttgttagggcatctataaccgcctccggtttaggtggcagcccggcaagtagacatccacaggaattaacttatcgacatttctctcttttctcttcctctggtcagaaaaaaaagatttataggaccggatgcataacaagaaaagaaagaatagtagtggtgcctgcgcgcaaacaatcttagaactgagctcttgacattgtcatcgctagctataaaaatatatcgaatgaagtattacgatcaaaatgcaactccagctccagctacaggaggggtggagctggagctcagccaaacagtttcagctccaccaaaactgggagtggagttgggtggagctctctcacaaaatgtactagagttgtggagctgggatttggcaactccacaactccactctagactcaacttctggagttatatttaggagttggagctgtaccaaacaggccctagctttaaaatcaaaattattagcgataatattattcttgctcagactcaaaaaaaaaatctagatccgccgcctcatcccggtggaggacttctacctccacgtcgctggcggcctattcgacttcctctaccaccacatcaagaagaacggccacgcccgtctgccatcgggaagaagatgaagagaggggagagagaaaaagagagtgaggatgaggaaggagagagaggggggagagggaagaggggaggtgaggctgatatgtggggcccatgtgggccccactatttttaattatttttttgtgtgtagctgacatgtggggccatggtttttattatttttttgggatcgaattgccatgtaagcgccacttcaaatgtcacatgggacgacgaccaagtcaaaccagccacgttggcaccacgtcaaccaaaaccgtcattcaaaccaccgagggacctcttttgcaccaattttgacagctcaaggaccggttgtatctggtttttgggttcaaagacgaaaatgggattcggtgtaaagttaagctcaaatgaactttttcccgattgattcacaactttaatggtagtagagcttggattaagctaacttgtggtcaaaccaatggtacctaaccaaatgtgttgatagtgctaatactttagattgaaaataaagtacttggtagtggtggagccaggattttgatatgaaaggggcctaagagttttagaggttatttgcctaattaatttagtggttatgggtgaaaaaagttgtgggagggggctaggccactcgccacccgcccctgtatctattgttggtgcttggttcaatgccagatgatttctgagctggatggattggtgttaccaaaatattgataagaatcttgaaagggtgtttacttttgctaccttatgaatgtcttggcattaccattttggtatgttagcaatctgaaccaaccattcatactgtaagggttcttgcgaaatgaatttatgaattttgtaaaatatatggtatgaaaaggtttatgtgtaaagtaccatggtcgcaaagtttcacctcgttatcgcctcctccaaggagtatagtatccttccctaactcttcatgtgtaaagaagttttgcccgctaaccagggacggatccagaataagatttaaggggggattcatctccttcttccttctgtagttcccatactcttcattttcttcttattcttcccctttcatctcctcttctatcaatggtgatctagcggggtagggggactcgagtccactttgactcccttaactagtgaccgaaactgatttgtattcctgaaccacaattttcagatatctcgatcctcgaactattgaaaccggtgcaatttaactcccttggtggttttggacggtggttttgctgacgtaatttttttgtgtgtgaatgacaaatgggtcctgtcacatcaacaccacatgggatgaagaccaggtcaacataaaaaaattgtgtcccataattctaattctaatgctacataagtgccacgtgggatgaaaactaggtcaacaccgccacatcctccacacaatttttttttgtaggaatgacaaatgggtcccataattctaatgccacataagcgttacgtcaatgccacgtgggatgaagacatggtcaacaccgacacatcagcaaaaccgtcatgagagtcaaattgcactggttttaatagttcggggatcgagatatccggtattatggttgagagatacgaataagattcggccactggttaagggagtcaaagtggacttactaaagaaagactggccacgtgcaaccaaaaccaaaccaaaaggaataagtttattttatctccatcatcttttcccttggtcgaatcgcatccctcaaccgaaaaactagtataatgtatccgccagctagttcgcttgaggacatattatgaagactcccgtgtcgcttgggaggtgaccgttgctgaggcccgctccccctacgcgcacaccaccttgccaccgctggcggtgccgccggcggcgcctccctcccatcacgacctccctccatcctcaccttcttcctttctctctttccctttccagttccaaaactctttttttcggcaactcgtctttcgaccctgttgcagccaacggcaatgacaatcggccgtggtggtgggcggccgataaatttgcttcctaccacgcccctcctcccctttggtcccgtcgaagttggagcctgtcaatagtttgttgctttcgccctatatcaaatacaataggttcctcaactgacaaaatcggtgctaataaggtcccaaggtggtttcggtcgatatgacatctacatggctagtttgacttgatccttgtcatacgtggcgacgacatggcactggaagcaaaatgtaaaaattaaaattaaaacaaaaattgtggaacccacatgtcatcgagtgtttggttaaaaataaaagaatgacagtgggacccatggccacccctctctttcccctcttctctcccctctttctctctccccctttccttgtcttcgtcaccgtagagctaggacagcgcctgcggctgccactgcgagcgaggagagaacgttgacggcgagaagtaagctcgcggcgccggagactcggtcgcggggctggtcgaagggagcggcgaggaaggtgacactaaggcccgctcgtcatggtcggcaagccgcaagcacggcatgcgggcgacagaccaaggaaggcaatgatgagagaggtggaccacgaactggcacaacgagcggcggtggtggagccggtcaaggtgagcggtgatggtgttgcaggcgtcgagcagcgtgacccctcttcccctccgccgtagcaaccttccctgccgccgctgtagctagggctggatccgctagagagtgcactgccgctaggcatggtgacgtcaatgccctttgtgtggccatcgttgctagatccgatagagaactcgacaaccctccttcttcgcacgtactcactggcctcctaacctcctccctctctgcgcactcgtcggcctcatcaccgcctccctctccgtgcgcgcttgctggcctgcccgcctgctcgtcggcctccccgcgtcctccctctcctctcgctcggaccagccgctccacccccgacggtcgccgcaccccgctccttttcccgccctgtcactaaagaaggagatgaagcaggctcagcgggtgattggcaatacaacatgcaaagaggtcgctcctccttgaagcagcggtcgtcgacattggagccccttcctcgccagtcgccaacagcagccaccgacggccaccaccagtccaccacagccgtgcgcggggcgagagaggttggggacatgcgcatctagcgttcatccgctgcttgggttagctcctccaatctatcctccattgctgtggggaaggaggaggggaagaggggagaaggagaagggaggagatagagaagagggaggatgaggtggaggaagtggacccattgacatggatcccactattttttaatcttattgtttcattgatatatgggcccacatattttgttttaattttttaattgttaaaatttgcttcatgtgccacgtcaatggctcgttagatggactgagtcaaattagccacgtaggtgttatgttagctaaaaccactgtccaaatcgctttgatacctatattgcactagttttgtaagttgggggattggttgtgacatatttttcagttcaaggatgaagagaaggaccgacaataaacttattccaatagaaaatggaaaaagacgacccatctgcatccaaaacaaaagtaaggaataaagggacccaaaatgatcttattgctatagaaaaaaatggaaaaagacgacccatctgcatccaaaacgaaagtaggaaaaataaaaatatcagagccaggtttcgatcctgggacctgtgggttatgggcccaccacgcttccgctgcgccactctgatggctgtgatgttatttcaattcttagtattaagtatatgaccagcacgcgtccagtaaaagaagttgcttcaacctatcaaataaatacatttttaaaatttacaataattaaatttaataaattatgtgctaatagcattttttttgttttccatattctacctttatgttcaattcattggaaaagaacgtcaccattttttctccaggataaacactccaacagaactaggaaatttttagtaaacttatgcaatacactttcataatatgaaattagtgtttataagtatttttgtaaaatatatactccctccctgataagttctaaataaaaaaatcatacacataaaacacacacacacaaatcacaaatcgactatataggacttcctccgtttcatactataagacgttttgactttttttcctagtcaaacttatttaagtttgactaaatttatagaaaaatctagtagcatttttaacacaaaacaaacttattatcaaactatattcaatgctagatttagtttaactaatttgataattgagatgttgctaattttttagtaaattgcatcgccgatacacgaacttggtaggtgggtgcaatctagtacacgaacttgtaaaatgctcgttttggtgcataaacttgtctggtgcgtgcggaggaaggcgaaaaggaaataacatggctaatcttactgacttaggggctcatcagaatactatgtaaacatatatctaataaggttgctattagataaacacatcttcaataaaaatagaatgggatatggtgatcgtagaaaatgataaaaaaaaaccgagcaatgatataagggttataaatatatgaaattcatcacttccgtgatgaaggataaagtatagatcaaatttataaatattacatgtcttatgcatactcattacacgtatgcacatcatatcctaatcaacaccagctttgcaaaattaacattgtgaagctattttagtcctcattcgcacaaactagacaagttcgtgtaccaaaacgagtattttacaagtttatgtattaaattgtacccacctattaagtttgtgtactaccaatgcaatttactcctaattttttctataaacttagtcaaactttactatagttgcaataaaagaattatctcctttattatattgtgttcgtagtttatatactagttcactagttatgtgttccagaaatagattatacttcattaatacaaattcacttgattagactagtcgatttacgttacgataacgatctaatgatcttaatgggctgcactagttctaacttgttcatccgaagggtttcaaaggggaattagtgatattatttattaacataagtatgatgcttaggttagttaaatgtagttggatgcgggtatgtcccacagaaaatgagataggcggtaggtggtgacagccctgtctgtcctttatactcctccaagtctggtatgatgaaagagttcgtaaaatgtcataaccatactggcggaccaacagggagtggtctctcggtagtatctgggtatatagaactaagtcctagcattgtaaacatgtatgtgctaagtgtacagtaaacattagcaatatagaagaatatatgaatcttagctttctataattcttctccactgcctagtgtaccattattagatgaatcttcgtcgtcttccctatagaaatataaatacgatacatttggaatactcctggatgaaatgttacagcagtattcatgcgcttacgaatttatatgtgattgtaagaaataccaacattaagtttgcgaaaggaaagggcaatgagattggagcagtgataggaagggcccccactccaccactgccaccattgtgggtcctgagctccacctctgtcggcaccgagctatgctgtcgtccaacttatctttctctaggagagaggggagagagaagaaggtgatcggacgggcaaaagagatatttcaaattgttacagtggaaaaaaaattaaatacgtctagaagaatgacatttgaagagtggctatccgtaagagtggcaaactgttaaatttgaggctcatggaattaggtttaggggttagagctctaggaaacaggtcaaaaagaacataaaatttccctagtactttgcatttcaggacgtagccgcattcctcgtaagggtgaaaatggtcacggaatttccccgtggatcgagagccatttctatataaaagttatcatttccatctctcatcatttttatataaagtggtcacggagtataaatttaattttttttatttttctttctgcttagtattggtaccttttgataccgatgagaactccctccgtcctataaaattataaaattagatatacctccatctaaattcattgtattagaatatatcgtatccagttctaaatattttttaatgacggagggagtagtttaaatgatcgtcgtttcatgctactgatcccgacgttttcgaccgtttttcacccctagcgggcggcgtccataacgatgtgaaatatcgccgccgatccgacgtgtggtgcggcaatgcggtcaaattgcggccggcggacagtccgctcgccggcggcttggtgttcgaggtggctcacgcgcgtctccgctctccgccgcgccgctcctcgatcgcttcttcgtccgcgccggagaagaggtacgccgcagcgccccccccccc

SEQ ID NO: 8037 - DNA, 19272 bp, Oryza sativa
  unsure (1)..(19272): unsure at all n locations
ccccccccccccccccccccgcccccaacccggcccgcgccttttacatcgttggttccgaccgaggaaaagaacgaacatctcgccatctcgcgtttccgctctccctaggtattaggtttccgccgctacatttttgttgcgtaagggttaggttcaaattcaaggtggagtggagaatttctttttttaatctttattatgtacagtaagggcgccccaatttagaacatcgtggaaaatttggttaggaaacccgtatggaaagagcgagtagtatttcttttgctgaaaaattcacgcgtttcgaacaagtgtaaggagaacacctgaaattagtgtgtgttctagtatttgaatatggggggactggattgggatttagacatttagttactactctgttccttgctgaatccaatcccctttaccaaacaaacaagtgtctccaccggtcgaatcctcatttctcatcctcgcaaaagaaaagaaaaccttcattttcttatccaaatatctaccgagatactgtgtccttgttcgtttgatcctatcaatttgggcatgttgtggtacggatagcaatggacaactgggcatgggcaaaggttaagtacaaacgccgtgacttgattctttcccctcccccagaaaatgcaatggtattatgggttgtagattgtagaattgaagaggaaattatccgattcacctctaggacaatggtgtttactgttttaccatttccctcctttatctagtattgctcaagatttacccctaaagcctttatgtgatcttttatggataatataagcctaaatttattaattcttcgattcctcgaaaaaaaaactattattcttctaaatcatttcatctgcctaattaaaaggatgtagctatattattttgttacattcagtaagtacaaaaatggattctgatgcttgattaattccacgttaatcaggtattctgatgcatcaaacaagaactgttgccagaaaaataccttcatcatacttccatgattattaaatattacttcataatatgatgatgtgctaggagctccctccatcacaatcaaactgcttgcttgctgttctgttctcagtgctgatgtggatgaaatatcaccacgagttttatctatttgcttgatagtttcagtgagaaagttcaggaatctcttctgttactagtcaactatgtctagttttatcttctgcagaactttgatttgttctctctatccatactagagtggtatatgtcgtcagtttcggtcaaaatatggatctgtatctcccgtgtgctttatttcactttacttttttgacctctctttgttgatatttgaaatgaaaagttcactttccagtttccaattaccatctcttagggcttaattcctaactctgttttttgtgcaatatctaaccgatacagtcaagcttagccaaaaacgattagatgtatcctgtattcctgtatatgcggttggtgccctgagatgccttagatatttggtgaatgctccatctcaaaacaaaaggcaataagatccatgccactagttgctagtgaaagggaagaggaatgcactgagaatgagaaagagcttccttatttatgctctcttgattcacaaaataatagggaaacttttctgtgagtttgttgtacttatatcacccaaccacaatggtgtacctatcagtatcaggcaatgttcctatattccctacaactatcattcgagttactgatcaccgatagctcatggtttagtgagaagataggccgtgctggaaagatatgattctcatggttaaagcaacagtaaattctttgtcactgcttttcttttcatccagaatgatctggagggctgtaagaataatggatatttaaaagctgagtgaacaccatcaccttcacctctgctgaaattccaaccggatacaatgatagcccatcactaagatacatcattaagaaaatggcaccgagatccaagtggaatataaaagacttgaactccagttcattattatactactatgatactatctggccagtggacacacttaatcagggttccatcttttattttgtaatgaaacgagctttgttttcagtcaacataggctggttagacagcagttatatgtcatgatggaacgaaaataggaatatatatgttccaccattttggtgctacttcatagtaaacaactaaacccccaattcgtcacctaaacccctaaagcattgttgctactgtgattgttggccaaggtaccctagaattatctatatacagttatacacatactcatttcatctcatcactgctctttgcttacttcaaaaacttaaagctactgagcaagtaccaacaatatatatctgctatccggaaattacaaagcaaaactttaaaaagctaaggtacttgatcaattttaagtcgcaaacaacacactattattcataacacagattgtctagaactactcccactggatcgatgttattgctactcagtaagtccccatatatatgcctataagatagcgtctcatgagtcccatcagaaccatggaacagtaccatagctaccgtcagatagagctgcagtggagaacatctggtccacttcgatctgcacatctgatctcttggcgaaacggcccttgatccggggtcgtgcctctgcatacgcctttcttgtttcataacgtattgtcttctcaaacttcctggccttcttcttctccctgtacctgagcaccctggcctccctgtccatggagctgaagtgaagggacatctgaagcgagggacctgagaagagattgattgctccagcaggtgtcaggattctggaatttggcatatctatcaccgtgctgtctggtactatacccgcctccattgatgagaaagatatctgagatggaatcggcaaatggtcactgaaatatgcgaatcataaggagattgcaggtgtcagagaccctgcaatgatatatagatgggcttaatttaattttacatacataagaaaaacttccaatatcttttttactgtcgcaaaagtaagatattttaaatttatgcactgggataaaatatgaattacacttacacttatcctacttttcatgaggtctttcgtgtggtgattgctgtgtacataaaaggttaacaaactcacttcttttcaattagtgagttagcatggatcgtatatgcttagaaatacaggaagtagtcaactggtctgcctaaagatcaattgtgtacttttctttaaagtattttttttatcggttccatttaatcagcctaaagatcgcagcttggaagtagaaaagtatctttgttttcttgttgagatctgtttatttatcccttcattttgttagacagtagcttttgtttggagaatgtttttccactcaaaagtactagtatgaactctaaaacattgacaacgtggcatgtagtaacaactaactaacaacagtaatagatgttcattctctgaaaaaaaaatagttgcagctagtaatagatgaactcacgctgttgctgatggaatctgtgtaagcactgacgccggcggtcatggaggcggcctggtctgctcccacaactccataaccactatgctgctgctcactcagcattgtgatctgtgaaggtaccacacactcgctcccttccttctctgcaaactccttttgcatctcctgctgctgctgctgctgctcttgctgttcatgcatcccatactgccgatcttggttgttttcgatgcggttgtcgtagtacgaattgtacccgacaagatcaaagtactcatcgacttcaccaaaatacatgccgttgttgctgctgttgctgttgttgttgtcgttattgtcgttgtcgttgttgttgttattgttgttgttgttgtcggaatctttggagaggagaagccaagagtccacctcctcgtccttgtcgccgaggacggtggcggtggccaccaccgcctcagcgaggacggaggtggccgggatggtgatggccgggagcgggttcgcggagtgcacctgcacgtcgcacgccacgcacagcgcggcggcgtcggcgcggcacgcgagcgcggccggggcgcgctcgcaggcctcgcacacccgcacgcgctcgtggcgggacgccacgcggttggccgcgtgcacccgcgcgtcgcacgacgcgcacaggtacgccgcgtccgcgcggcagtacaccacgctcggcgccgccggcacccgtcgcacggccgcgcccatgggcagccgctcccctctcctcctcctcctccttcgcctccaactccaacctcctggtcgaacacgttgccaccaaaattataattcatgaacgaagtagccttgcttgtggtagtagtagctttagcttgcaccacatggacaagtctatcgatccaagctattgtgtttgtcctctctctctatgtgtcgtgtgtgtatgcgtcttctcctgttcctctacctcgcatggctcttgtggaattttgtgagtgttttttggaaagagctagggaggggaaagtcacggtgtttttgtcctggggaggttgagtgtagagtatactaatagtaagggggtgtcaagtcgaatccagcgattgacacttggcgcgatccccggnnnnnnngggggggggggcgagcggcggctgcaatgcctgtcttgtggttgcctttggatgtttgctgcttcagcgtttctcttctcaccccctgatgccaatcctcaatggaggggtcgttttcagataaagattttgtgcactttggcgggtcctatggagaattggcgcccttgagctaaatctaagtatctaacctgaactgatgtcaataccttttaagccaaagcaatcgcgcttttgcgcaaaaaagctttgcattttagtgatgagtacactgattctcttttgtcgtaatcatgttccattttaacttaggactgtccctaaagagattttacagggatcaatagaatcctcccatatgcattcctaggattgtccctaaacaattcaatggacatctcttagatggaactaagcccaaagggggagaattggaagccactgtgatgatgtacaaataaagggaaaaacaaaaaagagcagaggaaagatgctgcctctctctctttatgcacattcttttgcaaaagagaaagggagggttgggttctctgggattccaaagcatgcggttttgtgccagtcattggcactcccccttagccgttccgcctttacgaacctccggtgtgaggtagccagtgcagatacatgagaaaagttccaaagcggcctgccatgtcactaaatagtttctttgccggcctccctcatccaaaaatatctattctagtggagaagtcaaattattaccaatgtgttttttttcttctgttatatgatttctcaactgctgaaggaactattatttccttgcataccttttttttgtttgtttgcaaggcctatctatatatgacatgggtcctttatgggttatttgttgcttatcattttctttgagccatctgtttcttattatagccctgctataacgttaaatatgcctctccatagagaatctacttttttttttgcaataaatttgtaaggagaacagtccacctctgttcatctttgcttttgttgttatctagtattttggtagaatctagctacatggtttgatatatgtcttgttagtaccaagttcaatgcaaccatatatctatcgtgttgatgaattgagtttgttatgctgtggttgaattaagtgttatgaaaaacataggagtaactaacaaaaagaagtggtgctattagagcaattctcctttaacactatgccatgctacacaaattttatcaacaaacttgtactacactaaacaaacttccttggtaaattggcatattgacatcatttgtttttactgtatgttcaaaattgatcttcttacccacaagtggttctttatttactagtgaaagcacaagaaatatttttctcctgcagtcctctttattccatttgatgagtgcgtatatatacagcagttccgtagaggcagtgactggtgagcttatggcagcctatgtgactgaagagtgggccccacggcccaggaattgttgaagatggtgacaactaaagttaactcgtcaggtaaggactgtgactgagatgccatatttggctttcacacctggcatatacatcttccagaattattggcttttactatattctaaaggaagaaatgcccttgtttcttcaaacagttcgatggacacgtggagttaaatgcacaaaatgtcttcgttggaagctgacctaacaacaagaggctttgcagtaccacgagccaaaatgtaagttcttagttcgaaattgtgaggtgcagagtatggtacaacgttttgaaatgctgcagtgtgctccaccccaaccgtcgtcggcgccctagccaatggcacccactctcctccgccacccacagccctaggcgcctccctccgctgcttctggccaccgaccgcctccccatcagccaacacggtgaacccaagccacggtaagttttgggaggactcgccgcctcctccaccacctagatctggagcgccccgaccgatggctagtgtcacccacgtctctgcgaccccgaagccaccgctgccacgaccccttttgtcgcttgcgaggctcccccgtcgccgatttcaattcgaaaattgctcaaccaccgctgctcccaaaattgaagtgtgcaattaccatgccgtcgccatgacgcgacgcctactggcacgcctatgagccgagagcaaggggatggataacgtctcctctaggcgtacgatgccacatcgtgccttcaagctgcctgagccaggttatctagtcgcgtcggttccatcgcccttgccactaacacaccgccaacaagggcctgagtcccttccgcctctgctataggccacgggcgttatggcgcaacttggagatctgaaaacaaggccagtggagggcgtcgtcttcatctcgacgtcacacatcattgatggggagctacgcgaaatggaaagtacagttgttgtcacctgggcgatgcgcgccccgccgtcggtcacggcaaaggacgtcgagtgtgctattgcctatgagttcggtctatgcatcagcgagctgacggtgtcgctgcacttcccggaggctttcctcctcaagtacaagcaccgccgccattgcgaggagacggtgaagcagggcttcgctaaaggccacgggatcgaggtccacttcatccaatgttgtagcttgaaaaatgccaccggctcggccctcatgtacagagtcaagctctgtctcgacggcgtgccgatgcacctgtgggcactggacattaacattcaagagagtaattggatacgggacattgacattctccgaatcacaacggtggaacatatccaacaatttgtgcatttatggtcaatgatcagaagaatgaaccagctgaatgatgaacaagacggcgtatggttgaacctaacagcaaacaggcaatacttggcaagatcggcctacagactccaattcctcggggcggcgagatccgctttcaatcaattgatctagaaagagtgggcgctgccgaaatgtaaattcttctcttggcttatttcccagaatagagtttggacggcgaatagattagagcaaagaggatggcaaaaccagaagatctgctgtcatgaggggacttaggtacgaaagacggtgcaacaggccacggcagcaacaaccttaagaggaatagtaatatagttggttttgatttagaattttttattagatcttatctctttgagtttgttaggattacatctctgtaagagctacttaagcagattagcggcaaagcaatagaatcatgcaattgagatcaatctagtctattttcccctgccgcgttcgtgcgttgcctatcacagctccgccgcgccgacgaggtccagggccgcgtcctgccaccgccttcaaatataatcttcgacgtattcctccttccaattctctagtctgtgacatctgcccgctatgctatgtacaggatgagacagtggtccacctattggcgaaatgtagagtcacaaagaggatatgggccgagatccagagatggaccagcagtgacttacaaatgaacaaatgggacgactgccactctactgtgctttggtggaatctcgtgcttgaagcccccaataacccccatcgaccactccaaacgatggtgatcctagtttcatgggaaatatgatgcgagtgtaacgtaagaatcttccgcaataccatctcaatgatagcatcaatcttagctaagattaagaaggaagcaagagcatgggtaagagcaggagcaataaagctccatgagtttggaattttgggagatatcacctagttttgttctcttccaagtgtgtcgttgttgactagccctgtacatattgttgtataattttctccatctctatctctactatctattatattattaaaggaatggaaaaaggagcctccacgttcgctctcatggcctagaaattctcatattaatcggagaaaaagaaaaggcagagtccatatagaaatacaatttagaaatagttgaaattcggaattaaaaaaaaaggaatattagaagaggagactagagtccatatagaaatacaattaggaaataactaaaattcggaattaaaaataaggaatattagaagtagagtatagagtccatatagaaatacaattagaaaataactgaaattcggaattaaaaataaggaatattagaagtagagtatatagtccatataaaaatacaattaggaaataactagaaattttatcaatatgaaacaaagtctactcaatacatgatagaaaagttacccctaatctttcacgtacataatgagcatacatgtatgttggatttctaatagtactatttggtcaaggatgttttccgattgggtgtggaataaaaggaaaaaaaaacagatgcacagtccatggaagagtccatctggactcaagttcacttagcccaaataatcttgccgtcccgctaaagccacgtgcattaattcatcttgatatcaacacctacacgacatattactgggaaaaaaagaaataatcagagaaaaagaaaagaagagtccatgtagaaatacaatttaaaaataactgaaattcaaaattaaaaaaaagcactattaaaagaagagtccttataataacctaatacgagattaattaatattcagaataataaaataaaataaaataaaatatgaaattagcaaaaaaaggaaaaagaagagttcgagtagaaatacaatttaaaaataactaaaattcggaattaaaattaagcaatattgaaagaagagtccatataaaacccaatacaagattattaaaattcggaataaaaaataaaacaaatcaaaattaggaaaaaaacagaaaagaagagttcaagtaataatacaatttaaaattaactgaaattcagaattaagtacaagcaatattgaaataaaagtacatataaaaacccaatacgagattaattaaaattcagaataaaataaaatccaaaattagacaaattaaaaagagagttcaagtaggaatacaattttgaaaaactgaaattgaaaacaaaaataaaaaattaaaagaacccaaacgatagtagttaaaattcgaaaaataagtaaataaaatctgaaattagaaaaagaaaaataagatttcaactaggaatacaatttatatataactaaaattggtgtaaaaaaataaagactattgaaagaaaagaccatctaaaacacatgacaagattaattaagtaacaggcttataaaggagtagagtggtggcggttgatgggacatctaaaaactattaataaaataccaaatagaatcctaaagacgattaaaaggaaggacgacgggcaggtcgtgaaacaatcggtcaaggcggttcccgggacttttagaaagtaaaagaaaaaccaatgataatcatattcaatttttaaaatctcaatgacagtaaaaattagaggtaacgggcggatcgtataggagtacaatggcagcgccgtcgatggttggtgagacttctagaaagtaaaaaatgaattttttttttgaagcaaaagacggcaggagctctgccggatatattagaaggagaagcagttacagaggtcaagaaagagcagaccactaggtgacattttcagttttcattttcagagatttacatatatgatgctatcaactagagctaagcacaagcctttatgtatggcgcaaaatctgaatggcatctatatttcctttactaagaaagctacttgggtggcacttagttgcttttgatggaaaattcttcgattgcgctcaagccacacctgccaccaggttataagaagtgcccctatcagttttcttcttctccttccataagttgaatgtatgattgaggtccaccattctaaaatgtttgtatcctgtagttgatttggggtctgcatgatgtccagccagctacaaacttgggaccaaaccgtgttagtgaaactgcactcctttgccaaatggtttgcgtcctcaaaagcatctgtacataagctgcaaatccaatcgcatggccaatgtcttaaaaggaggttttcagctgtgagagttctttgatgtaaaattaaccagccaaagaaccgatgcttaggttccgcttcagctctccaaagtggcataaaatttgtgttggcaactgatcctacaaactacatttcataagcgctttttgcatagtattcaccatgattagtccacttccacgtgatactatccaaagaattggggtgtaatatgatctcatgcagcttactgcctaggtgcaccagctcattgatctcatttattgaagtgattgttcttagggaagtgatccagtgattattgtgcagctcaaaggctacgcagtttgtttcctctttcctcttttaaaaaaatgaattccaacgacagttatgttcgactttgacaatcctaatgacaataaagagtaggcggcggatgggtcatagaggagtatagtggcagcgtttgacgggatttctcaaattatataaaatgaaacccaacgagacaataaactttaaaaactataatgtccaatttttaaaggttcgagcttctaaaaagtgaaaagataaacaccaacgataatcatttttattttaaaatctcaatgataataacaaagagaggcagcaggcgagccgcagaggagtacaatgacaaagtcgctgacgttttagcggaacttctaaaaagtaaaaaaaataaacctaaacgataattatgttcgatttttaaaatatcaatgaaaagagaagaggcagtggacgaccatagaggagtataatggtagtatttgatgggacttctagaaattataaaaacaaaaccaaggataataaactctaaaaactataagatcaaaattttaaaggttccaagaagaataaatagaaacaatagtagaccgagcaagcaaataaataaggatatgacagaagtaaggggtagtagctggtgtaactttttaaactataaaattagaattacaaggatggtaaggtttggtctttcaaagtcttaagacaatgagataaatatttaataaattttaagtaaaatcatattaaaaaaatatataattttgtatgggtgctagccgcgcaattgcgcgggccacccagctagttataaaaattgaagatgtttttgccggaattttggtacgtcatcagtatttaagtcggtttttaagctcgttcgtttttggaaatacaaatccatgtttgagtcggattttaagttcgtttgcttttggaaatataaaaaggagtcgcataagaaatttctttaaaaaaactcacatgctaacttgagatggaagtcggactcctaattgtagctcatgattttataaaaaaatatccaagcgaattcccacagcgaatttcatcgtagctaatccacataacaataataagattaaaataacattcacccattgcagcgcacgggtattttttctagttaatatacaaagcaaagcttttgcgctcctttttttaaaaaaaactataggttcttaagctgcaatttctgggtccgtgactcagtgttgaaggtctgaatttctctgccaaagacagcaccaggaacgtccagaaacgattaataaaatgcatgggagaagaataatttgatgcacctgatcttctctgaacatttttccaagattggtgaacctgaagccaccaaacactgctactactgcagagagagagagagagagagcctttgacccattagtttccatatcataatactctttactttctgcttgcttactctaccaaccacatcagagttagttcatctcctccttgaccgcgtttccatcactgatcaccatggaggcctcgcctcactttgctataaagcccatgcagagtgtgagaatctacccacaacaacatctggatcatccaaagaaaggaacagctgcaacttttttggtcagaaaatggctacaggtgttctgtgctccagggaatttgctctctgcctggcttgtgtgctcctggccgtgccattgctagtggctcaggacccttcaagcctgagcttggagcactactcaaagacctgcccgaattatgagcatgtcgtccggactgagatggaatgtgctgtgcgtgcggattcccgcaatgcagctctgatgcttcgtcttcatttccatgactgtttcgttcaggttagcattcaatccattttctctcttttactttgcacagatgctaatcttgttcatctgaacttcaatgtgcgtagtgggagttgcagagttttctctgaaaaaatgtgaatatatctgttgcagggttgcgatggatcagtgctgcttgacgacactgcgaccctgattggagagaagaaggcagaacagaatgtcaactcgctgaaggggttcgagctggttgacaagatcaagcagaagctggaagctgagtgccctggaacagtttcctgtgcagacttgcttgccattgcagcgagggacgcagttgtgctggtaaacctaacgatacctatgttcagaattgtgattcataagcagtaacttatgtcagacagagtttgtcatgtgttgtgcaacacattagctcattttcgctactatcaggttcatattagacattctattcaagaaaacatgaacaggcagacatacatttcaggaataactcaatacaccatcgagaaattcaagcacccgtttcacaataactatctattacctcataaaatcattgtctccattagcatattgttttgcctgcaatcatgccagcatgtagaacttgcaagcaatcaaagaacggtgcgtattccacatcaatgttattacagaatggaaatttgtgttgcaggttggtgggccttactgggatgtcccagttggaagattggactccaagaaggcaagcctggacctagcaaacagggacattcccactgctcaacagggccttgtcaccctcattgccaagttctgggagaagggcctcgatgccactgacatggtagcccttgtcggtatgttcttcttctctcttcaatgctacaattctatcattagttcaattcaaattagcacctgccagtggccttatacatgaaaaatactttcgaaaagttgacattatatccagggtttttttttaaaggagggcaaaagctttgcctcgtatattaatagagaggaaacaaagtacacagctgtatatacagggctagtctaaaaaaacgacatgcccgcaacagaaaagagctaagtgatatccagggtgaaatttgatcatataccctcctatcccctccttttagattgaaatggagaattcaccctcctgacttacatgccagtgaaattagatgacccccaagtatgaatcaaatcctcaaattgtgaactgaaaccttgttgaatttgtgaatttgatcgaaggatcccacacaatcggattcgcccggtgcgccaacttccgggacaggatctacggcgactacgagatgacgaccaagtacagcccgatctcccagccctacctgagcaagctcaaggacatctgccccctggacggcggcgacgacaacatcagcgccatggacagccacaccgccgccgccttcgacaacgcctacttcgggaccctcgtcaacggcgagggcctcctcaactccgaccaggagatgtggtccagcgtcctcggctactccacggccgacaccgtcagcaagtactgggccgacgccgacgccttcttcaagcagttctccgactccatggtcaagatgggcaacatcaccaaccctgcaggtggtgaggtcaggaagaactgcagatttgtcaacacatgatcatatgcatgctcaatcaaaaggactgcacatttgttctttttaatttgatggctggcttgtcctagatagaaataagaaatgctttgatgatgaggcccttgtactggtacatataatacgcgttgttgtcattttgtcatcactctacaagtatgttacatggagatacacatgataaggtactcctggcttttgcacaaactttttatttatatacatgatgaggaatggattatgaattgtgatgaggttttagcaacatctttggttggtgcaccaactattgtgtacgttgacaagaaaaaaaaacactaatcttcaagcaagctggatagtactatatattactcctagatggttaaggttgtcatctcttctattgtttaatataaacttgtcatgttttagaaaagagtgaaatatatggtgagtcccatatcttgtgtggtagtgtcacttaggttcatgaacttaaaaattgcacgtttagatccgtaaacttggtttaatatatcaccctagtctactttgactatgtttgaccgccaatgtggcataccacgtaggcaacacttttgctctcagccccctcgacatcacaacatatcgcatatatctccttgtagctatataatgacaccagaatcccaaaaaaattctcaaatcgttcttcactcttattcttctccttgcatgtatggaaaaatgtgatcccgattagaaattgacattgctctgcgctccaaagtgatcttatccttgcgcaacgggcacttaatcaacaacgccttctttcggtgacttcaagacaaggacgagcttggagaatccatggggatgcctagcgtgcaagccgtgttgcgttgcctcccgccgcaaatccggccgcactgtgccaccgctaaccccgctacactgcgttgcctcctgccgttaatctcaccgtcgaggccgccacagccatgtgcgaaggtatatgtggaggaggctaagcacaaaagtgttgcctacgtggcatgccgcgttggcggtcaaacgtggtcgaaggacaattggactgtgggtggtacattaaaccaagttcacggacctaaacatgtaatttttaagtttatagacctaagtgacaccacctcacaagtttaaggactgtccatgtatttcgctctttagaaaaataaaaaggactactagagtatggaatgccatccggacgagacacttaatgaatctaattcccacccccatctccgcacattcgagctcccatgcatgtggaagtagcagcaattccttagctccttgtgctcgttggttacagcagcaagaagaggaggcaccggcggtacgtggctccttggtcggccaaacaacaacaacgtggtccctacctctgtgccttgatctagtacttgatagttgatatctgcatgtaccagaccaggtacttgatgctagacatctcatactcacaagtattagagctcccccttcccatgccttgacccggtaactaatatcaggcattaatttgatactcacaagtacttgttatcttatattcgatacctatgggtatcggccggtaccattgtaccaagcctggtacccatgtaacagaccctaaagctgatacctattagttatgacatacatgcatacaacactagcaagcatagcgatgggctagcaaggagcatgacagctttcagcgtcaccggtgtgataatctcaaggtttgcacaaagaactcgacgactctcctatccacttcgtcaactccgagccctccacgccaagaccggccgcctccaccttctagttggtgccccggaccttgtctccctccgcttcgccacctccctttccttctcctcgcacatgacaacaccgatctcaccaccatagttgactccttccttgccgacccactgattctgatgatccccgatgccctcgccagtctccactctctcttatgcccttaaatttgggttagtatgggagaaagatgataggggatgccaccgatgttgggaagatggttgaggagtcgagagagggaggaggaagacgccggttggtcctctagtgattagggaggaggatgatggagtggatggttggcttggtggtgaacatgaagggaatcggtgggagagaaacagatctagagataaacagatctaagtcacttaaatagtgttcacccttaatttatcatgtgcctccgaggggatcctgtcttctagattttctatataaaaggaagattgaagaagaattcagtaatacatacctgcaggagaaaaatcctcaaaagcttcaagaggtggaagcttgttactgcatctcacttacaatcagtcatatatattgtttcaactaataactaaacctacaataataacactctactattattaacatcaagtatatatggagacacggaaaagtacaagtccttgtcctctcctcttgtgtttgtacagttcatctaaaatgatataaatatatacgcatcactaattagtaattaccttagtaaaatataattattactacctccatttcaggttataaaactttctagcattgcccacattcattcatatagatgttaataaatctaggcatacatatatatctagatttattaacatatatatatgaatgtatgggtaatgctaaaaagttttataatatgaaacagggaagtatttcccaacctagctagctacattaatattcagacagaaagacagagagctccatgcaagcatgctgtacaagaagagccacacaccacagctactcgatcatggtggtgttatctggggccggagagctcgacggcctggacgaggagggaggagtcgtcggtgaggtcggagaagcagcggccgaaggcggcggcgaagtcggcggcgggcggcgccgggtctgaggtgcggtgggagtgggagagggagtcggcggcggcggtggagtggccggaggccttctcccagcggtcggcgaggccgtcgccctcgagcatgcggacgacgtcggacatgcgggggcggtgggcggggaggtactgggtgcagaggagagccacctgcaccatctcctccacctccacccggtcgtaccctccgcctaaccccttgtccaccagcacctccaccttcttctccgactgcatcttcttcacctgcattttttttctttgcatcatcgtcacagtttctctacattatgccctcaacaacacacaatcacatttggtggtgttcggattaagatgtagattttactttcatttttgttagcacatttttaaaactgttaaatggtaggtttcgtgtgaaaattatatatatattagttattttaaaatatcaaataaatctattttttaagtttgtaataactgaaacttaattaatcaggagtaaatggttttttatttcgtgtaccgtaacttcatcttttatcttcgatagaaaagcacaccgctgatcttagttttgtgattgatcggtttacatggggattattcgaatagttatgaaaaatttcagtgaatattatttttacaaatttccctataaaaatgagtaaaacaatctaaaaaaattaagtacatatattgtggtgctgaacttcactctaaaaaatgtattgaaaatgcgaggctaaaattcaatctgagagaaaaaaacaaaatcaagttgcgaatagttccgcgtttttcctagccgagattttatttttctccatgcctagattgaatttaatgttgcagcatctagaatgaaataaggtataatacttgaatagttacatttgaaagttttttaacaaaaagaacttgtgacaatcttttagcaatttcctaatatatcacacattctcaattttttttagaattttggaaagtattagtgtcatcttctaactcttaattacttcatccgttttgtattataagtcgctttaactctttttctagtcaaattttgttaagtttgattaaattaatagaaaaaattagcaacatctaaaataccaaatcaattttattaaatctaacattaaatacaatttgacaaatatatttgtgcagtgttcaaaatgctactttgtttttacataaacttgatcaaattgaagttcgacttaaaaaagatcaaatcaattcataatataaaatggagggagtaatcttaaggtgtttctaccgattagaattatactactccagattgcacaagctaatcgatcaaacgaattaacggatcgaattgaaatcagtagcacatatatttacccagtccagcatggcgcccttaaatttgaaggtgtttctaccgattagaattatactactccctccatcacataatacaagggattttaagtttttgtttgtattgtttgaccactcatcttattcaaaaaatttatgcaaatataaaaagcaaaaagttatgcttaaagtacttgggataataaagtaagtaaaaaaaatattcccaaatttattgaataagacgagtggtcaaacagtgcaa

SEQ ID NO: 8038 - DNA, 6134 bp, Oryza sativa
cccttgtattatgggacagagggagtactcgagattgcacaagctaatcaatcaatcaatcaaacgaattgacgaatgaattaataatagtataaaataatacttacccagtccagcatggcgcccttgtggttggacgacttgccgaactcgagcgccgtctggccggtgacgagctccagcagcaggatgccgaagccgaagacgtcggtccggtccgacgactgccccgtggacaggtactccggcgcgatgtggccgacggtgccccgcaccgccgtggtgacgtgcgactcccggtggtccagcagcttggccagcccgaagtcgccgacgacggcctcgcacgcctcgtccagcagcacgttggcggccttgacgtcgcggtggatgatcttggggtcgcactgctcgtgcaggtacaccaggcccctcgccgcccccaccgcgatcctcctcctcgtcccccactccaacgccggcttcgctgcatgcgattttatagtagcatgtttcattaatctgcccaggttagtttttggaaccgcgtcgtcagttcatcatcgtcatcattcatcatttggtcagagtttcagagtttcagagtgagtgagggagtgaaaggtataaggtaaagatttttggtgttggtttgtgtctaattgggtatcacactctacttcagggattgaaaccggcggtttttcgggctccgtcgtggtagcttaagttaggttagctgttggtgtggtgttgtagctgtggttttcgctcagttttccctaattaactgagcattgtaaggtttgatcctgttttctccttaaaatgggatatcttcttcttaatataaaacgttggcaacggtccgaccgttcgaaaaaaaaaaaaaagaaaccagcagtttcgctgttcaggcgccgatcaccatcatttggtcagagaaattcagagtttcagattgagggagtgattcggacagaaaggtataaaggaaagaacttttttgtgtttgtttgtgtctgattgagaatcacattctacttcagggattgaaaccggcggcttcgctgttcatgcaccgatcaccgtcatttggtcagagaattcagagtttcagagttcggacaggaaggaataaaccaaagatttttcttttttttttggttgtatctaattgagaatcacatcctagctccctcagcgaacggaagcacatcaatggcgtctgtcgtcgtcacaatttgtttgcaagttaattttgaaagggaaaccacatcaattcatcatcatcatttggtcagagattcaaagtgggtgagtgcagtcggaaaggaaggaataaagctggagttttttttgtgtctgattgggaatcacattctcctcttcttctcttctcgtcgtgatagataaatttagtctcctttttttaattatctttcagggcaatggaatccaattccgagctcttatcatgctccacttgtttctttgccggcctgaactgaaagcttcagtctttcgattctgcacctctcttttaggtccggtatgatatgaaaaatccagcaaagaacatatgctgctgctgctgttccactcagatttctgctgtcatatcgagtaaagaacattcgagctgcagcagattggaggaattctaccggactttctccgtggtcattgtctgaatcttgtactgcctctctctcaaaatgagttattttactgttcttaatgagatattgagatgtactatatttttcagtgtaaaatttggtatatatacctaggagttacggaaatttgcaataaattttggtacattttcatacctctcaaaaatggtaaaatttatctcttaaaatatagaattctagtagtagatgtgatatatcataatacttcaaatctgaacataatgtctgtttcaatttatagtattataatgtatcgcatctcgtactattttactttgttttaaaatagagagagtaaaatatagcaacttagtactgagatgagacatatcctaacatcacgaatctaaacagaaaatctgtttgaattcatattattatgatgtatctcatctcgtactggattgttatatattttaggataaaaaagagcaattcataatcttaagaagaaaaatagatacagtactagaaatattaatttacgaatttggtttggttacctttgaggcgggaggcgacgctgccgttggacatgaaggggtagactaggaggcgctcggtggcggtcatgcagaagccgtagaggcggaggaggttgcggtggagggcgaggctgatcatctccacctccgtctggaactgggcctcgccgccggccgcgttgccgtccttgagccgcttcaccgccaccagcgtcccgtcggggagctgccccctgtacacgttcccgaaccctcctttccccaggatgttcttcccgctgaacccctccgtcgccgcctgcagctccctgaagctgaacctcttcacgttccccaggttcacgttctcaatctgctgctctgcaattttttattttttttcccaaccaaaaccaacaacactagtctattaacattaatactcaaatttattagagatgtaataccccttgtctgaattcaaaattggagtgatttaatttatggtcctttggaaggtaccactagcgtgaatgttggtgggtttttattattcagatgtcatgagatatcaaattttatattaaaatgttgtgtacaccctatttgaaatacgatttttgcgtgaattattgaggcagattttttatacttatttaacacaataaatcaatattttgagaaataaacttcacaatagtttagaacaggtgaatatgacagcagaagttttttttaaaaaaaaatctaagaagcatggagcgaataatccgtaccaaaaatcttagacaaaagctgacaataatttctcttggaattaatgacgaaatgcaggttgttttggaaaaagattgaggttaccatcgacttcgaagtatggatgaaaacggagcggatacggatggataatgttcataccatattcgttttcatattttttaccggatacgaaaacgaatacggaaacaaatacggattatctcgaatacgaataagaatcgaatatgatcggacacgaatacggaaacaaatttttctcggaacacgaaaaccaactcaacttctaatagaaataaatatcaacatatataattagctcattttatataaaatgaggtataatttataaatattttttaaaatttaaataatattaatagtatggactagtgttaagagataaactactattaaaatctataaaggtatattgaaggttatagagttagaaagaaatagggtatgtctcatgggtcctgcggatatccgaatagcactgttcaccggatatccgaattattatccgtatccggcggaaacctgataccatattcgtattcgtatccgggagaaaatatccgtattcgtatccgtatccgaaatatccgagaattatccgatccgaaaggtatccgtatccgtttttgtccggagcggacggaaactatccgctccattttcatccctacttcgaagaaggccctagcgtaaaattaaggtattacaaggtaccaaaaagcttagaataaatagtcttttttttacgaaaaatcgtttttttaaagaagcgtggagcaaataatccacaataaaactctagacaaaggcctgaaaataatttctctaagaattatggatgatgaaatgcaggtaggttagctgcgagaaaagactgaggtttaccgtcgacgtcaaagaggatctgccggttgcggcggtggcgccaccagaagaggaaaccggcggcgaggaggaggaggcccatgcagccggcggtggagccgaacgcgacggcgaacttgtgccccctgtccctcgccgccggcggcagcgcgccgccccgcgagccgttcaggctgtagctcatcggcatcggcgccgtcccgtagcaatcctgctccctgttggcgtcgcagatgaggggattccccactatgctgcaagaaaaaaaaaaccatgcaattgttgatgaaccaaaaaaaattggaagattttttttcttcttgttggaagaattgatgaacttgaaactgcagccttacttgtaagttcttgccaatgattctggaatcgggccactcaggttgttatatgacaaatctctgaagaagaacacgagtgtatgcagagtgatgagacaaaccaaactgaatagtacacttaaaagaataagttaatatagctcaagaaagagcagggcaagacaaagcatctctgaataaatgacacaagtaagcaggttgagacaaaatcgaactgtttaattgcaacaacccaaaactgagatgaatttactcacaggaaaacaaggtgtgacaggttagctgatgcagaagggaatggaccagacagggtgttgttgttgagcctcctgatcaaatttccagcaacagagttaactcaaacttaattaacatggcaacaaaaaaacggagaacaaccgcaataactatgtgtagatatgatatgatactgctacatatctagatatcataatcaagaacagtgtgcttataattatctttactacaaaataaatggaacagtattcagaggctttgaacagtggagctctcgactcacaagtactggaggctctcgaggtggcccacagagctggggatttcgccatagaagctgttgctggagagatcaagcgtcttgaggttctccagcctgccaatctctgctgggattggcccggttatgttgttgttctgcaggagactgcacccaccagcacatcaaagaaaagagacactctgtttaagtacaagaactgacctgataaggctatggattgatgtgaagtagaagaagaagaaagaacactactgacacagtctcaagattggtcaggttgccgatgcttggtgagagcaggcccgagacatgctggcttggagcttccctgaaaaaacattcagagtattcagccaagcagcagagaagagaagagaggtgagattgagattgatactgtgaagcaatggaaggtgagagctaacatacaggccagtgacgaggaaatccggggagcaggtgatcatggcccagctgcaggggtcgacggagttctggtcccagctcttgagcacgccatgggggtccttgagcaggttcttgatcacaatcagagcttgcactgccaatcaaccagccaatcaatcaatcagcacacgcccaaatgcaagaaacgatcagaggaaacaagagagaggaagggatgaactgaactgaaccttaccttcgttgttgacgcccttggcggagaggagggcggcggaaggggaggaggaggagaccacgagcagcagcaggaggaggaagaagggcggctccattgctgagctcaggtaggaggagacgacgaagctagcaagcaaaccagcaactacaacctcaggtggtcaggtcaggtgagctctttcctgggagaagaggaggaagaagaagcagtggctgcgtctgcgcgtgcaatgtgtgattgtgtgtgtgcgctcgaactaacatggaacaagcgtgaggccaaggaaagcaaagcagcatgcagcttggcattggcattagcagtggcaggttgcctctcactctctctctctagagactagagtctagtctctctctctctctctctctctgtgtgtcttggccgcgcgcgcgcgcagtcacaccacacgcgggggcaaagccaaaatggcagagggccggggggatggggccgtgtcagagggggggcaaatgacacaaaaggcagagaaggggagagagatgctgatgctcggcttcgctcgcgcgcgaaatggagggatggaacaaacatgcctcctgcgatgcgatgccatgccacccgagctgagcgagacctgactgctgtagcctactggagtagcagcaaacgggatcagtaaaccatgggtgtttttcttctactcttcttttttttttctctctgtctctctctatc

SEQ ID NO: 8039 - DNA, 21681 bp, Oryza sativa
  unsure (1)..(21681): unsure at all n locations
agacggtaggagatctaccggatatattagaagaagagagttgaccctgtttataaggaaaaccgggcccaaaaatcatataactgcacagtttgctaaaggaaaaccggcaaaaccttacacagaagacacgaaaagcctgcgacaaaactacaaaccacagaagtgaccaaagaaagagcaagaccttcaaagcgaagcctccaaggaggtgaacaatgacagaagccgttgccgacgctcgcccaaaggattgggcttttcacccgaagggggagagagtccacaatgcaacacctctaaggaggaaacagcgcccgcaggcctcgatgttgccgatcctggaagaccagataaggctttcgcctaagactccctcaaaggggtagaacctcttagaaaccagagccagagtgataagtgttatcgtttcccggctcatcggctggacccaatgcagcaggtccgactccgccttaacacaaaaactctagcaacatagaagacaagcaccatgctcaaaactcggcactacgacaggttcacacagacacaggacacttgaagcaccggcgagacccaagagccctaacaacagacagactgaaccacgagcacggctgaacacttctcctcaactaccgaaaggctccacggccgggtggaggcggccaaaagaagggaggagcccaaaggagtgaaaggagccgtggccgccatgaggaggacgtgagagctgaagtcaggggcaacaaggaccacgttgtcttccatgattccggcgaggaactccggctattgcaggacatttcttacgactgcagcaaccaccaccaactttaccaccagtgcagagagggggacactggggtgagcagaagagcaactaaggagtgttggcgagaggaagggaggaagggatgtggggagggggaggaaggaaatgggggagcgggattcaacagctaccggcgaagggtggccggaggaagagagacaacacagagaggaacagagaaaggaggagggcaccaaggaagaagaaaaggtggttgtaggggcggcgtctgcagatgccggcgacggggagaggtgaccggaggccagactcgccgactcccagcgagagccccggaggaccgaccaccaaagccgactggcgccgctacgccgccacgcggacatcggcaatccgccgcccacgcaccggcgcccgcaccaccgcgcgtgtctgccgccttgcacggctgcgcaagccgcctttgcgacggccccgccgcctcacaagccaccagacgccgcagcggtcgcctccagccgcgcctcctccgcttcgcaccgccccacgacaccaccgccgcaggcgcactgcccagatccggtgacggcggtgccagatctgccgccgctggccgggatccctcgccgtcgccactcctggccgccggcgaaaatctccacctcccctacgcctgagaggggggcaccaccgcggagaaagccccgccgccgccttcctagctcgccagccagctttgccggcggtgaggtgaggggagacgaggggggtcggtgccagcggtggggttcgccccctatgtcgcctgcgtgtgggcgacgcgggggtttgcacaccttagtcaactagattttgatccaatggccgaattgtcattttctacttccagctaggtgaaggcaaagagatggtgaggaggactcaccagcgatattgacagcaacttcctcggcaagcccgatgcagagacgtctttcacagtaatggcgacatgttgtatctctgtcaaggaccgccagattaggttttcgggtttaggaggaggtaggagggggtaggggatggtgagggagggtttagagggaaggccagggtagtagtgggaagcggagatgggagggcggagaggcggcaacgtatgagctgtgcggatggacacactgggtggggtcgatagtatgggcgagagagtacatgtggttagaaggtaggggcagtcgttgaagatgacgaagtaaatgtggagcaggggaaacacacacaggagctaataaagacggagcaatggcttcgacgcaaaggaggaaaggcagaggaagggcaaggccaatgggcatcattggtgctggcaacgcggagacaatgcacggagggtcagggagtggagtacatgcggtgtttcgtagtcgcaaactcatgacgcagctaggggatttgtttagggtgaaagaagatgtgagcattatggttatgcgctagcatgaattgtgaagtaatgcaagccgtccaaaatatgcagatagttagccaaaaataaggtgattgattgatagacaatcccttgtatatataattttaggttgtttattccttttttactatctattgatcgttttgaagattctatatatcgattttagattcgtgcagcttttcaaaactctattttgtcccatactctctccccggcgcggttttcctcctagctggtacggccactcgtcaaaccttgtattctaccttttgccacccatgaacccctgtcaatctagtggtgaagccaggatttaagtacgagggacaattttgtaagtgattctgattaaaaaatgccgtaaaaagtatatgtgaattccaaggttcccaataggtaatatatcatatcaacggaaaaaacacatggtaatttaaaagatcaaccggtatatttattcactttaatttacccttatgagcaaacagataataagcagcgataataccattcgaggtaaaagcagacaaaccacaaaatacacaaaaagctagattacggcaaaatgagcaacaaactatctatcttttgcaagtattaactagtattttagatattcaaatttttaaattgaaatgttagccacctaatgatgtataaaaattaaatacacatgattatcaaataaaactcagtattctataaggaaaagaaaagtgtagttgatatgggcttatggctacggtaacaaccctttgctgcttttgatcagggattagttgccatattcttgctaaacatatgttcatgtcatctgaaactaacctagcttaaccaactaatcaattggcagaatttttttttcgcatgatcagtaccacatttgttagtttaactttggtgaaaccaaattataaggatttgtccttctaatcatattactcccatgttaattttttcacacgaaacgagaacgaaagtgtaaatgggtccacccatcgaataggccgggttgtgcagttcgggaggacgtgttgttacactcagccccttcttcttttcatttacctccatggtgacatctccgtaattcatctccgctggtgatagatgcctgatccactggccgccacctgaccacatagtcctctacattcttgcctacggcttcacatgttgccctcatctagatatacggcttcacatgttgccctcgtcttgttacccatcccctttccttctaccgaaagtatcaacaaataaaaaaaatatccactttaacaaatttgactacaaaggattttttttagataatggactacaaaggaattacgtatgtgatcctctctcttattaagacaggtagttacataaattatacgacgaagtgattagatcccaagagacaaagtgtttgtggtggtggttcgaacgacgaccgactcacttaactctgttttaattgtaggttttcattaagagatttgtaaatcacttatatatatggagcatcctataataactcaccttgtctatgagatcgaactaccaaatctgctgtgcaagatcaaactgatctaccatatagtggtatctttagtcacgaccgagatgaaaagttggcggaccatatcatttctcgttaatttggccaaaagtaattaacacgagttgaccgcacgcataaagaccttatttggtagcccaggatggcaatataattttcccccgtattaaaatcaaaaccaccatttgcccccataaaaaaacaaaatttgctagaagacgtctaaaatttgtgcagtttgctgctggacaccttgaaaattgataatttattggaggacactttcgggcgaattaaaatgagaaaagtttcaaatatatgagaataccctggggccacgtgcttctaacatggtgttgtagtgaaaatttagaaactatacaattataaaatctaccattacctaaagtacatcgctaacatgcatcatattccatgttctcgtcagccttaggttaaaagatattttagccctaaggatattctcatcttttcttttaagaatttttctttttaatcaggctaaaatatatactctagcaaattatcagttttttaacatattattcaactataacatgtttttacgatgtccaccggtaaattattcaaaattctcaaaagtgtcttgtagcaaaacttatcaaaaagaaaaaaggcacaactttattggattgtgcatgtagccatgcccacgtaccgtttgaagccctataattgagggttctctttgcaacaaaaggatcgccaaaggtgagtcgctgttgagacacttgcctcgagaaaaagcttgacacaaactcgatcacagtttctacggaaatggagggggccaggaagaaaagccatcatccatcatcaaagggtgaagcgaaaagcgtctttttagagggccggccggcatggatgatgactgccgctggccccggcggcctcaccctgagaactcaacaaagcccaaatggagaaagatatcaaggggagaattttggtctgtgtatttggttactactccctctgtaatattggtttgatcattcatccttttttaaaaaaaattatgtaattattttctattttattttgatttgatttatcatcgaatattctttaaatatgacttaatttttttatatttacacaaaatttttaaataaaacgaatggtaaaacagtgtcatatattaaaaaatgaaagtagtagatgtgttcctagtggatggagaatccgagcaagaaaggccttgtaatcatctccaatagagaaaaatgcccagctctcaagaaaaaagaaacgatctcgccacgtaattgttgcatatggtgctatttgaaataggattgtatatatttgttgtatacctcatcgacaggcctttagcttataagccgcagccaaattcttaagctgctcttcttcttcttcttcttcttcttcttcttcttcttcttctttccattttcccattttctaggtttttttaagattgttaagactacaagttaaacgtcttaccctaaaatccttttttttttggcctagaagccgtatcctaatttctgaacacgcattgtactttctagatgtttgtagctagctattgatctactagtatttcgttgcagtttgatcccattctctgtttgtggtgataagctgaaaatgactgctggtttgtgggatgagaatcgtgcactcgtttgtacaaactcttttgtttgcaacttggctccttatcctcccatgatcctgcttctcacccctctttgatagacacctgccgccctattgcaggcactagtacctgcaaaaaatatgttaaaagtttttgtgaagcatataatgatttgtccacatgctacgcactttgagttggtggttttgctttttttttttttctgattctccatgcgagctccccgaatttgattctgcgaggtcaagtcttgttcatctttttgtaaaaaaagaactggattttttttttaaccaaagtgcccgtagccattgtgagttgtctccgaatcgcgaaatagaacggaataatcgtaaaggaggtagctcaattctcgtagacgcaatattaccaaacttacgcatttcacaatggttcttattaaagtttagaggcaataatcatggtgatggggttttaaaagacttctttttggatgcaggattttaaaaggaataaaacatagtagaatgtcataccgtgtgccggtttgttaaaaaaatagaaagggaatatctatatttatggcgccatattattcaccaaaaaatagtcggcatgtatttacattgtaagttcctaaattacatatgtaattttagtgtatttgcaatgtaagtcttgaaattacatatgtaagtatctaaattacatatgtaatatatcatattattaaaggaatagaaaaaggagcctccacgttcgctctcatagcctagaaattctcacattaatcggagaaaaagaaaaggcagagtccatgcaggaatataatttagtaatagctaaaattcggaattaaaaaataaggaatattataagaggagactagagtccatatagaaatacaatttagaaatagttgaaattcggaattaaaaaataaggaatattaaaagaggagactagagtccatatagaatttcaattaggaaataactgaaattcggaattaaaaataagaaatattagaagtagagtatagagtccatatagaaataaaatttggaaataatagaaattcggaattaaaaatgaggaatattagaagtagagtatagagtccatatagaaatacaattaagaaaaaaaatagaaattcggaattaaaaattaaggaatattagaagtagagtatagagtccatataggaatttaaaactaactaaaattcagaataaacataataaaattaaaagtagagtttagagtccgtataaaaatacaatttataaataactaaaatttaaaattaagaaaaacatgggaagaagagtttaaagtcaatataggaatagaatttagaagtaactgaaatttgaaattaaaaattaaagaatattgaaagatgagtttatatagaaatacaatttagaaatagctgaaattcggaattaaaaaataaggaatattagaagagaagactagagtccatatagaaatacaatttagaaatagctgcaattcagaataaaaaaaataaggaatattagaagatgaggctagagtccatatagaaatacaatttagaaatagctgaaattcggaattaaaaaaaaggaatattagaagtagagactagagtccatatagaaatacaattaggaaataatagaaattcggaattaaaaataaggaatattcgaagtagagtacagagtccatatagaaatacaattaagaaaaaaatagaaatttagaattaaaaaataaataatattagaagtagagtatggagttcatataggaatttaaaactaactaaaatttggaataaatataataaaattaaatgtagtgtttagagtccgtataaaaatacaatttacaaataactaaaattcgaaattaagaaaaatatgggaagaagcgttcaaagtcaatataggaatacaatttagaagtaactgaaatttgaaattaaaaattaaagaatattgaaagatgagtttagagtccacattgaaatacaattagaaataataaaaattcagaattaaaaaaaataaaagatgagtctagagtccatataggaatatataatttacaaataactaaaatttgatattaaacataattaataactaacacgtatataaaatacaatatgaatattacatattagtagtttcgtaaagttattgcaaaatttaaaattatgttgtcattttaatatattagaataatataatgagaaaacatatatgctattatatgaaagaaaatataatgatgctagccgcgcaatctgcgcgggccactatgctagttttactgtatttacgatgtaagtcttgaaattacatatgtaagtatctaaattacaaatgtaattttagtgtatttacaatgtaagtaccaaaattacatatctaagtcctaaattacacatgcgtaattactgtgtaaatagagtaattacattcgttgatgaccaacacgtttcatgcaaagcaaaaaggagtcgggagcaagttgttcgatcagcttatcagatgtactttgcacgaatcatgaagaagattagatggcagatcgtcaaactggctgtatttagcccagaaatatgtcggcataattttagcaaagccgaaatagaaaacacatgctccaaatagccatttcgatggcacacacgaaaaacatataaatctgggcatagaagagaaaaagaaacatgagacatgaccacatgtttgtctctccaaaattcctattgaatgtccattctgtaatatttttaaaggaatttttagagcaaattctttcttttaaagggctctaaggaattttatctatatgattcaagtcctccagaaacccttcaatttttctttgttccaaagtcaaggaaagcccttctttttttacccgccaaaggcctcaaataaaccaatatcaaattttgcgcttttagttttcttaggttatgctctttccagcgagtttccaacgcacctctctcgttttccacgcacacgcttttcaaattttgcaaaaaaaaaaattatatataaaagttgctttaaaaatcatattagtccatttttaaaaaataaatacttaattaatcataagaaaatatgtcgctccattttacgtgcgagggaggtgagttcccaatctcaccttccgaaaacagccaaggccacttgctgcaacagttgaccaaattggattagggtgaccataatctggaacttcatgtattcctcttctagaaccataacctgaacatatgcactcaaagttgtccttattccattaattattttaaaacatgcaaaaaatgaaactttgttgaatcgattactagtaataacttcactcacaaagattgattctgaattgattttaatattttcagcctttctttttttggggtgggggaggggagggtctttttccacctctcacttcctctatcaattttgctcatctctcttttgcccctattcaattctcttttgccattaccataataccattggtcaaagttagttcaccataagagtagcccaaaaaggctattatacccttaatccgttatgtaactaaaattataagaaattccaaaaaaaatatcaaggaaaatgtaattatatatttagtttttaaaggttgagtaaacaatttatgatggaccatttcagttagttcaaaatatttataattacagctaaaaaactatttaaatataaattatttttgcttatccacatgtaatgtaagcatggcatacctcacaatatttggaacaaaaaatgaaatagcgatgcacatcccaagtacaattatttcgtgaaacatttaagaaacatatcaatcccaagatgcatttttaaagaggtaataaatataattttcctttttagttattttttctgaaaatttaatacattttaagttcccataatttattttttttatgttttgcgttcacgaaaaaattttcatgctgttttatggtatttgctaaaatttgaagtgtttttttttttggaacaatccttcgggcctagtaaataaaccagactgggctgatggttgaacccgaaaaaaccagaaccaccatccttgtggggtcggtttgctacaaagactagacatgcaatttgactgctgcgaatcgtgtgaaccgaaccaagcaccgctaccaaccagctagcttgctcatgccaaaaaggggatatatgcattgtcggtgatatgggaccgggagtatcgtgactagaggcttaaggcagacacaatcgcccacgtggcctggcaccttcggggacgtcgggcccgagggtgaggtgtccgccctcctcctgatttccccgagggggggggtagggtgactccagcttcgcccccgagggcagaggcgccccgacccctcgcgttttctactccacgtgtatgggttaggtgagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagtacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaagtgggttggttgattctttccagattcagagcctagaacgagggagaggtcggctcacactttgtagttccttcatacacagatccaccaaaacacaggagtagggtattacgcttttcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagtgtgtgttttctgagctctcgtactcctccgtgtgcgccaagtttttcttgttcagcctaatggccgagcaagcaaaggtgcacgacctctctccgagtgcgagcggcgacgacggggagccaaacccacgccgtcgagctcgtactcccccacctcctccacaccaagatcctaagcagggggaggcgctcgagagggtcgaaaaatccgcagcatcgccagtcgcgggtggtgcaggagaacggcgagatggggagcgtcgcctcctcgtctacggcaacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacaccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgggaatcagccctccgtgcccccggttggtggtgttggctgtagagccttcgtggcgagtcttcggaatgtccgttggcccccaaggttccggcccgccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccgttgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgacaggaggaggaagaagaggtcagtccgttccgacgacgagggtcatgtcctcgccgtcgagggcacttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccggaccgaccacccaccgtgcgtcgcccggggagggcagattgcgatggtggtttcccccaccatctgcaacgtgaagttggggcgtgtcctcatagatgggggagcggccctcaacatcatttcccccgcagcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccacatgaagatgccgggccccggtggccccatctctgtccatggcgacctgaaagtcgcgctcgcttgcatggagcagcgcgcggaccacctcgctgctgcgtccaagcccgagggtggtgacgagaggcctggcacctccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcgaccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcggggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaaatagggcgtaatgttgaggcttatgtcgatgacttggttgtaaagacgcgcaaccaagagactttactcttagatctagcggaaacttttggaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccctagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtggttagtgcagcgttggttgtggagcgcgatgagggcaatcctcattccgcgcacccccaccctgtgctgacttggcccgggagcgagcagggaggagaggcccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggaaggagcagggagaagaggcccccgagccgaacggtggcctaaggcccctgacgaccagagttggccctttgcccgcttgtccgacgacgccaggagcccccgacccccaggacggccccgaggccactgtgggaaggccgcccctgtcgtcctccgaccccgaggtcatcggcacagaagacgagtgcgccccgaggggccacttggacgaggaacgccccggggatatggcccttagcgaagggaatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaacggaatcctcctgaagtgcattcctcgggaacaaggcgttgagcttcttgccgatatccatgaaggcgagtgcggagcccattctgcctcgcgcaccctggttggcaaggcctttcgtcaaggattctattggccgactgccctcaatgacgcggtcgacctggttcggcgatgcagagcgtgtcagttccacgccaagcaaatccatcagccggcccaggcactgcagaccataccactttcatggccatttgctgtctgggggctcgatatcctgggaccgtttaggcgggccccgggcgggtttgagtacctgtatgtcgcgatcgacaagttcaccaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcaacgccacgtccgggcctgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggcgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcagccttgccctcgggggctcggttcggtcagctaaaatcgccaaacggggcccagaaccgagctgtgccccggggcgtggtgaactccgggggggaatcggcaaaaacccacaatcgggtcacccataaccctcggtcaccacgttcccggcctggccagtctcgacatgtggatctccccaggcactagccccgacccgagccattagaggactgggacttgggcacgagcccttaaatcaagctaagacacaaaaagaggatcacggcacagatcatcctcatctcattcgcatagcaaaataaaattaacacaaagaattttttcatcattttttattgcagattataagttgatttatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccacccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggtgtgtcattgactggcctttccagaggcccgcttgccgaccggcgcgatccaggcgggagactgcatcccaaagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcgacctcttcgagagctcgctcccgctcggcaagcgcgtcttcgcggaggcggagtgcggactcctcttcggcgcaggcagactcgtgcgccgccagcgttgcctctcgggaggtgacggcggcctcgcggtccgccaggactttctccgcgacgcaggcgcgctcctccagcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccgtgctgaaggcggagggagtcctgcgcctcgatcatcacagtggtggcgatgagggcagccccccgctcctcctccacctctcgagcgatctccgccagtgccgtcttgcgggcctcaagatctgagacgtgccggcggtgagccttgcggcccgcttctaccatggcctccaccgagcgccgcccctcctcgacacgcgcccatgcggcgtcgagctccgcacgctccgcctgcagggcctccacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcacgggccacccccggacctgtttggtcctgggcgtcgcccgaaggggtgggcccaagcgaggcgtccgcggcctcgtcgtgaactgcctcggaagccgccatcgcctcagcccgggcggcctcctcccgagcggcttcctcggcttggcgggcccgggcggcctcctcccgagcggtatcctcagcctggcgagcccgggcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattagttttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcgcgatctgggtcgctgcagagggggaggataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcgggagtcggagatgcgcttcgtcggcgaggggggtgtagaaccagtcgctcttccagtcatcccactttttacggaggacgcaggggatgtagcggttcaacaccggcccccgcggcaggaaatagcagccgccgaccactgacggtggcgataccgactgcacggtaaagaaccactggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccagtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcggggaagaaggagttaggacgcaagcggcgaaggcaagggaaatgatggcgaaaggaaggagacaaatcccatcctcagtgcctttatacccttgccaacgctgtgcccggctcctcgtttctcgcacccattatttcgccccctcgtttctcgcgcccacgcttccactaatcccattcgcccgcttgcggcgcgtgagatggatatgcggttgcggcagtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgccccattattgacagccaaattaccattaccggtgtgcatggtttgagaccgttgggtttttgcccaaccatggagaccggtcccacctgtcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8040 - DNA, 1152 bp, Oryza sativa
tgctgagctcatgcccaatgttctttatgacactgtcaaggtcctcggtcatgcccaggaggtcatcgttcttgagctcccgcgcaacggcgctgcacctcatgacgaggtccttggcgaggtcgacattggcagccagatactccatgacgtgcatcacattaaccgtcgaattctgcactctctgcagctccatcgtgaccaggggtgcatggtagaggtggctgcctacatccatgaagttctcatgctcggcatcggctgccgcctctggcggcatgagctcagagatcgcggcctctatggactcaacgagtgacgccttcctcgcctgcgctccgcttcgctgaacaagagtacatgtcaatcaggcacccaagcaaaagcatccaaaaacacagataacacacagactgttctgttgtgatgacaactacagtccaaaattcatacagtccaattataaagcaataatacaggctcccttggctgcaatcaatctgaggttgacccaaggggttgagttctacacaagcaaattgacttcccccaattccaaatttttaacagtttgttccaagaactactagcatcttatctactgtacagtgaaaaaatcaccaggaaaattgaatagaggacacaaataacacaagggggggggggggagtacatcaagaacagcttgatgcacattctacctggaaatcaacatcgtttctccgttccatctaaccaaagtggcaaaacgtactaccaccaccataaatttgctcacttcaagcagggttcgccatctctagcgcaaagaccccccatgaatccatgattcctcgccttaccaaatcacgaaatacaaacagaaatggcacaagaaccgaggaatttgcgaatcacagcctcactacccacctttacaaaaaaaaaatccatgaaatctaccgaaatttatggcagcactacgaattagcagcaagcgaacaagccagcttcgtccccccaaaagagagatgcagcaaacagcaagctcaactcccccacgcttacctgcatccaagaactccaagaacttgaccgcgccgctgcttctcctcctcaccttccgctccaagctcctcctcctcctcccgagactgagaggacggagacgct

SEQ ID NO: 8041 - DNA, 23834 bp, Oryza sativa
  unsure (1)..(23834): unsure at all n locations
gatttggtaaaacttttgaagctttggcccattaacaatttcccaaatgcttagtttaattcataaaaaaagatgtatgtatggatttgccttaaaaaaatactaacataatgacataaatttattgtttcattcgtttcaaaatataaattaaaaaatatattagtacataagtatttttaggcacagattctaatacacgagaatctatatattttcagctaaaatgatatgcttaggtaggtaatttaaacaattcaatttgaccactaagtcgattaaaagataacattttttctctatcttagttttttgctaaaaatcatagaaatggttatatttttaacaaagggagtagattttgtaaactcgtttcaatataaaattgatggttaaagctataaaaagtttgactaataaatcggatcattggaagcgaaatatatatattgaagctgaaattcgtttgtcatggatcggagctgaccgttgcaaattctctatctgaaagcgttcattcgaatttgagtagctagaaacagagggaagggtactttattatcaggcttacccaaattaagtcgagacaagaacaggaagtagacggagaagaagatggccggagagtggagacaccgggaaaaatacaaaggacgagctaccgccgccggccagcacagcgccgcaatgtactggaccagcgcgaggcgacgagcacagcgaacgacggcgtaccttttttgtttgggaactcgtcccggattctcttaagatttggagcagctccgtcaaagtttaatagcatagcaactgttgaattaaatttaaaaatatattgttcattcaattttttctcatgaatattcgggatgcaaattttttttataaatataccgtcgatctcgcacaaccgttgcgcgaaaccgagatgggtgtgacgtcatgggcggtatcgcgcgttgaaagtgcgagagcgcacggtctcgcgcggcgaaggcacgagagcacgcggtttcgcgcaatggaagagcgagaccgttcggtctcgcggaatcaaacagcgaaactgttcaccggttccatttaattagtgcttaattacttaattagcaattaactaataatgattagtaactaattatcctaattagcgactaattaattattaattaatagttaatcaagataattagtcgctaatcgaatcagcatggcaccggtctcgctcagtgcttgtgcgagaccgttctgtctggctgtaccattccacgagaccgcgccgtcgtcccgcgagactgcgcggtctcgcgccttcgccgtgcgacaccgcccacaacgtcatttccacgtcattctcgcgcaacgattgcgcgagatcgactatatttacgcaagaaattttacatcccgaatatttgtaagaaaaaattgaataaacagtatattttcaaatttaattcagcaactgtcgacaataaattgtgtgtcatatcattttaaaaatgtacacaaaaatagagcatataatagttaactattaacacaataagggggtgtttgggaactagggactaaatttagtccctctcacaaaagcataagtccctatgtgagagggattaaagtttagccccactttaatccctccaaccaaacaccacctaagcaatacacatattttactaatacattttaaacaaaatctctctttccatacacaatactcaatcccatgacttactatatgtgttactattggatctcactttcttagagctcgtgtgtagttggctactagttttaggctgtgtttgtgttcgggaggaggggttggaacccttcctcttggcacgcaaaacaaaacatctattattgtgtgattaattaagtatttactattttttaaaaaaataaattaatataatttttaagcaacttttgtatagaattttttttacaaaaaccgtaccgtttagtagtttgaaaagggtgcgcgcggaaaacgaggaagggaggttgggaaagtgaggaaacgaacggagccttagttgcccactctctctcctccacatgggcattcaatactacatgacatctggataaaacactatgatagacattagactatagcttagggtatgttcggtagagttctaaggctgaggggctgtttgtttggaggggctaatccataagtccctccactctagtcccttttagcccctaaaataccaaacaagagggactaaaagaggctaaaactacctaggtcataagtccctgcgggaggtgctaattcggactaaaggcctatagcgcacctaccattaaatggatgaagcatgtaggtgctggataaagtgctactagataggtcatttaacgaggttttagtcacttttagtccctccaaacaaacaggatagaactaatgaggacttatgttttagccctggaactaatttttagctctaggacttatggaacaaacatgacctgagttatttcttcaactttcccaactcacattcctcgtgttccgtgcgcacgcgttttaatctgctaaacggtgtgttttttaaaggttgctatacgaaagttgcttaaaaaatcatattgatctatttttaaaaaaatagctaatacttaattaatcacacgctaatgaatcgctccgttttccgtgcgcagaaaatgtcttcccaatacaggctgcagaacacaacctaacttctaaggccgagtttagtttcaaactttttcttcaaacttccaacttttccatcacatcaaaacttttctacacaaacttccaatttttccgtcacatcgtttcaatttcaaccaaacttcctattttagcgtgaactaaacacactctcagggctggccctgactttttggtggcccattgtggatcaaaaaatgaaggcccccattcaccataaaaatacaagataatatttaaaaactcattgtcattaacgaatttcacactaataagtttaaaataccaaaaagaaatttctctagctcatttaaaataatttcttctaacagttctacatgcaaaattagttatgatagtgtcaataataatctcatctatatcttctcaatgcacaaagtagcctatcagggtatatatattttggaggcctctaatttttggaggcccagtacggtcgcactacccgcactgccctagggccggcccttcacactctaaatttaacttgaagatttatgtctggtacgggcgtggcggagcagcctcaagcccactcactttgattcagtttattttaatagcactttactctcctctgttttatttttagatagactctgagacccggtttagatgggactaaaacttttaaatccctatcacatcagatgttcgaacactaattataaatattaaacgtagactattaataaaacacatccataatcttggactaattcgcgagacgaatctattgagcctaattaatccatgattagcctatgtgatgctacagtaaacattatctaattatggattaattaggcttaaaaattttgtctcgcaaattagttttcatttatgtaattcgttttgtaaatagtctatatttaatactctaaattagtgtctagatacagagactaaagttaagtccctacattcaaacaccacctgaaaccagagtctgaagctgaagctataattgtgacaaacagatttcagtagcatgaacacgagggagggatcctgcatgtattacatagtactccctccgtttcaaaatgtttgacaccgttgactttttagcacatgtttgatcgttcgtcttattcaaaaacttttgtgagatatgtaaaattatatgcctacataaaaatatatttaacaatgaatcaaatgataggaaaagaactaataattacttaaattttttgaataagacgaacggtcaaacatgtgataaaaagtcaacgccgtcaaacatttcgaaaatgaaggagtagtcggtttcgtgcgtcttatcttgggtgtcgtcctgtctgcctagcgcctaccatgacaccgtcagaaacagtgagacaaacacgatacaagacaagcacgtactgtaccgcgcatacgtacagcaatacagcagcacatgagacaagaagacgacgaaatgaaggaaattaatcagccgcgttccgttcggcgtaggccacgcgtgtgcgttgggccacacacaactaactccttcggctacagacgtactctctctctctctctccgttccctaatataagagatttttatattttatttgtattgtttgactacttatcttattaaaaaatttatgcaaatataaaatacgaaaagttatgtttaaaatactttggataaacaaataataattctaaatttttctaaataagataaatggttaaacagtacagctaaaatgtgttatattagggagtactagcggtggccttttgttttgtgtacactaccaaaccggggtgttcatttctctctctctcagccgcacaggcgcacagcacaatcacacaaacacaagatcagctttcgcaaccgttgagtgcgtggagaccctctgcgttcgataaacatcggcgccgggggaaaaaaggcgtgcttcgccttgtctcgtccggtcgcggccgctgctccagccagcctccaggcagaagcaaccggtcaacggcgcaggcaacgccaccgaccgaccgaccaccggtagtgctcgtttctcgccgagcgcagcagtcgtggaggagggcctaaaacgccgcgcttttgaagagttttcatagaggcaggcggcggcatgggctttcttggtgccgcacacgcgtgcgtgactgcacacgatggagttaagccatgaattaagttcactttaggtcccttgatttgttgccgaatctgatatacgctccctgaaccgcagcgtcagatatggcgtgtccctcaactcttcgaaccagtgctaataagattccaaaatgatttggactgtggtttcggatgacttgcgctgcccaccgcagagctgacccttctccttccctacctcgtcgttgacaccacctcttcttgcatgtgcttcccacctacatccttcaccgctaagcgagcacaaataaaaccctatgtctttgagctatatagggctgcctacttgccccgatccatcttcctctcttgatttcttgctcctatgcaggttcaattcttgtggtacgagatttgggcgtacgagataaaaaaccctaatatttgcttggttctttcacgcccgaaatttctatccaaaattccaaacgcttacatgtgtataaatcctcgtccaggaatcagccgaggcacacaataacaaattgataatagagtacaaattattactctaatcaataagcgaacaaaatgtcattacagaggtagatagttcctctcaatcaataaagtcctaagcagcggaaaaaataaaagaaacagcgcagacgactcctctccacaggcagcttgaccagggctacgcctaatcatcaactccatcaacatcactgtagaactcctcctctgattaatgattgcaaggtgagtatatgacatactcagcaagccacacagcaaatatgcaagtgcacaggataacaaaggatggcatagtatagtctcatttgcataaacaacatttaataaatatttcagaatttcataaaacagtagagtattaaataaacagtattaaaccaacgctatacaacataccctgttgtataggcccaaccatcatgcacaaccaatcccggctgcacaagtctatctccaaaccaggaattaaccattccaaatcaggagctaaacaagttaataacatcatcatttaatatagtgtgggggtgagactaatcacgaaagacattgttagacccgcccataaccgcggacacggctattcgaatagtttaaactctgatcagaagtgtaccactgtacccacaagacacaacctcaacatcatgtcaaccatgcgtcgcgatacttgacaagtacccgaatagagagattgtgacaataccctctatataatacaattcaaagcagtgcaccgttcccggatcataatcacccccttataaacaaggtatggactccccagtgacccccgtgggcttatctccgccacttcacagtctggtgctctactatgaaccatactatacagaaagtaaagccgttgcccacgctggcttgtggttggcacggtaaatgtttcacaaccgaaaatcgtgaaccgatccttaattgtcatgagcacaaccatcaaaaccatatgctcacaacccaccattatcatattttaattgtcaaattaattaattaaccaatcatgattaaccatcatgagctatcattaagccatcattaaataatagtgaatcttaaattatcccattagtgaactaatgtttctaagcatggctaagcaattatacctaacatctagctgaaccattatatgaagctcaactagtcaaattataatagcccaaggtatcaaagaataaagtaaatatgtacaaaagggccataacaaagaataggttacttccacccaatgacattcgaaaatagatgcaatagttgaatagaaacaatagctttaaataggatcaacatgctcaaagggttgtttgggatctgtgtgacttgccttgctggccttgaaaatcctcaaagtcttctcctgcaaaatcggactctccgggaacgtcggaatctaaagaaaaaagagcaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcgatttaaatcatttatatggattttaattgaattatgacgcaataatgaattatttttgaaaaggaaaaaggggtttattgcgtcagcgggctcggctcacggtggaccgggtgcacagcgacggttcacgagattggacggctgagatctatcctatctacaacggacggccgagatcgattggatccaccgcggctcacggatggacgacgacgatgacgtcagcgacgacgtcaccaccagcggcgaccgaaccgtgcgagcttgtcggcgaaccacggcacgtgtaacgccccgattttcgttcgggtttaaaaatcattaaataatgcattttctagaaattaaataaaagttaaatcaatttaatcaagtgaaataatgggagaattaaaattttcccttaaaaatcattggccgggaatattttgtaatattctttgtgccttaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgcttttcatccctcccggcctctcctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccggcgccaaactgcccccactcacccatgtcgccggcgcccctttcccccttcaaatccgtcgccaaccggcctccccgtcgactctcgaggctataaaaacgatccccgggctcccctcatccatttcccccattttccccaagccgccacgccctccctcgctctccccgcgccgagcccttgcaccgccgctctccggcgaactccagcagcgccgcgccgccactcccgtccaccccgcactgcgccgtcgccctccccggcaccgcagccgccgtgcgcaccccggcatccactccgttctctccttccacccccgcagcaccattcccaccgcgaggccgagcttccaccgccgttcgccgccccagccgcccgctactgccgccctaggggctgcagcgccgcgccgtttgtgtcgtcggcatcgcggtgccgagctctaccccgacccctagtcttttcccctccccaactccgaaacaccgccaccacgtgcaccacctccctccgccgtcgccgctcccgcaccctgccaccaccgcagccggcttcgccgccgcgaggacaagcctgtcggccgctcccctcccccaatcgaccgccaagctgtcacctccactgccaacccgaggccgccgccgctttcgccgccccggccaccgtttaccgccgctcccggccgtcccgagccgcacccgtggccatcctcagcgtcgccgcgtcgtgccgcacctcggttgccgcccctcgccgccgaaattccacgggagcccgcttttccccgttcaaggtcccggaggcccccggccgtcactcgtcgcccgtcggccgccgttggggcgccgccgtcgtcctcgcccggggagctccgccgctacctcgcctccgtccggtgccgtgccgcttggtgagcatcccctttcctcctcttctttccgccgcccttcgcgcgccctctcgcgccgccgctcgccgccggtggccgtgcgccgccgtgcgtcgtgtctcgaccgggccggctctgagccgtgcccgtgctctgggcgccctgcctcgtggccgcccgatcggctcgagctgatctgggccatcggttcccgtggaccggcggtggaccaccccgtggtcccggtccacggtggaccgattcccttgacccgctgacgtgtggggcccgcctatcggcgccggcctttttgatgacgtcagtacttaagcttttcctttgaaaaaataattaataattgcgcaataaatcgagtttaattctagaaattcatttaaatggctcaaaacttctaaaatccatatctaattcattcgaactccgaattgagccgttcaacttgcaaaattcatctaaaattgagctctacatgtttgtttactttttatgtactatttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttactgtttgcaaataaatatgcatgttttgctaattacacgggatcagggtttacctatctgctcgcttgtgccatgtttacttgatatctatcctttgtcaacattgggtaataaatcgactagctcatgttacttatgtgacttagctagaactatatgcttagccatgcttaattaccactagctcagttgataggataattacagtattagacctttttagtatcagagtgagctgcgtgctcgagacatctggccatgcttcatggtcgtaattatccaactaaaatacaactgaatggtgggctgtgggtgcatggttttgctggtcgcacccatggcagttaaggaccggttcgcgggatgccctggaagaacttatcgtacttaccacaagccagcgtgggcaacggctaggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttgattagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttacccttgcacgtctgcatcgttggtgtggcttgctgagcatggtggttgtactcagccttgctattattcccccttttcagaagtgtagtgcttctgagttgaagacgaagttagaagaccaaggctcagaccccagttgagttttgcctgtggagtggagctgaagccccgctaggatcgcctttttccgctgctgtcgttctgtttcagtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagcacgacagcgcgaacggaaagcacctacgggttgcgggcggcacggcgaactcaccggcgaccaaagcgacggcggacgatgaccggacgacgtcggcgacaaggaagaagcggcggcaaccttcggcttgacgacggcgacggtgctccggcggtcgacagcgacgacgaaggggcgaacgagaacggcgacgagacggcgaccacgacggcgacctccccgagcgacggtgacgactggagcgacggcggcgcacggctggagcggcggcggcgacggcggcgctagactgcacggggctagggcgctacgggcggcgagggacgaaggcgagggtggcggcgggtagcggcgggcttgggggtcaatttatagcggctaggaggcggcgacggaggcccacggcgaccggcgacgagaaggaaagtctagggttcggaggagagagaccgatccgattcaaccttgaatccacgaatttccaaacgattttagccgatgattccaaaagagaaaagatagaggagatcgagaagatcatttcccctctattgatttcatcggaaacggaaaggatcggccggattggaatggcggcggcggggcgcggctagggtttcgccgggaggaagacgacgggccggccccacctgtcagcgggcgaacgcgcgcgcgcgggcggctgactgggccgattgggccgagggagagagagaacggtttgggccgactttcggcccaaagcctaaagaggattttaagaacttttttcaatttaaattattcattaactgcaattccatttattaaaaatacttctttagctcaaataaatcccagaaaaatctaggaattatagaattaagcaaagtatttaataaaattttatctggccccattttatattggaatttatttattaaaattagatcttctcttctaggctttttaaaataaattctaataattccaatttaacaacaatttataatttggagatttttagggtgtgatagttctccctatcttgatttggctttcctcaccgccgataagaggatgttgggggatgggaaggagatgctcaaattgcggggcagggcggggatttcaaaatcaggcactatattgactgggacctcgagtacatcggttttataagttgagagatgcgttatatctagtattgttgttcgaggatgtaattcaaactcgccaccaagacgagggacctaaagtgaacttattcctttgacggctacaacaaatgttgctgctatgggaagaattaagggttaattgaattcatgtcactataaattttacaattttaaattctactattattattcatgtaattaaaatcatgccatcacaacaaatctaatgcccctatctctttgctttaatggatgaccgacatggatagcgctagtggaaacactgaccagcggcgatggtggaaagatgacagcgactggggaccaagacatgcacatggtgaggagggagtcacaccaaggattgacgaaggtaaggtagaacgtagaattggcagggatggtggccctttccttctcggtcaccgctaccaccttcaggatagctgcatcgatcaccacccacggatcctcctgcttcgctagtttcggcgccgtaacaaacgaagactagttgttgcctcaaccatcagcgtagaactgtgtcgaggcaaccgtaatagagctctaccaccggttgtacacaactatgcctaaacctgcccgccagggatacaccagggccgtttctactggagtggtggtgcctcttggctcgagcaccgccacaagtggcttcgcccagatttggagagagcgagagagggggccgccggatttgctagggccgaaccctagcgccagaacaagattcgagccctagcggcattgccgttgtttggccgtcgtccttgcatcattagcgtcttaccatcctccacttgcccccgcgtaccgacatcctctgctcattctccctgcgccgctagaatcaggctgtgtttgaggggaggagatataggagattgggaagatacgcaaaacgaggtgagccattaacacatgattaattgactattaagtattttaaactttaaaaatggattaatatgattttttaaagcaactttcctatataatttttttacaaaaaaacgcaccgtttagtagttcggaaagcgtgcgcgcggaaaacgaagcaaaactcactcacaatcacccagatcacccaggaaagaacacagcctcagtcttcattctcgcatcgcatttggctgccgtcatcctcgtgatgtcctcgtcccaaggctgacaactcacatgatttgcttggacattggtgatggcaaggacagctacggcatgagggcagggacattttagtacatacaaaaatattgcctaaaaattatttgaaacttgtttcaggcgtacagtgtggtatggatcaaattttgtgcttcttatgatggtatggtttcagttatataaatagtaatagattttaaaacctcaaaagttataatattttataatgatatagatcaaattaacgcaggattaagagggcagaaattgactcggcacgtttctgcatactgacacgcaactgtctgtcagcgtcaaaattaaacatattctttttttacgcaaaattaaacatattcttatgcagcacgtggtatcactggcaaattaggctgttgctttctgaagcggtgctgtgtgttggaatcttggagaggaggtggatatgtactaaaaaactgacctcttaatatcgtgctcatttagaacgtagaatctgatatagaataaataaataaatgctgctactccatccaattttctctactaggggttatcagttataaggcgtgctcgtagtaaaaaaacaaccgtaaaatttgaatttctttagaagacctaaaatttaaattctattaggtatatactcgactgcaacggattcatatgactatatcattgtgaataggtgcacaaatatgattactccctccgtgttttaacatatgactccattgactttttaataatgtttgactatctgtattatttatttttttgcaaatataataatatttatgacatacttaatgaatatttgatgataaatcaagtcacaataaaataaacgataataacatatttttaataaaacgaataatcaaacattggtcaaaaagtcattggtcaaaaaatcaacgacgtcatacattaaaatacagagggagtattttctttaccatcacgcgtgaggggaggcaggctaatgcgacattatctttaaaatcgaatggaagtaaaactcaaaatttacaaagtagggcaggtcaaacagttctctttcaataaaacttgcccaccaaagtttaagttctaaacttgacatgtgtggtcgtatttgtcgattaattatttttccagtagagagcgatgaacgatacaattatgacaacatacttatagggtcataaagattggtagggtaaagttacgctgttcaattaaatgtggtttttattagggataatcctaatctacgttatatgtaatatgagagagtatgagcctctgtggcacgaattgagatcctctgcctttaaatacatcatgccttttattactgacacgtgatcccatatagtttatcggtttcacatgccaatgacaaacacattttgaaggtagtggagcctgatccccgtggcacccctctggcatcatgccaaacttgccaagcgagaaaagcgatcggtacacacatcgtggtgaccacgaaggaggagccagccacgtggaccgcttcaacgccaggagatccgcgcgccacgtcgctgccctgtggggccatccctcgagggcatctcaatctctatccatcaatccggcccggccccacctgcagttggagagagcgcgtggcagcgtccacgtcaccagtggggccctggaacgtactacgccagatgtgacctgatgaggttttgctaccctcctctgtcatctcgtcattactgacatgtgggcccacgcttcaccttggcccaccggtcattggcgtcctggttaatgtgcgaaaatcaaggagagtggccatcaacaggcaggagccatgagctggcccccacgagaagttgttggtgttgggattgggaatctgttggctattgcttgggatgaaaattaaaggaaaatctataaattttgttctcaaatgaaatgaagggttgatttggtttgtggcctaaattggtcttaccaattcgtcaatgtcaaattttggtaacttttagcatggctaattttggcaaaagtaaaattatgtttggattgaagccaaaatagcctaaattaactgttaaaatggcatatttttttaggtatgtcaaaatttggctccaaaccaaatagacaataaacactattgaaattgccaaatattggtaaggccaatataggcctcaaaccaaaccaacccgaagttaacctgtgatcctcctcctgatcatgtgctcacagaggttaatttctctgagctcagcaaaccatgttcagttaatcaatttttgccatcaagttagagtgaaaacatggtgaaaccctgaatacacttggactgggttaacgagatgataatcgtcccatgacttggaacaaatggccatcatgacagtcacatcaatatattattagcactacatcatacacctaccaaataataacaaataaccttaagtccttaacaaataataagtgcacaaaaacacggagaaaaaataacaaaaaagatatccactcgcaaatcaaagaaagactggcagagtaaggctgtctttagatcacactgaaattttggttgaaattggtacgatgtgatagaaaagttgtgtgtgtatgaaatgtttgatgtgatggaaaattggaagtttggaaaaaaactttggaactaaggctatgtttagttcagcgcaaagtttggattttggttaaaattggagatgatgtgaccgaaaagttatgtgtgtatgacaggttgatgtgatagaaaaggactaaagtttgaatccatctaaacacagcctaaacaggacctaaacaaattcctaactactctagctaaaatatcgcagaaaccctccccacaaattaattgatctgcttcctcctcccctcctctcatgtcattgtcctgcaatacacgaggagcaaagagttgtgtgtaatcctcctcctactctgggtcagctcttaatcccttcaacttccgtcggttggacgccaccggaagccaatccctgtttggtgttttacccccaattttgtcagattttttggagcgaaaccacgagctgtttgaagtgttcggcttcggaatctctttcttggagttctaggaatggggttttgatacaaagattgaagcctttttgttagcgttggtgcaaagattgtattgtattgttttttttttctgcgatgggtggaggcgtcacggagcggctcccggagggcagcagcgagccgctgctcccgacgaagcgggagggcggcggcggcggcggcgagttcgccggcgcggtgttcaacctgtcgacgaccatcgtcggggccggaatcatggcgctgccggccacgatgaaggtgctggggctcgccccggggctcgtcgcgatcttgctcgccgcgctcctcaccgacgcctccatcgagctgctcgtccggtccagccgcgccgccggcgcgccgtcgtacggcgccgtcatgggggacgcgttcgggtggtgggggaggcggctgctccaggtctgcgtcgtcgtcaacaacatcggcgtcatgatcgtctacatgatcatcatcggtaaaaaaaaaattcgatacaacaacctgaattttgacttcaatattgccttcactatttagttgttcatgtgactctagaattgctgaatatttcattttcttttttacttataaccatttctctagaagttatatcatcagtatcggttcgtgtggaatgtagagtagattgcaaattctgaactaactcaaatgcaattgagtaatcgattgaggaagtttggccttctaattgtgaactgtaggatatgatgccttctgaataaactcggcagttttgcttacatgtgagatttaagttgcgttctgcattgtgctgtagataatcgtaactgtttatttgaggccataatttcgtgctgaggcatggcagtgtatctgacatacacattggggtacttcactctaggtgatgtgctatctggaacctcctctggtggtgagcaccattatggtgttttagaaggatggtttgggccacaatggtggaacgggcgtttctttgtcctcctggttacaactcttgttgtatttactccactggcatgtttgaagcgtgtcggtaagtagtctcttcacttagccttatactttcgtgagattttattttgtaccattttgtcgtactgccaattcatgacatcgctatgtttttgtttgtttcttgcagattcactgagttacacatctgccatatccgttgctctggcagttgtttttgttattattactgcaggaattgctattgtcaagttgataaagggacaaattccaatgcctaagttgtttcctgatgttcccgacttggcatctatttgggaacttttcacagcagtgccagttcttgtcactgcttatgtttgccattataatggtatgagacaaattgaagttttgacttgttggtgcattataaaattttattttagtagggaagactttctttcaattttcttttagataatgtcctgatgtcttataaaagcccgaatagggttgcttacttctaagttttctaaagagatttgattgatattttgcagtccacccaattcataacgagctgaaggacccttctcagattaagccaatagtacacacatcattggttctatgctcaactgtctatatcacaacaagtttctttggatatctcctctttggtgaatctacgctgtctgatgtgctcgccaacttcgactccaatcttggtattccatacagtcagatgctaaatgatgctgttagagtgagctatgctgttcaccttatgcttgtgttccccatgatattccatgcactacggcttaatttggatgggcttctcttttcctcatcaagtcctctgtcttccgacaaccgaagattttctgtaatgacagcggtacttctcctagttattttcctatcagcgaatttcattccgagcatctgggatgccttccaatttactggtgcaactgctgctgtgtgtatcgccttcatttttccagccgcgatcactctaaggtaagttaatggattaatgttcattgtgatgcttttattttgttccacctctacatatattatgaaaaaatggctgggatatttattccgttatctcaaaaaaaaaaagtgttatagtacttctgctaacatgcacgaagagaagtgaagaattctacatttgcagatttccacactgtagtaattgcttgttttgatatcaccttttcaatgttgtgatgttatggctgtctaatttattttgcttctaattttgcagggatccacacagtatagcaaagaagtgggacaaaatcctgtccatcttcatgattgttcttgcaattgtatcaaacgtagtagctgtgtatagcgatgcatattcaatgttccacaggaaaagttccccttccatagcctgatattccaaaatcctattggcgagtcagtggattctttatctgaaagatggcttgtacattagctagcaaataaaatcattatttaggcaagtatttacgggatttattttacggtttatttggcaaacaacccttgactcaattatgttgagttggatgtatctataggatgggtgtgtaaactttggtccgaagtgttttagtccaatgtacaattcaagatcaatttgaatcaaatgtgaattatggagttattattgtaacaaaagataaacaattattttttcgaatgtaaatcactgaaatggcaactctgttcatgcatttgcacttctgtataaacatgctactaatctggtttcttggatacaataaaattggtgctttttgttgtttcttgttgaaggtgtcattccagctgtagccgttggcttagcagaacagccttatccgctaatgctgcgtttcgttgcagcagattaaaaaaaatcatatttatctatttttgtatttaaaataatcagtactcaattaattatacactaatagctcatttgatatcttttgaatcttctcctttcttgagacattgttttggagatggagatgaaacactagctgactttatacgacaactgcacacattcgtcgtatgcttcttgagacattgttttggagtagttgtggaccttttttccttagatttgtttcggttattttgattacttttctttactgaccgtgtgcatcctaatagatacagaagtggatagtgtaatttcatttctcaacaaaatcttactattatatgatggaaacgaaaaatgttagcaacagatgatgaagtaaaactaaagatagtagctgcatttttttttgcagccccatcgtttggttgatttgaggaaaaagcgaaacgacgtatgtcggtgatatgggcctggcggtatgcgaagtatgggggagtcaccttcccgtccatccacgcggccctacagcctggccctcccccaacacctcgggcaacgcagaggcagccagggggcctcggggtgccacgtcacgcccctcgagccctcgcgttgcctcgcctcgaggccctcgcccaaccgccacgtggtgaggggagcgagtggggcggagacccaggctgaaccatcatcaatgcgcggcgcgccaaccgtccctcaccgcatttaatgcagtaagggcggacgtgcggcgctgcccgattgacccacgtcaatcgggcgtgaccagactgtgaccggcctgtcgccggtcacgtctgatcggacgggcggtagtgcccccacgttccgccctgtacccggtggagtgggggcaggtatgccccgtcccatcgaagcatcatctagagccctctccacatgagatggaccgccacaagtctccattcatttaagagggaatgacaagggtgtcccccgtgtcaggcggggggcggcgttgggccccactcgaggacggacggctgcttagcttccgggcgaaggcacgaatcgtggtccggtctaagcggagtgggtccccctttcgtgaaggagtaggtagaggtggtgtatgtggtatccccttgaattataaaaggaggaccttgccaccgaggaaagggacgactctcggtgagcctaaacctcaggggaagaagagcgagagtactctctggagtgtaggaacctttgtaacactcagccataaatcccacacacaggagtagggtattacgctccatagcggcccgaacctgtataatcccggctctcgcgcgtggtctcagaaaactctaggctgatacatgatcttgatcagcgcgccctttcccccggtcgaactcataaaaggggatctctcgatcacccgctagagagggtcacccctcgataacgtatttgcaaatgaaaaatagtttgcgaataaaacttttatatacgtattcttaacgatataagagcaaagaccaaaaatatactacaataaaaaaaaatcccaaaatcaactccgaatttaaaattgaaaatacaaaatttgactcataagctttaagcgaaaagatgagccgttaatcttgattccggaccgctggttgggagatggacggcgtagattgcccaacccgcaccgcttagccaacgccccgccgacttggccgcgctctcgccgccttcttcccccttgtcgccgtcgccgagccgcctccgcctcaccgtgccgaccaccacctctcccaacctcgccgtcgaatcctctctctctctctcgtctccccgcttcgcttccacctcgcactcacactcccatggacccctccatgcctccgcctccacctcgaaaccctaacccctcctccgcctccatgccgccccccccgccaccgcccaagttggagccggcgtccaagcccgaatccactaaccctaactcctccatgccgccgcctccgcctccactcccggtggagggtgcgagcactagctcctctatgcctccgcctccgccgccacggcccgcggcgccgccgcagccggaggtggagggggcggacgcgtcggccgaagggggcactagcgctagcgattccgaggcggatgaggcggcggggaacttaggtaggggctccagggatattgagatggcggaggcggcggcgccgccgccatcacagcagcagcagccgaggccgcgtgccccgtacgccatacccgagtggagcgccgcaccgggccaccccttcttcctcgaggttctcaaggacggcaccatcgttgacaagcttgacgtgtcagttgctgtctctcttcacccttagcatgattgtctattgtctatagaacaattgccactacctctttgctcgtagcctcatattttggttagcgctcggggttatggattgaaaatggcatgaatgtgtctgcttttatattcatgtttggtgttacatgtgacaggtccaggaaaggagcttacatgtttggtcgaattgatctttgcgattttgtattggagcatcccactatttctcgctttcatgctggtatgttactatgctttcatcattgtcttttcaattatgacataggtaaaactgtagaagaatcaagattcaaaatcctggtgtttaacttagtggctagcttgcatgttccgaatggttttgcattcttaaaaattgtcttgtccttgaggggttttgttgctgatgttagaaaaggaaaatggcattcagtctcaggaatagctttttgcatcatctttttaccaattgatcatatatgaaatgttgacaaactggtaaccagcctgtccttgttcttttcacattgaggagaacaaagcataattgctattcatgatgctgtgatttccgtgaacatatatgaaatagcattgcatgaggaaccgatgaaacttacccagtaaatttggcttgaaaggttaaactttcacttcaaactctacaacttgtgaataccttcagccctaaatagcagaaaaaaaacacaacaaaattcaagaatttgagagaccaggttatgagattttcttgtgcagagctctattatttttaacttacaaaaacattttatttcaagtgtttatgtatgagcacttgttgcctttcttgggaggtatccgtctttaatattcgaataatctctcaactccagtgtcactatcatagtggacattatttgctagctagagaaggaaatgaatggattaggtaaaattggtactattagtttgtaatatagaatattttcttgtttagtgcttaaagcaagacattcatgaactgcttttatgctattttagttttgcagtttagaaatgatggggaggttttcctttatgatcttggaagcacacatgggtccttcatcaataaaactcaggtaatagtcttctgtcatatatcttacttcagagaaagcttcccccttatcaaagctcaacatatctttataccttaaagctttataagcttttgtcatgagtgcattctgtcgttgctcgtgctcttttatttaaaaagcagtgatttatgtcagtagtttcttatcctgttgcgttttagttccatcatttatctcaaccttattgtatcgcattgtaaattttaagaagtcacctgccacattaattatttatatggaacattgcagtaatatttacaatttgttgttcatattatattctctgatgttatttgtgaaaatactaggtcaagaagaagatatatgtggaaattcatgttggagatgtaattcgatttgggcagtaagtgatcttgttaattaattgtttaatttttttgttgcctaattctatggaacttactggcccttctttccttaaatgtttctattttttttattgagttggtgctgttgttacttagtacaattggactaatcttctcgtcgtatttgccagatcatcacgtttgtacatattccaaggaccatctgagctgatgccccctgtaagattcatctgttctttcatattttcgttaccttatttggatcgttcaaccatccacaattttgtcagtgttattgatgatgtagtatgctgtttattcttatcaaattctgcttttggatgtcatattgaaatgaagatttttttctaccagttaggcatgttcgatttcttggcagtgatcttgtaatactttctgaagtagtgccaattgagtgtggctagtaaaatcatagcatgctatatcagatctgtgcttatgttggatttctttggagctctgtttctttttgagaggttcctttatgcaatgggtcacacctataaaagcttctaaaatacttatttttttccagaaatagttctcagagaaattcatttcaatacgaagatatattatcatgtaacaagcaaacatacatgaagttgaactagttattcttcattctaacttcactttgataattttaactgttaaaaacctcataatttgatcatgttctttgttattacgagggacattttcacatccagtgaatagtccagtgaatcaaattaacctatcctgttgtttaaagttgcttgaatttacgtatttggcaggaaaaagatatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8042 - DNA, 22217 bp, Oryza sativa
  unsure (1)..(22217): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcagggtagcaagtaagatgcaagatgtggtgaagaaggcaccatgtaaagacaagaatcgactttgctacaattgccgtgcaaagggacatattggtacaaattgtcccatggttaacattcttaagccaaactcctcatttgattatgctttgcttaggaaggccaaaaaggacatttgtgctactaggctgattagttcaccacatactagcacaaaatccatttgggtgcctaagtctcgtgtgacttacctttatggacccaatgttgttagggactaaaatgtgctaaaatgagaatataggtacatggagaggcattggaggtatggctcatgcaagaaaaggtggatctcaccaagttcggaatttggagccaaccattgcaaaattcacatcaagaatcaatgttatctcggtaacatgtatctacattgaattatcttttatataaccttgtgtaggctgcattacattctcatagaatttaaaaaattgtattccttgcatatgagaaagacctcatttatgcattcttgagcaagataggttatggtgtgagtgtttagtgctcattcatattcatgcatatcacatccatcatatgtgctcaagttgactaagtgctagttggaaatttcaaaatatcctttttagccaaaagtgaaaattttgaaaagtatagcctttctatgagaatctaattggaaatgattttaaagtatgtttgaaatgtctcttaatacttttgtatttcaaagaagaactaagtttcaaagaaaatgaatttcaacccaaaatgtagttctaagtatcttgttttggcttttaacttcaaaattttgtacaattaattctaaaaggaattttaaagtgattttaaaagtaaaatgatagtgttggtcatttcaaacatttttggtattcaaagtttctctaaaaggccaaccaatcaaaagaaatttagattccaatcttgaccaaaatactatctagaccataaatgtccacctattagcacttagatgacttctcattgtaggggttgcataaatgcatcatactagctcaaatgagtacataactttcattcatattcatttcactccaaaaccatctcatttatttgtgtttgcattttggaagaaaaatgtttaaaatagaagcttgtgtagttttttgctcaaacttggtcttttcttccaaaccttgacctcatggagttaatgtgttaaatacatcaattgggagtggtcttaatcatatttttatatcccatgctttcaaaatatgaaagatttcaaaaagttggatttatagcaatttcaaatagcctctttggtcaaaattcaaaaaactcatttaagagaccaaattttgtgaaaatcctctcaaaagtgcttcaatatgcatttcaaatgttttgcaaggcttttgaagtaaaaatttccatttgtgaaacaaaatagccaaaatggtctcaatattatcttttatgatcttgcttttgctcaaaatgatctatctccctaaataaaaatctattgcatttttgaaaaagattctaatataaaagtttgaggattcgtcattccaaacttttctctagttcaaagtttggaatagggttgaaataggcctggcccttgtggctcctcaacggagacataggatccgtggatctgaacttcgggaaacaaatcacgcgtctcctctcttggtttgcccatttgtgcattctctcatattatgcttgagtttgtttttacccgatctacttgcttgcttaattgatttagttggtgaccttatatcttgtttagataccttatttgtcaccttttgattcatatatattttgtttatttgagctacaagttcatagctagtgttttattccattatccgcctaacttttcagttgagaccgaaacttccaatctcatatcggaagttcctatttgaaccaaaagttctcatcattctaatatgctatggagttgtgataatttttaggaatgcctattcacccccctctaggcgacattaaggtcctttcaatcttaactaattgaaagagcacaaataaaactgaagtatgaatcggagacaagagcacaagaacacaagaagaaaaattgataacggaaagagagggtgccgtcgtcgctgccgtcgcagggacgccggtccgccgccggctcccctcccgctggatccgacggaggggaggccgtgccgccatcgcctccctcccctctcgctggatccgagacgcatctgggacgccagatttggtccgctaggtcgccgctgcctcccctcccactggatccggcggaggggaggacgccgccgccgctgggccgccaggccgccaccgcctctccttctctcccactagatctggtggagggcaggaatcgcccctgcacgccacctcccgccgccggtcgttgctgatgggcagggggagtccagcgccgccgccgcgcggaagacgaggtcacgaaggggagacgacggggaggggtgccggggcaaggccactcgacggcggcgcactcacccacgggcgagtgcgcacactacgagagggcatgcgccggcgtcgtcggttttcgcttttctggcgagggggcgagggggtgaaaaggctagggttttcaccagcggctgggagggatggggtttgtccctctgacgtcaccgcccgatcgtccgatcgaaaccctaagatcggacggccggcattggctggactgaatccggcccaagtggaggcgcacgtggggctgcttccccggcccaggcccaggttgcagcctggggaggtgggaagcgcccgcacatgtacataaaatgtcgtgggccgaccggccaggccgagaaaaagtctgttctaggtccctcagcaacacttttttgtcactatacacactccgtaatcatccggtgcaacgcacgggcacttttcctagtaaaaaacaaaatttgcttccaacaaaaaaaaactcgttcgtccgttggtcctcgtggtccgactccttctcgtgctcgagtcgtccatggctccacacgggcacctaatgccgccaccatattgatttgccttcccatgtgttttcttctctaattaattgcaaaaagcgattctccactccccctcatccttttccccatgattttctttttcaattcagctttaattcgccagatttaagctccttttaacagttgccaatgatggttggccaaagatcttgcctcagccatttttatcccgagttttgtgggttcacttcgattttgggaaaacggaaagagaagatcgagtggatcaaaatccctcaatctattttggaagatcctagatttgatggggatgatcggctcctgcatcgtacagtcacaaactgtcttctggatgttaagagagatcggccgaacaaagggagataggtaggagacaaacaccttttcaattataatatatagcgatcctaatattttaatttattactcatcacctaatagctattgtatcactgtaaaaaacacttttacccattgcaacacacaaacatatttatagtataaaattaaagcaaaaatataaacagtttaatctcattgagtttttctggttcaggaaaaacagaaaacaccacaacactcagttggtttaaaagttgaacttttgggctctttcactttgttgccaaaatcaaccttagtaaaatttggtaatgccaaattttggcacattttggcgttgtcaaattttgatagctttggatgtgtattagtttgatgccttttcaaacttcagtagtatttgtgagcggaagcttctgaaatgctaaattttgatatggtaataatttttagtttgttacctaaaaatttggttacaatgaaatttaaaagaattgaagtgcaccataaggtgagcaagactttttttgtttaattggaaccattgcgaatttgtcatgttggaaaataccattagtatacgcaattttggctgggtaccactgaaattttctaaacttttagagtaaatttcacaaaactacacatactatgaccaaattatcacaaaactacagatttaactcgttgtataataaaactatagatttaacatcaaacttatcagaaaactacacatttaagatggagtgtcacaaaactatataattagtaataaaattaacacaaaactggaaccaatttagtgacaaaactacaatgtttatagctccaacataacaatagtgatagggattcaaactctgaaatacgtagttttatgttaaattcaatattaaatatgtagctttgtgatatttggccttaaatctgtagttttgtgataaatttggtgttaaatctgtagttttgtgatagtttggtcaatcattgccgaaccctcaaaagaggtgggatgccgctgttaccttaagggtaggaaggaaccgaggagttcatggcactaggtaactgcgtcaatcatactactcttgcccttgcctattgaataacaaaacgaaagatagttcgggccatgccttgtctccattgggtagcgctgggccacgggtcgacatgagcttctctttgctagttcaagttgactagagccggccaatggctagaacaagtcgttcaggatttatccttgctaaccgaggcatattcctttcgatcgatagatcatcaatcttctgcgtctctatttcttgtttccctggatggaggggatgaagagtagaggtgaggtccctggacagcaattggatacgcttagcaccctttaacgctctttggctcatgtagttttgtgaaatttactcaaaattttatccatatcatcgccgttcagttttcaatcattgcagttagatccatatcttctcttccatttgtggcccacgcctcgtgaatgctgtcgccatctccaactcgagcatcggcgccaaccaacagcatcaatgaggtatagctccttgagcgcacgatagatgggagagcgcatagttgtgggaggatcctgtcctgtcattgaagctgaacgcccgtcctcgagctccccaaactgcagtggcgacgagcaagtcccgcacccacgtcgcagccgcccttcctgcacccacatcaccactgcccacccagtcactgtcgccttccccacgtcctcctcctctcctcgccgacggcaagagcttcgacgaggatggatccgctgtccccctttcctcgacgagtcactattgtagccccgctagagaagagaatgaatgagaatattgtcacactctcacatcttgtgtctccaattcttgtagaattatgcaatccctcttaggctgtattcttcccccctacttcgcaactcacctccttttttcacgcgcacgtttttcaaaccgctaaacgatatttttttcaaggcagaatttgttatagaacactaaaaaaatgtggtatttgctgagagacatcgtaaaaacgcgaatttgtctgaagacactcgaaaaacatggtaatttaccagagtacaccatgagcattaaaatataatattcagttagctgaggataaagaaaccacataaattgtccattttacaccgcttcgccgccatacaccgcccacgcatggggagggggcatccctgccgtcgccgaccatgccgtctctagaaggcagcgactgcgcgactgtagcgtcacgcggccgtggagctggagctctcgctgggcggcgtgatctcccccaatgtcacatcgttcgacctaaaggcggcggtgtgcagccacgggttattcatgattgcgcccaaccattgggaccggacgtcacgcgcgctagtgcgccccctccgcgtcaccttcgaccgtaccaccttcatcgccgtctgcatctcccgccacccccacgtgcctcttcgatgtgttcctcgtttctgtcgtcagtgcgctcgatgccccctccccgctcgaccagactgttgatatttcttaacgacattagtagaaatataattcccagtaatgacgtcaaaatattattggtatatttatggctacagatatgatccgcaagcgcacggatataacattgtatcatttcacccagaagtattccaaggtatcgtatttatttaatcccaagggaagatatgataagagagaactatgctaataatttatatatattacttgtatacatcaaggactatgcaggggttaaataattcaaaaggtaggataaaggtgacacacagaaaaaagaactaagatactctcactaaaatataatctaaactaagtggagaaagaataagaaaataatttattcatgtacttctaatatacaatcatttttagtttacacttcctagtatacagtcatgcagccaatacccctaacagtgccctcctagtgttttgagaagccacccctgattgtcgagttccttatgataacctgtcatggctatccaaccggggttaaatacggaggagtacccttcctaggaaagtttcttaggaatatatactaacgtggaggaatactcgtactgagctgtcaccatcagtggcccacctctactgtcccgcagcatatatatccagataatgatacttaatgatctaagcaccatgcttacattattaaatactactctgtatccatgctacacaactatatcgatacaagtataaaataaaatcgatactcagataatataaagaaaataaaataccaaagatgtataaagaagaatattctattaatttgataagtcttacaaaagaagagagagaagcttctagagccatatccggattctccaaaagactcgaggactaagaaaactattctatttctactccactagcactagagcactaactaaacttgagagagagctctttgatcttcttcttgagtgtgtggatgaagtgaggaggtgaggtccttttatagactcccattgacggttacagcggtttggaaatgtcggaaataccctgcaaccgtcattggggaggcatctggagcatccaagccaaaggggagagccaacggctgagatcagggttcggccgaaacctggacttgcccaattggcctatagtacggcaggtgcgtctcctaatgactcctcagtcaagtggtgcggtggtttggcccaattgaagttatcttaataggtttggaggcccatccacccataagtctgcctctgacggatttcgattaattattcggttatgttccgtcgattctcctccatttatgaatgcttctcctgcacatatgttagtagcatagcacatagtggaagtagatattttatttggaaattatgcattacaaacatagctattcttctttgattgaataatattgacggtcaaaattggttgataacaaccgtcaacacagacctccatcctcgaatggacggagttgccgtcctcggcgagaacacaccgcgacaaacggttgtggcagatgacggatatgggcacagcgacgggcggtgaggccatattttgtgctaagtcgaccggatttgatcctgtcagcgaagatttgtctcaggggcaaaggtgccattttgtgaaaattctctcctaaatagcaggaaattataaaataatgtgtatagtgtctaccagcaaattaccatatttttttagtgtccttgagcaaattcacattcttaaggtgtcccgcaacaaagactatattctttgagtgtcttgtagcaaattttgtcatttctttcaaaagttttgtatacaaaagctaccttaaaaatcatatcattctatttttcaagattttttagctaatactaattaatcatgcgctaaaccatcatttcattttgcgtgcaatgagagaagtgttcccaacttcaactagcgaacacagctttaagactactttatagcaggaggggttgcataatacgttactgtagaccaaagtagaagaagagtaagaatttgtagattttttttagcatctcgctgatataatcgcgaaaatgaactctgctcccaacccttgttccatttttactattcccggagaaatccaccaaagctgacttggtatcgccggcgaatgcccattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagggatttccagaatggttggccgccaatgcgtgcctctctgtgccacaccgcaccacgagaggaacaaaaataaaaaaaaaagaagaacaaaattaggaaaaatacataaaaagaaggggaaagcgggaaagcagcgccgcgccgccacatgacagcactacgtgggtcctataggtacctgttaggagctgtgccgacaggtaccttgcatcctaggctcttggatccagctgaacggacggacgagataacaggcaccgagaggtatcagtagatacgaaggacggtaaaaaaaaaactcatgagatatagtccagaatgtaattcacagcaaaagtgctgcatatgataaatgcacaactaccacctaatggtgattaagtgccttggattccttactaatgactagtaatgtgtccgtactaacgctacgatgatattttgtattgcaaactaaatgacccaaaaaagataacattggcaatacaagtgttcagatttctttgaaaaccgaataatcaaataaatattatatgtatttgaaaaccaaataatcaagcaaagatattatatgtatttgtgtgaatgctaaatgatttaccaaataaattcattataccgtaaaattttagcataaaaaaattatgcttaaacttgcaccccgaagacaaaataattcaaacgtcacaaaatttttgcccaatatagtagattgattttgccaaagggagtagtataaatctaacaaatctcacgttgcttaacaaaataaaaattaatttaacaattccacatgtatataacatctttcaaatttcgccacgcaatttgcatacaaatagttctggcctgtcaaatttccctcgagaaatttccactggaatttcatatataatcaacctgttctctgcatatattgactgtggataagcatgcactctctgcatttagaaatagacccatcaaaggaaaacatttatttaaaaaactaaaataatagtacaaataatgcaaaattaggttatattactattagtcaactcctatgacaattattaggccgaatcaaaggattgtgcgccatgcaatgcatccagaacttttttgaaccattaggagtaaactatatttttaccatcatgtcttttacggtgagtaatgaaagatcaatacagggaaccaaaattacctatctcaccatcagttttactcttctctgaattttttatcacgccaatgcttgagatgcaccctaaattttcatttgtgattaacaaatccaccttactctttgaactcatacatgatcagttggcaaaacacatcccagtatcacctagctagatcacgtgtgccgaaaatacattcagtcacttgtaagttctaactggaagacaacatgtgtaccagatgaataacataaaaaggaaaatgaagaaatataattcaatgttctatcaatataaactaaccttaccccgacaagatgcagcccaactgctaatgctgcacacatgtcctcacaattgatccaatatttcctgggatctatgatgtacaaccaatgattattaagtctgttatctactctccacattgcaaaacaacaaattcaaggatccgctggaatcaaaattcatatagatagatattttatattcctacagagaattaatatgcccaatggtcaaatatcagtttttgaaactcctataggaaatgtaaccagtataaattttctccatctaaatttcagatagaaccttgagaggcattttgtagcatgaatacaaactacacacaatgctagtactgaacatcccacattcccactggggctttcaccatcacaaaatacagaaaagccacggtaccatctgactggaagagtgtcaaccatgcaaggaatgacaaaagccacaaaaattgcaggcatcaatgtttgattctgtcagaagtactcagctggcagaggctatccaatcaggacatataccaaactaaacaaaattacagtcaatcgaaattgctggagccataaggttaaaagctaaaaatgtagggcttgctcgcccccagctttcaatttttaataaatgtacatttgattttctctaagaaacaggaatgaatacttataccaagtgagctgaatttcatggctgtgtcctcatgatatcacaatcaactgaaatcaatgatacacaggaaaaaaacactattgggacgaaatagttttgcacaaggtaattgacatggagtatatgtatatgacattataaggaaaaataacaaagttgcagaaagaagcatagttgggcaattgcaatatggaaggatagtgtcagggtctcgggggtaccgatgcagtggccggcggcgtggaatccgtgcgtaacgtcagcgacgaatcgcgagcagggacgcatccattggcgtcggaatcgggaagatgccagtcccgacgggcataggactgccgccgaggcggtactacactgcttgtgacctgcataaaggccgcactcgtcccgatattgagaccttgccgccggcttggagatggtggtggcggcacaaagttagacctatgctcatatttggctgaacttaatgtgatgtggcctgaagataagctatataataagggtcacttcaggtataacaagtaccacaaattcccaaatattctgcagcataacttacttgttcaagtaagaacacagaatacctagagatatataacgcggaagtgaacaattaggcataaaggaaagcacctgttcggcggcaggaaaagaagttataaatttttgaatatattacgagctttaaagaaatctggattgcttggtgagctataaaatttgactgaaacacaaccaacgttcctgcaataaagatagcccattgataggacaagggttattaagttagcaggatgaaaatttgatcctgatctttgatatctgaggatgcatgcaacaattatctatttctcttcctgaaatgattaaaaatattaataggggggagaagtgcatgattacctcattagcggagaatttgtgagtccggttacaattccagcaacatgacaatattcaaggctggaaaaaaaggagatccattattatttaaaacaacccctgacaacaaagtgctttgcttttgccatacaaagcgcataattttgtggcttaatcaagttgagctacagaagcaagccccagtcttcaatgcacaaaaacaatgtgaaagtcagatcagagcaaacaaaactcaaagcaaagcaagtatgaagcagtggctgaaccgacatagatggaagaatgtatatgtggtctgagagtaccaaataacataataagtgggttacttgcagtttagctgacctggtgtaggcaaatcagcgaacagcttgcatacgttcaagagagcaggaaaacggcacaacaaaagggcccaaacgctgtggcacggtcagagaggacagaggccttctgctcagctgagcgaagtgccgatcccaatcctttttcctcttcttaattcctgtgcctttaaatgatagtaatgtcaccaagcagaccttttcagctttcccaattttttgcagtaaataagcaatcttttaactgttcagagaataaattgaaatgctctaataggcgacaaatcatgaatttggagtaataaaaaaaatattgatttgggaaaaagtgagaggcatacgaaaatgtgttttctgttctacatgattgcttcagaatttgtattagcagtataatagaaaggcagttgtattagcactatatatgaatttgtattagcactacaaaaggaatattggtgagtatttacctgtcccggcggacaattgcggtgttgagcatcctgcgtttgatctacatttaggcgaggcaagtaatatctaaacaagaaatttgttttgcatcaattatatgagaagtcagttatctgagaagccaattgatcaatgtttcgatggaatggcatgggatcgaagcatgaattagtgatgaactaacctggttcggcgtctgaacggcactgtgaggacagggcgggacgcagagaggacgcgcatggcgaggattgtgtggatgcctgactgtgcggtggagatgaggttgctgctgcagatcaatcgccgaggacgaccttggcaggtacatcacggcgcacatcgagcacgtcgcggtgactcagcgtgggacttcgccggtatgatcttgaacgacggcacctggcggcatcggcggagcgtgagatgtcaagccccagccagattcagagcttgacaagaacaatttcagagaaaagaggctaagtagctaccctagtgggattaaattgaaggatttgcactgaattgaagagtaaacagtataaggaaatagatgggcaccgcaagacaagagtaaagtaatttagggttcaattgttcgatacagacattgcggcggtgctagcttataaagggggtcgctaatacaacgagacaaaagagatgatgtcaacagtacggcaacaggggcgtgctgtagacggtccaggcgcatctccatcgtccgatcttcataatctccagccccaagcgttatcgaataatcccagccattggataactgaacttgccttctcttccagcgttcaaacatgacttcacttcgtcagagttctcacattgccccccccccccccaagcacccatgtcctcatgggttaaaagcaggaaacactttggagatgaaagcagcatcttcccaagttgcagcagacggaggtagattcccccattggactttccattgaaccacaggtgcattgtttctaggaatcagcctgcgttccaaaacggccgttggctgagaaagaatgttaccgtcatcatcagtgagagggaggccaggttcaggaaccacttttggaccgatgtgtttcttcagttggctcacatgaaagactggatggatttgagaagatgccggtaacagcaatttgtaagccactgagccaatgcgttccaagacacgaaacgggccatagtatttagaatgcaatttcaaggaagaatgtaaccccaaggaattgtgacactaaggctgcattttgagataaaccatatcgccgacagtcagtactcgttcactacgattcatatcagcaaagtgcttcatacgtgcttgtgctttgaggaggctagacttgatatcagcagtaataacagattttgtaaaatcaaaggtgttttttattattattctgtgataaacaattggcattggagattattggttttgttatttggaatttattttcgaagtggattttggagatgattggattttacaggtgaatctacaggatactgctgttatttcatgtgaccggtcagaccgggctgtgtatgccggtcagaccggcggtgatcgagcggttggaccggccagcccgcggtctgaccgaccgactctgtgtcagtttcggtttcgggttgtttatttggatatccgtgattgtttcatgattatggcttctagatggatactatacgtatgtaatactgttgtttgctactaatgagtcaagttggagatagcttggtctcggaatatggtttctttgtttatttcatgcatgtgtaggtgactcgatgcctcgagagagtatttgcggtgatggaccgggagtcggcttggggataagacgacgtccgtggtggtcagagatcatgcgggatatttaggctagagttgatgcacgtggttgatggagattccatatagcatacgatggaggtattgtgtgcgtatgggttgcagagtcgaatttggaaggagtccaaatttggtacgattggttatgtaaagtttctttcttgtactagagggtttcctaaagtgtttaggattcctagtatgagtttgattcgtggctttaggctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaaatacagagagaagtaataaagtcgttatctactttaagagttcttcgatttgtgtttcaccggatttcggcggtccaaccggcaatatactggcggtcagaccggcggcaagcggcggtcagactggcggcatacgggcggtcagaccggcggcggcgacaggcgcggcaggcgacatcggcggtcagaccgggtgatctataccggtcagactggcggcatccacacggtcagaccgacaaatcaatctcggtcagaccgatctccgttgaattcgagggtaacttttatttccgctaaaagttttcggtttttgggtataccaaccattcacccccctctggttggtttagttcttgtgattcgatcctacagattttgcttcttccttgttacgagcatcagtgaaaagagatggagatagcaaagattcagctagcaagggaggtgggaccccatgtattgcctggtaaggagtcatgcccaaggcagtgtggaaggatgtattgtaccaccattcagcgtaggccagcagtgatttccacttcttgggtttagtgaatgtcatacaacaaagataattctccaggcactggttgaccctttcggtctgtccatctgtttggaggtgatagccactactaaaatgtagttttaccccggctttctcaaaaacatccttccaagtttgactagtgaaaattatatctctgtcactgacaataactgccggaagaccatggtgcttgtaataattttccacaaattgagtaactatctggtcagctgtgaatggatggctaagggcaacaaaatgggcatatttggtaaacctgtccacaatgacccaaatgacatccttgttatcagatttagggaggccttcaatgaagtccatagaaatgtgtgtccaagccatctcagggactggcagagggtgaagtaacccaggctgcagattatgttcagacttgtttttctgacaaactgggcagagtttgacatatgaggcaatatccttcttcatgcctggccaatagaaaagtaacttagcacgttgataggttgctctttcacctgagtgaccccccagagcagaatcgtggaaagattgttgtaactttgctctcaaatcagtaccagcacccacatagagacgattcttatatcgcaagatgccaccagtcagagtataagaaggatggccctgaggagtgattctcaactgagattccaatgctgtgcatttcgggtctgttgcataacttgccaggatctcaatgatccaagtaggaacaataatagtggtagaaaaccactgagcaacaaaaggtatgcgagataaggcatcagcagccttgttttctttgcctttcttgtactctattttgtaattgtagttgaggagcttgattagcaatttatgttgaatcccttttgtaaggcgttgctcattaatgtatttgaggcttgcttggtctgttcgaataatcagagaagtgcccaagaaatagtgcttccactttttctgcttccaatatagccaatgcttctttgtcataagtagagagtccagctgctttaggaccaattgctttactaaaatatgccaaaggtctgttgttctgcatcaagacagcacccaggccggtaccactagcatctgctagcagtataaaaggctgagtgtaattaggcattgcaaggactggcgcatgagccaatttatccttgattgttgcaaaggcttgttgctgctcatcttgccaagtgaatccagttttcttcaaggcagtaaatagtggtttgccaataagaccaaaatctttattgaactttcgatacttgtcgacgtttgatatcgtgatttcagtatttgcatagtatggggatcgttgataccagagtatatgcgagattgaggtaaaagagatggagacaatatagtcatacactctccctagcccccagccttgtcgtcggagaatcgttctcggaggataaggctcttggacccttgacctgccttggttgaaaaaacgcttaccctagcccccagccgtgaagttgaaaaacccaatttccgattaaacggcttggttaatacgcacggtgagaactcttacatgaccagatcttacatggtagtttgtctctgcatgatccgacaaggccttatccgctctggacgtccccagccgaagttcccttaggttcctcagaggccttgccaggacggcataaagggacagtaggattggtttcaactctaggtgtcgtcgtggcaagggatctctgggtaaaacacttggcaatatcgtgtacctgatatcaactttgttggagtagaggtagtgggagaatcactgcacctctggtcgaggaccatatagtagtcgtaactcaaccactagaagtggatgtagtcggaggaattgctacactgctggtggagaaccaggtagtagtcgcaactcgaccacttaaagtggaaataatgggagaatcgctacaccgctggttgagaaccaagtgtagccttaactcgaccacctgaagtggaagtagtggaagaatcgctacaccgctggtcgagaaccaggtgtagccttatctcggccattagaagtaaatgtacgagagatcgctacgattgactggttgagaaccagtgagtaggtgtctctcgaccatttaaagttggttcgagggccgctacgctgccagtcgaagaccagtcgtagttatccctcaaccatctgaagtcgtggtacgaggaccgctacgctattgccatagtcgtacctcgaccatcagaagttaagtcacgagaggtcgctacgtcctactggtttgagaaccaggagaaggagtctctcaatcacctataggggtgcctaagttggtttgttacatgtgcatctcatgtggccagcctgactcacatacccaacttatagcatatccggatgtttgctcgcaatcatgtcgggtgatcaagccgacaacgttcacgagaagtaaagctagtgggagtatcgctacaccacttggtcaaaaaccaggtgtagccttaactcgaccacgagaagtaaagctagtgggagtatcgctacaccgctggtcgaaaaccaggtgtagccttaactcaaccactagaaatagaggtgcgagagatcgctacagcttactggtccgagaaccatgagtagtctcatctctcggccgattgatgtcgatgtacgagagatcgctatggcctactggtccgagaaccaggagtagccttatctctcgaccgattgaagtcgtggtgcgaggaccactacgctgttggttgaagaccagtcgtagtcgtacctcaaccatctgaagtcgtggtgcgaggaccgctacgctattgccgtagtcgtacctcgaccatctgaaattaaggcgcgagagattgctacaatttactagttctcgattatctctcgaacgccaatggaagttgcggtgcgggagattgctacgattcactggttcgagaaccaacgagtagaattatctctcgaacgccgatggaagttgcggtgcgggagattgctacgattcactggttcgagaaccagcaagtagaattatctctcgaacaccgatggaagttgcggtgtgagagattgctacgattcactggttcgagaaccagcaagtagaattatctctcgaacaccgatggggacgctagagttggtttattacatgtgcatctcatgtgactagcatgactcacatacccaactcgtagcatatccggatgtccacctgcaatcatgtcgagtgatcaagccgacatcgttcgcaagcaattatccgttaacaacccttttctcgaatagcccagccatagttggcgctatgagataggtcgtcggtcttcgttggtaggttgggtgcgacaactctgcatttgtcgagaacgttctcgataatggggtgtgctcgaccataacctactcgagtgctcaattgttcctgaaaaaaatattttctagaagacaagttatatagcagagaatatcgagtatgtactcaaaaacttgcataaatcttctagtattatcatgatatatgtaacatcctgaaaatttactattttctaatcttgcatcatgctgattcttatgttcttattaactttttaaacctaggaaaatataattagagagacctcgaaaaattaacttgcgtagaatctctctttgctatttaaagtctttcgtggtttttattctaaaattgatcttattaaaccaaggtatttactttgatttgattttgcaccttaaaccttcttttgcaaaattcctttaaaaactctcttaagaattatggtccaagaaaccttcccatattacccttgaacctaaaccaccgaaattctgattccattagaattaagtgttaacccatcctttgattctcgatcaaaatatccaaattcctctttttgatcaagctaccaatttaatttctgtgacttgattttcttctcagcacaagaataatattattataaacattgtgaataattgctcttgtgctaagaagaatagatttttattttattcccctcttccaaattgattctctattagccacaaataattcttcaaatactcctactatcaaatttaggattcaaatcctatttattttacctccaaccattcccctccaaacatatatatattgaggaattagattgttaattcccctctcatttgagtgcattaaattccaccatattccacttctaaaaatattgcactcaaactagaaaatatctcttttggaaattagatccaaatataatttcctttcaaccttccctattcaaattatctccaaatatatttttctttcaaaactttctagtcaaattccttccaaatacaaattctcctctaaatcaaattatttagtctccatgaaatattagactttcttccttctatgtttgggccgaattccccttttcctcctttagctttcctcagcccaagccggcccaacacccagccgagccgcctccttccccttctctgtgggcgcgcaaggcgccgccaccgtcgcccacagccatggcgtcgccgcccacggctttgtgcgccgtcgccgccaccttgccgaggccgccaagtcgcgccgccaccgtcgccgtgccgtgcctgtccactgccgccgcccagccctgccgcggccgccacgtgcacgcgccgccgtcgtcgaccaattggaaaacgaggccggcgccgtcttcttctcctccaagctactgtcgtcgtggccaagccgtcgtccgcctcctgaaccgccattgatcaccgcccctcgccgtctatatatagccggcgagcacttctcctttcctccccaccaagccgagccccgagctctctctctctctctcctcccatgccggccattgcccgatctccctcaccgaagcaataccggccaaacccttgcgccaatagcttcgtctcaacgaggggaatccatttcaccactttcccctctccctccacccctagctaggccaccatcgcctctccttttggccacttcaaccaagctcttgcggccggcgttccaaccattcttctcactctctctgccggccaccaccttacctaggtatgaaacatctgggaacacgctttgccgccgccgtcgaggccgttccaccaccaaagcaccggcgccccctctctctccctctctcttgttgctcgggaggaagaaacaggagaagagaagaaagaaggaagaagaaaaagaagaagaagaagagaaagaaaaataaaaagaaaaaggagattgcctgacaggtgggccccccaacagtacattttcgcatttttctagatttaattcaaaatccaatctttagaagcccatatctcccaaaccgtagatccgattccgatgaaacttggatctaaattcatctaaattcaaaatataccttttgataccaaatttgctattttaagattttatttgaatttccttaatttattcaaataccatttgaataaatatttgatttaaacttataattgaaacttataccttccaaatatttccttttattttcaaaagaccctttagccataaaagctgtcggttagaactttacaccttctatgtggacgttcgtgcgatctactggccccgacgtcgaacagttggttgtaaagcccagcaaacacccaaaccctagccgatatttatcctacctcgatatcggcttaaacaaatgaaaccttagccagcctactatccatactccacaccagttataattacctatatgccactttcctcacccccatcatatattctccatccacttagaaccccgcacataaaatatagagttagccgatatgttatcctactccacattcaacttccatataaccaaaccttaggtattatactacctaaacctaccactagccatataccatctaaaccagttcaaatatccaatatacatcctatcccctcaccagtcaaagccttcacataaattatgagcaaccttagtttgcttgatccactctccaccttaaccttcaaccctttagaacccatacatgaaatactagtccaataatcccaatgctctataaaggagatcggctatatcttaaaccctagccctcctaaccgtttatctctttcttgctattttatggcgtttattgaatttggttcttcctctttttcagtagagtctattatatttggatgacaacccgtggtatttcgagcagcggataatcaggttgcttatcttggatttatttgcgttggagcaaggcaagttattattcctcccctttgagcataatgatcatatattcttatatctctattctatgcattagtcatacatgatttcaattgtataaactgaatatagcaaaccagatatgctagcttttgcttagccctgcctagttagattgcataaaatataacgaacttagattggaacagtacggtagaaaatggttgatttccgggtggctagtattgttccaaccgacataagactacccaaatacttgtgaagaacaaacgattggaacagtacggtagaaaatggttaatttctgggtggctagtattgttccaaccgacataagactgcccaaatacttgtgaagaacaaacgagtacgaccacagttctagaatgggaacagacctagttattatgtt

SEQ ID NO: 8043 - DNA, 11224 bp, Oryza sativa
tatactttgagtgatagtccaggggactatgtcatggccatgtgattttgtaaaccctgattgcgatgacatggtgtcatacaatcagtcctctctaaataccccgggaacgccagaactcctctcggtgctgttaacgttatgttcagagcgtatggggactagagttcatggaacaggtgccactattgttagtaacctaatgctgggccatgactaaagctgatgattatcggcacgtcgtgggctatgggtaaagcgtacatttactgcagtaaagtataaatgaatctattcgaatagccgtgctcacggatttaagcatttgggactcatatggtatttggttagaaacttaattccaaactttattaaatactgttgcatctaaaacattacaggctttcttcctctatattctcagccttctgcaagtaaacttagctctactcaaatattaccatttcatgcattcattgttgattaatataatatagcttgctaagtacgttgtactcacccttgcctcaacccccttttcagagtcaatttggagtcttgccgaagctgggagttcaatcgtataagttagtctcattctaacttagttctcaagcatatattagatagatagtttaagtctatagcaaaacattagaattgggtcatcctacagcttctactgtaatagttagccacaaacttgtaaatatcctattattttataataacatctcaaaatgtatgctatgaagatccagattgttgaacctgtatcaatctactgatccagggcttgatacagttttaataagtcagttaccgaatcattagttttgggacccgacaatataacgagcaaattaaatatcaggcattatgtaaaccgcaaacaagcatgatttatgcataagaaaatagagcgagcccccagcattaaaccgtagtcggcctagcatcggaaatactcgcacaatagatattgtataaaaaacatgctctaggtaaacataataattattgatctgacaatattgtataatctgaaaataggtacggtaaattatatataaaatattacatacctttgtagatacatgccggatgtatctacaaaattagtagattgatttaaaaaatccatccaccaattaccttactgcgtactcgttcgacatcatatgatctgacgtcttttggtatactgcgtatcttgaggcttgggtgatctcgatagtccaaattgttgacgatgatggttccgatcttgtcggggcgcgtatctctggctaggttaaacttcctagatccaaagtagttgaagtatccctcatcaaaaaatccatagtgacgatgacttggcgaagcttgacgaagatcccgatccgtcggagaatgtacttcgttcgggtcatatcacccaacatacgaagttgttgagtagtttgttgttgaagaatccatttcttgaacccatctcgtcgaaatcttgaagcaccaaaatcctcctacctggcgcgccactgtcgacgtttgatatcgcgattccggtatttgcatagtagggggatcgttggtaccagggtatatgcgagatcaaggtacaagagatggagacagggattttgatacaggttcgggcccctgaattatcaggtaataaccctactcctgttggccgaagccggtcgttgctcttattcaccataatcacaccagtacaatatttggggtagcctatctatctgttgtcgacttggcggtctgaagtgctaactcgtagccgacaacatggtagccttcctcctcgaatccgcatccgacgaagtcagagatagcgctagattcctctctttggttttggtaggtaccatatggggttttcctaggcttatctctgatgtcgatatctggtagtttgtcttggcgtatgtaggtttgtatgttgatctattgttccatgtcccctcccctcctagggggccttgtatttatacccataggtgtccccttgtccaagtagaactaggaaaaccaatatggatacaatccgagtagtccttgtcgtttctatgtagaactctggttgtctttccttatgcggaactcctcctatatctgaggttgttcccgtataagacatggtatgtggtgggtcctgccaagatttagtcaattactattaggtatgtggtatccataactctgacaatagtaaccagccaaacctaggaatcctctgagatcagtgacagatttagatacatgccaatctttcacagcttgcactttggtaggatcaattgctaccccttcattactgataatatagccgagatattccacttgtgactggccgaaaacacacttgcttggtttggttgaaagatgatgctgtctcaaaagttgcaaaaccaattcgacatgagttacatggtcagatagggatagatagggatggattgtatatgagaatgtcatcaaagaaaaccaaaacaaatttgcacaaataaggggccagaatgctgttcatcagagcttggaaggtggttggtgcatttgttagtccaaaaggcatcaccaagtactcaaagtggcccatatgtgtgctaaaggctatcttatatatgtgagctgggtgcattttgatttggtgataacctgagtgcaaatcaatcttagaaaagtattgagccccatgtaattcatctatgagatcctcaatgactggaatgggatacttgtttttaaccgtggtagcattaagttgacggtaatcaatgcaaaggcactatgaaccgtccttttttttttaccagaatggcaggggaagagtagggactcatacttggtctgttggtttgggaattcaacaattgctgcactagctcttccaaggcatttttcttgtggtgaggaagacgatatggccttacattgactggtttagcatttgggagtaatggtacagtatgatcacactcatgagagggaggcaactgagtaggctcagcaaaaacatctgaaaatttgtccaaaacttgagttacctctggtggggttgcagttagagcaagcgcagaacattgtggataaggaaggaacaccacagcacctaatatatctttgtgcaacatcttctgcaagttatcagctgtgagaagaagattggaccgaggaaaagtaatatcaggaaaggttattgactgcatcccattgtgatgtattgtaaatgctctggtcttgagatcaatggtgattgggctatgctgatagatccaatcacagccaaagatgatatcaaagcccttaagatccaacaatctgaaatctgagataaaagagacattatgaatagaataaggaacctgagagcagacggtccctgtattcaaaatactgccattagccactctgactggtataggtgcatgattagccatatgtaacccagctttacttgctatcttcggagagatgaatgtagtggtactaccactatcaactaaggctgtggcctatgtggtacccaatagaacatatagtgtaaaggtagtagcagcaggagtggtgccctccaaggagtgtaataacagatgtgtatcctgttgatcagtcttctgtggactgtcaggagtagagtaagctgcatcatctaggatttcagactcatcttccattgtgaccaaatagacttgcttggtagctttacagactctgccatgtcctggtacccagggttcgttgcaacggaaatacttgccagaaaattttgtatgagtgacagcggactgcttgttgtctttgataggttgctttggtggaattttgggagtctttctgttggaaggaacagaagaggtgttggcagagcgagggataacatcatagttgcgagcatgttcataagcagtcaccagggagtaaattgagagagatttcagaggtcttttaatattgtccttgagtccagagataaaataatccaagaagtaatccttagtcaatgtaggattgctgcgtttaactaaggtcatggtgtcctcaaatttatcaatataactgtcgacagagccatactgtttcaaatttctgaaagtttcagtaatttcaatcttggatttggctgcaaaacgttgacacaacatggttttgaattcaggccaagaaagagaagcagtggcaatagctaaactttcaatccactgatcagctcttcctgaaatgtgcacttcagctagcaaaactttgtcttcctcaggagtttgatacaaagagaaatatttttcggccttgcgtatccaagactccagatagtcaccctcaaaggtaggaaaatcgacatttcgagagcgttttgcagggtctgcatagtgtggccgatgttcatagtgagggtggtgtggttcaggattgtactggtggtggtggggtgggtggaatggttcttggtggtaatatggattgtatggttggtggtatggttcaggatgagcaccatgtcctccttcccagaagtgagtaggtgtagatgatataggaggtacatgaggtggtgggtttgggtagtagtggtagtcccaaggaaccggaaagggagtatgtggttgatagggatattgtggctgatagggaaagaattggttaagtggagtgtactgaggtggttggggaaagtgtggtggtggtggcggcggtatggtgcttgtgttgaaaaaaactgaggtatttctttctgttgtaggaatgtggtttggtggaggtggtggtaagggtagtgtagtaactaaactgggtgtcatggtcatctcaatattctcctgatttggtgaattggacatatttctgaaatcaaacagtgggtgtttactaggaccagcagcaaaagtttcaggtttttttcctccattacagactgagctactccaggagttctgggtgttcccttaacctcttgtccattgcagctagatgaagtactgagcatatcttggattaccttcagattctgcattacctcatctttgtggacttgagcttgtatggcctagttctacagttgttcttgaaacaacttcccatcttcatccaccttccgttgaatatcctacaggtgcaccctgagctcctcaactgcaatttcccaaggctgcacctcctccaacacaggttcttccacagcccgagcaccacaaaccatgttgacagagcagatctggagattttatagaagaaaacctaggtctcttccaaccctctctgtgatgtcacagatcccacctctactctgattcctcagccaggctagaatttggggacggagtcggagacggaggcggcgacagctagggtttggcgggggaggccgaggccgaggcgctcacggaggcggaggctagggttgcttgcgttgcactttactcaacgagtcgaggtgcacggaaagtctgcaagatattattaatcacttctacaatttctaaacttgtttaaatgtaccaagataagaaaacgtgtactacgtctacgatttattgctgcaacaattgtaaccgacaaaaaaagaaaagatatcttagagcttgccatggaacactggagcagttggtaacactgcattatgtataacactgtcgattatcaaggcagaatgaagatcttgcctgcaaatggagcgtcatgggtgtgttatctcagtattcagttttgattatatattgttgctcaatgtttttgtttcttatgtgtatggtacaagtcacgttaaactagaccaaggtttaatttagtgctttctacttttaattggtgcgccacctgttgcatgttccttttgtagtcattcaacagagacaaaaatgataattgaaattcccttttgcagtattacttatctcagtagggttcttttgggtcctagggggctgtcaaagtcaatcttactgaaagctgttcaacgtgtaacaaggagtgtaaaattatgatctttaaaaaatttcctccctccgttcctgtatacatcatcagacagtatacatatttaaactttaaccacttctattttaaaaacaaatttggagttatttaaaaataaaacatattatccaattatgttcatgttaatataactgttcaattttagtttaacgaaatattataatttaaacgtaatccatgtttaaattccattaaacaaggagagcctttcggactcttttttctcaccgagagcctttcttaaaacaacgaaaaccccgagattgctactgggcgatcagtcgcgcgcctccctccccacgtgactggacacgtgtcgcacgcggagagggggcggcgaacacgccgcgagggagcgagtttttcgtttttcccccttttttccgtttctgttcgaggttttttctccggttttttcgtttctgtttggttatttttttctccggtttttcctgttcggttttttttccggtttatcttctgttcgattttttcccttttttttaagatgtataaatacaaagtttgtattcgtacgtatagaactttctatacgcgcatataaactttctatgcgtgtatacaaactttctatacgcgtcatatacaaactttctatacacgtatacaaactttgtgtatgtgtgtatatattttttatgcattaaaaaagttaaagtgacttataatatgaatgaaacggagatagtacaatgcagtatatatttagtaaaaatactgtggttaacactagctatgttaaaaaaaaaattaactgcagtgaacatatagcagtcgctattatattacaactatcctatctattaataagttagaattattttttacggaatatatattggagctaaattagttcaacaccacaggattaccattaatcatgcataatcgactccctaacgaagtccataaaccaaagacaaaaatgttagctgcttagagaaggattgattccatccaagttgtgttaaattcgtgagagagagagagaaggaagacttgaatcgattacattcaatttgtgttaaattcgtaaaggggagagaaggaagagtcagtttgtgttaaattcgtacgggatagagaaggaagaaatgaattgattccattcaatttgtgttaaattcgtaagggagagaaaatgaagaaggtcaagacattgccatctttttatgcaccaacaccgcaacccaattcgcaaaaaaaaaaaaaaaaaaaaaaaaaaaaaaagtcttgcaggaacagactgatggaatgaagatctacagctacgtctggtgaaaaactgaaaatgttattaccgatttggtgttttacgtctatatcacaccagtacaccacaatgaatttatgtttctattttggtcatgtcttagtgttgtgggtatcctttgctggtgatacctccattggtcttggcccggggcttagcacaatccttgttcggccactaaagtagatggatttttgggctatatgatatagagatatatatgataaattctactattttcttttgtatcttatgatacttatcatttcttggatttttttaagtatatgatcaataggtgtctttttggaatggaaaagcctctgattagtagtagagatgtttgtaatgaagacaatatttagccaagaacaacttgcattttggataacatttaaaaactataattttctgataaattctaattctatagtttacgattgactaaatgtgtagttttgtgataaagttagtattgaaagtatagtttatttatttgaggtttaaatctgtagttatacgaaattttctcataaaagtataaaagaaaacatgagacatttctagtttttatcctttcagggttacggtgaccaaagatccttcaagagtgtttaattagtatagataaagaaagatgcaatggcatgatggcattgagcaaagcattgtggctttagacacactatgtccatacaatagcatgttcatctcaaatagttgtaccatatatgtgaaagggcatatagtcttagtggtggcagtgacctgagtaacacctgaaggtcttgagttcaaatctccatatgagcgaacttcatattgggttgtttgagggggctaagttcccaatttaaaaggttgcatatatccggttggatataaaaaaaaataaaaaagtaaataaaaaaataccatatttagtgccaaataaaatcatcatattccacaaattttaatgctagacttatatttgtaggtacctcatcattgttgatgatatttggagcacaaaagcatgggaatttgtcaagtctgctctacctgacaacaatttatgcagtagaataattacaacgacaagagatactaatgtagccacatcatgctgctacactgtagcaggacatattcacaatattcaacctctaagtgaacaggactctcgggagctatttttgaagagggtttttcgtgatgtgtctgcatgccctccttatttggaggaagtctcttgtggaataattagaaagtgccatggcttgccgttagctattatcagtgtagctagcctgcttgttggaaaaccaaatattgtggagcaatgggaggaagtgtacaactctattggttcagcatttactcaacaaggaatgacagatcactacaacaaaataaaccaaaggagacatcttatttgtaagatagagacgttttattttgtctcgcacagataactgagacgcttttataaagcgtcgtaggatcgtctctgtttgcaccgtctcagaattatggagacgctttttaaagcgtacctatattatttaagacgttgctagagacgtgtaaattgcatctctataaaatatagagacacttttatataggcacgcacatcttaatatatttgatattaatgctttcatctgggctcgaacacagcacctgcaggttgcaaagttcatgcactaaccaagtcattaacgtgacaatcttgaaggtaaatagatagttttttttatattgcaactctgcaaacatgcgtcctgtagcggtactcttcttttttaatctaagactgaatattaaatatttatttttttccaaataattataatattattataatggtatttgatgatgacgattaggaacagtgtgtttattttcttctttttctatataaataattatatattatctaataacgatgacacggatataataaaaacgtctcaaaactcatttcttacacatgagacgttccaaaaacgtctcaatattcgtctctaaacgatttaattttgtgctaacatataaagcgtcttaaactatgtcctcaactaataaagcgtctcaaacatcgtccctatttcaatttcacttataaaaaagagacgacttatagaatgacttaagtaaaacgtcttaaaacaatggttttgttgtagtggatatactcctgcttagctattatgatctcccacattatctaaaaacttgcttgctatatcttagtatgtttccagaggattacatgattgaaagagaagtgctaatatggagatggatagctgaagggttcattagtaaagtgaagggactaacattggatcaagttgctgagaactacttcaatgatctcgtaaacagaagcatgatccaaccaattgacatccagtatgatggcagagcgagtgcttgtcgagtgcatgacatgatccttgatcttatcgtatccctgtcgaaggaggagaattttaccactctaatgcaaggggaagggtacaattgttctaacaagattcgtaggctatctgtcccagggtttacgattccgatgaaatccggtcagatttcgcgaaatttcgacgtttcaacaaggctcgaaagtagaaaccgtatgagatttcgaggagtttcatccaaattcaaatttgaattgataaaaaaagaaaaaaaatcaaataaaatcttataaatactatgatattcatacaacctattgggatataaatttttgaaaaaaatgatgtattgtgtgtatttactgaaacttacataggaaagaaaataataaagaatttaaaaaaggaaagcacttacatgggcaagattactgatcgaaatttcaatgatttcgatcggaatttcgctaaaaccgaccggttttcgagaacttgtcggcaaactcagggaatttgtatttaaattttggtttatgaaatttgttcagaatttaccggttttccatcgaatttcgcgaaattccgaattccgccagtgcccgaaacgaaagggcctgtcggaatcgtaaaccctgatctgtccaatccaactgtctgggcaataaagcgatgcaggagattatgggtaagtgttcacagcttcgttcactgaactactatggtgtacaagatgtgggacctgatctgcaaacacttcattgtttgagagtactggtatttgaaaattgccatggtatcggtacacaacacattaaacatcttgagagcttcttccggctggcatatttgagcattagttctgatggtattactgagcttccagagcaaattggggacctgaagtatttgcagacactagatatacgccatagtggaattaaaaaattgccaccgaccataggtcgtttgcaaaatttagcgcgtctacttgttggcaatgatgtagaattgccaaatgagattggggatctacaagccttacaggagctatcggatgctggaaaatatgactccataaaatttgtgcaagagttgaggcggttgaccaggctaagtgtgcttcgcataatgctgcatgacagcaacaaacttggtgatcacaacaccgaaaattacgaagaatctttgaagtcatctctcgctatgatgggtgagcatgcgcttcagtcactacacattggctgcaatggattcctgataggaaaactgatggacatattgtgctgcactgtgttaggaaacgataggcaaacaaacgataaaaaacaatagatcaatcacagaagacacgagattttagcgtggaaaaccctcccaaaacagaagagaaaaaaccacgggcactagccagcaaaatatcttcactatatctggggtgaggttacaacgccgcacggcggcttacaagaggtatatatatggtggaaccctagaaggaatgacgatccgtttcacgggggct

SEQ ID NO: 8044 - DNA, 54502 bp, Oryza sativa
cgtgtcttgctaatctcactcatctttcgctatgggtttgtagcattaaacaggaggaactcttgatcaagttgaattcacagcatgcccccgaggagaggcttatcatcagcagtcaacaaatccggtgcctgaaggggtttgaatttggaagctattatcacggtggcgggcttgagatgctgtgagcaatgccggatctccgacggctgcgtttctacattagagcagaggaaacagggtccaagatcggttttgagttcggattcgagcacctcgcaagcctccagcaacttagtgtcacggtcgattgccgaggagccacgaggcagagggtggaggctgcggaagctgctatgagggatgcagccagcattcaccctggacgccctgcgcttgagatcagcagaaggtgggaacgcgacatgataaaggataaggatgatcatgaggaaatcgttcaagtggaatgataaccgctacagaggttcacttctgcagaatcctgaagagctgcaaaggtatggattttctttttgttatttttgaacaactgcagttgcatttctcaataccattctatcagtaaaactcctgacaaaattctagtgtgaatctaggctgattattgactgaaactgaaactgaaatgctggccgtaatcgttcgttattgaactgtaccatactgtctgaaatttcaattcggaaccttaatcatttaacttttgtacttactggccgtgatgcataacagaacgtgggcagatacaagaatttaagctgctgatttattaaaagcaatgggctttaaggtttcagatgtggacagcctgtgatcctgccagaacctctcttcagttgcactttacttgaaagtcagaaaaccatgattgatctcttctacaattatttagcttctcatccgagagaaggaaatgttgttccatcgttgcatcgattataattggcaaaaaaaaaacaaagattacatagcaattgctcataaattttggcaatttgaccctttgcaaaaactaattatataaatgaactgtgcctaaaacttattttaaaaataacccttttgttcagcgccaaatcgtatggcgctgaccttagacacctcaacgccacgtcaactagcgttgaatgacgtgccaccgcggatgggagtctgagtcagcatcccaacgtgtattcagtgccacgctatttagcgctgaggtgtctaaattcagcggcacacgatttgacgctaaacaaaagggtcatttttaaaataagttttgggcaccgttcatttgtataattagtttttgcagagagtaaaattgtcaaaatttgtggcaattgctggcattgtaacactggagagtggagaatgaagagtgtgtgaagaacaacatgagaattgagccacacagccttgtccaaaccagaacagagtcagcggtgctagtacaattttcagttgcaataatgtttgtagctcattgtttttagcttcttctgtgccgacacagggattcaacaagaacctggtttgcactttgcactggttctctttatttcttacattttcacctgcgctagtcaagctaaggacaataatgaagaatgagtaaatttcagtagatctttttttctaagtcacatgaaaaccaatttgtaatataaatattttatgatatggaacataaacaaggtactacacagttattattttctgatacgtaagatacatataaataattctttttagaggccggtttaatccaatatcttaaaataatcattttttgacatgtaaggtacatataaatactttatgacatgaaaaccagtttgtaatgttgttccagttattatctttaatttaaacaacgacaattcaaagtccaacctctagtattatacagtattacattacttagcgtagagattaatgctcaaataacatgggagatttctctaaactacaggcatatgctcccacaataattttgtaaaaaacaaccatataagacaaaaatggtgtgcgttcccttactttgatatcacaaaaatgtttatgtgcatttaaaacatttcactgatgtagaactatgccacataagacccggggaaagataaacaagaaacagtttcaccaatttcatgggtcggaaaatttaactatttgccactcttatgaatggctactctccatatgccatccttatggtggttcgtacacaattgccatcggagagagaaaagttcttaataatttgccacttttgctaatgtggcatgccacctcatgctgtcagcttggatgtgccatataaaatatccattttaccccttgtaggccccacaaatcaggaaaaggaaaaaataagagaaaatggatggcatttggatggcatttgagaaattgtgtaagaaccaccataaggatggcatttggagagttgccatttataagggtggcaaatagttaaatttcccaatttcatgaggtccaccaaaatagactacgcttccatgttttctcacacacacagaccacttcattgttaaagttgcaagtgtttttgcacagccgtttaaaataactagtcaaggaaagacggaaaatatacaatgaaaacctgaaaactatcgcagaattaaaaaaaaatgaacgtatgagattcgtctatgctataagtaaaccttttagtcatgattaaatttgttttacctataatgacatgaacaaatcttgaccgttttatatatttggaagaagtataaataaacccctaaactttatatggaaatccgtctagcaccctaaactttaaaaccggacatccaatcccctgaactttgccataccatctatattacatcctaaggtggttttggatgatagttttgcatattttggaagcttaaacgaaaaattttgaataactaatataatatatttgcatatcaccagttataagtcattagtttatccttatacagtgatatcatatcataccattattatgttggtacttgtttgtaagtgagagctaataagaagcaaagaaaatgatttaagtcaaatatatatatatatatatatatatatatatataaatatatatatatatatatatatatatatatatatatatatatatataaagtgtatgacatgtgatcaaactcatacaacttatatataaattagataaaaaccactatacaaaaccacctcagggggttgtataaatggttttacaaaatttaggggattgaatgtcctgtttcaaagttcagggtgctaaacggacttacattcaaagtttaaggggttatttagactttttcctatatatttataatttgcaattttttttactactactacatatttccccccgcaaagcaagagtcgagatgtgccacgctgtggtaggccgcgccgacgtgggcgaatccgcagcacgaggcttggccccctatcccaatctctcgtgcgcgccgataaggcaggtgcacgcggcgccatacaaaaaacgagccgtcgccgcgcgcgcacgccagggcacccccgcccacgcccacgcccacccaccacccctcgcctctcgttgcccgccgcgtcgcgctcacgagatcccagaagaggacgcacggcggagcgggagcggaagctagcaagcaagcaagcaaagcaagcggccacgaagccatggcggcgccgtcctccctcgcgtcgtcctcgcacctgtcccgccgcgccaccgccgcggcgtcgccgtcgatccctcctccttctccccctcctcctccgcagcggctccggtgcggctgggtcggacgcgcggcgccgccgacgcggcgcgcgccaggtgtttgctccgtggtctcgcccagcaagccaggttctctctctgcggctcctctgctggtttgccttgctctcggcggcggcggtgttgggcgggtgaggctgagcagttgggtgtgctttggtgtaggtgttgctgctgttgacgtgccggccgcgacgattcctgacgcggcggcgaccggcgtcggcgtcgccgagcgcatttcggtgtcgtcgctgctggaggttgtggcggacgacttgctcaagcttaacaacaacctcaaatcggtgagcttcaccttttcctcccaaagtttgcatcattctgttcagcttgttcatgatacaagtatgattgaatagcttctctttctcctagcacatttggtacaaggctcacggttgctacgacatagtccaatacaaaaaaaaaaaaagttgcactgattttgcttggaaatgtatcgaactgtgacagtttttagtccataaattttagaataaaaaaaatttgcacttagtgataaagttgtggacaatttaagtacttggttggttggctggttgaacaatatgttaatggttgtaacttctggaaaaataaaatgtattcttagttccttgcgttcgtcgagggaaattaatgtgcaacgaaggttgaaagggaaagaaatatgcccatcatttgcagtgttactggaatatactgcaggagcgagtaaacagtgcagagtcgcataatggtccattccttttgaactaactaatgaccccagttatcgaggaatggaggcttgggaagtttttttggataatggatagaaatctggcctctatatctctaaatggatataccagtgtttacaattcggttcgaaatttcggaccccaccggcaatcaatatactgaccgaaattttcgggttttctcaattttttgtggaatttggtcaaagttttttcaaatccagtcaaaatctttcaaaatttctggaaagtgccgaaaatcacgaaattaaatttcggtcctaccgaaatcaccgaaatcgaaattgtaaaccctgggatatacacagccaaagaggcttgggaagttgggagtcagaagtagactgaatgagcaaatgccttatagtagctcttatgtagtgcttttgcacactcaataacttcttccatgtttgctattttatgcaacttctctataattgctgagctttgacatgttttctgctcttgagtagtgacattgcacaatactatcatttttccaatccttcctctatagatcatcaatgtctgcttaagcaagacatcaaacatcacagaatgacatatcaaatactagtacctaaacttttttcaagaggaaattgtacttatgtacgttcttgttacaataactagctgacataattttaatagcttgttggtgcagaaaatccagttttagtttctgcggctgaacaaatatttggtgccggtggaaaaagattaagaccggcactagtttttctggtatccagagcaactgctgaattggctggtttattgtaagttccttttggctgcattatcattgatgtgagtaggtttgtgtcacgcccggaaattcactagtaatttccgaacttatttgtgcataaaatcctcgtccaggaatcagccgaggtacacaaactgacaatttaatatacagattcatcaacaactaaagcaaataaatacttacttaagaggcacttagtcctcatcatgaagaaagctgcagcggaaaaataaaatctagcgaagctccgactccactcccacaggcagctcaactgggtataagccaaacgtcttctccttctggatcctttttcttcaactgaggtttgattgattattgcaagaatgagcatatgacatactcaacaagccacacagcaaatatgcaagtgcacaaggataccaaaggatggcataatataggctcatttgcaaaagcagcatttagcaaaacatttaagagaaacaaaacagtggagtaattaatcagaaattttaatcaacactgaacagcacacccatgctgcacaggcccaaccatcctgaacaaccatacccggctgtacagatctaactccaaaccaggagctaagcaaattattaccagttattacatccataattattgtgagaggtgtgagactaatcacgaaaaacattgctcaactcgcccataaccgcgggcacggctattcgaatagttttactctggccagaggtgtaccactgtacccacaagacacaacctcaacatcatgtctaccatgcgtcgcgatactggaaagtacccgaatagaggctgtgacattatcccctgcataacacaactcaccacggtgcaccattcctggatcataatcaccccctctacaaccagaggcatggactccccagcgacccccatggacttctcgccacttcacagtctggcacactataataaatcatgctatacaagagataaagccggtgcccacgctggcttgtggttggcacggaaaatgtttcacaacagtagctcgcgaaccggtccttaattgtcatgagcacaaccatcaaaaccatatgctcacaacccaccttaaccaggttttaattatcaattaattatcatcacacgattaaccatcgtgagctaccattaaatgtaaccataattaataagaataatgtaacatagtttataattaatccctttagttaggctaatgtttctaagcatagctaagcaaacttacatatagcatttagctgaaccaatccaatatataaggttcaagctaatcaatttattacccaaggtatcaaggaatagggcattcaatgcaaattggccataacaaaggaataggttcacaccacccgatgacattcgaaaataaatgcacagttgaaataaatagagaatttaaatataggatcaacatgctcaaaggattgtgtttaggatctgtgtgacttgccttgcaataatcagtcttcaattaatcttcttgatcacttccgacgcactcacgaaccttcgcaacgacggaaacgacaagctaacacgcaaaacgaagaaaaagactaataaaaaccaaataaacagtacataaaaagtaaacaaacatgtagatcataattttagatgaattatgagacttgaacggcctcattctgacttcaaatgaatttattatgaattttacaagatcaaatctaattaaagcccatttaaaaaaaactaaataaatttaattcaatttatggacaattttaatatgtagatctttattttagaaaaatttggcaacttgaaccacctaaaacggatctacggttatttagttatgattttccaaagatttaaactattagaaaaaaaagaaaaaaggaaaaggaaaaagggacgatgacgtcagcatgacgtcacccacgatcggccgattagggttagcaagctcgccggagataggggccttggccggggaaaaggagggcacctacgcgtagagggcatcgagacgaacccgatggtactcaccaaagcgcccaacgacaaccgacgacggccggcgacgacgcaagaggcggcggcggctcgggttggacggcgacggcgaactccggtggtcggcagcgaagggggacgggcggccgaggttcctcacctccttgcgcacctaacggcggcgacggatggcaacggcgacgactaccgtggcggcgcgacgcggctggaaggtcgccggcgacggcagcggctagggcaacgtggcggcaacgctacgggcgacgagagagctcgggacttggggcaaacggtagaggacgactaggggatgctatttatagcattggattagagagatcggactccaaacgagaggaatcgatccaagataatcaaaactcggttttggagataaactcgaaaacgaatttgattcgggcaagatactcaaccatttgctccgattcttgagggaaaagatagaggagtatgtgaggataaaatcccctcaaaaatcccgaagaaaaagagtcggattggagcagatttgagaggagaagaaggcggctcgggctcggcatctcggccggcttgggctcggccggaggtggaagacacacccgacaggtgggtcccacctgtcggcggctgaggggaggagagggcgggcggcgtcggctgggccggcttgggccggttcggccgcgcggggaagagaagagttgggccgaaaacggcccaacggcttaggaagggatttttaaaactttttcaattaaaataattcgtgaaatgatgtttcatttattaaaaatacttcccttgctcaaataattcccagaaaaatctagaaaatagaggagcaagcatagtatttaataaaattttatctagttcaattttatattgagatttagcaaattaaaaaaaagatcttctcttttaaacttttaaaattatttctaataattccttttaaacaacaatttataatttaaggatttttaaacaagaaaaactcttaaaaattataattagatcatttaatgattattttaatatttaaataattgctgaacttctctttgtatgattaaaattaacaattgagctccgaaaaatccgagaaaattccagagagtataattaaccatggagaatttaataaaaattaaatccatccatgctttgtatttaggaaattttattttccacatttaacttcacttgtaaattaatgaacatttaatataaattctattaataatttattaaataatttataaatcctgaaacgaaaatcagggtgtgacagtttggaatagagtgcactatctcataggtccctaaaccataacatgtgtgttatttaagtcaccgaattacagaaatgcaaattggcttctatccaacccaaacttaataagttaccaatgttcaggcagcactttaaccctgctaaatcaagtttgactaaagaatttctaccaaagtaaataaaaatcttagtgacgtgtgaaattttccttcgaattgcaaaatattaatatctattgatttcaattggaaaacaaaactatgatttggactaagggtgtcacatgtcatttctaattaccataaaatggcatatggtactttgttaacccatttatacaaatcccaggacatgaatgtgcagttctcaagttcaagcacctaggtgacaccacacaagtttagacacctatcatatactttagtcttttaaaattattccctcaagatctttgatttttggattacagggaactaactacagaacaccaacgtttggcagagatcatagagatgatccacactgcaagtttaatacatgacgacgtcatagatgatagtgggatgcgaagaggtacgtattatgttgtttttatggaaggccagcagtactggcagtaataaccattctctcttagccaacagaactgtcaacaaaaaccgatctttgttatttcatttttgtgacacatgtgcctaccgtttattcttcttagaatactctcctgcatattcttagaaatacattgtctgaattttgcctccatgcattcatctagtttgaaaacaaaaaatgctgtcgttgcattacagaaactgttctgtttcgctctaaaagaaaaaaacgaaactgttttgttatttgttttcgttatttatatggcaatcctgtttgattttacttaactcctttctattgtcattgtgaaataggggactcaagaaatttacctgtttaatctgaggtacatttattatttttagggaaggaaactattcatcagctatatggaacacgggtggctgtacttgctggtgattttatgtttgcacaatcttcttggtttcttgcaaaccttgaaaatattgaagttataaagctcatcagtcaggtaatgaagagtttgagcaagtttttgtgccttatttaaaactatgcatgatttgcatccagaaaggtgcttctttaacaggtaatcaaggattttgccagtggtgaaataaaacaagcatcaacactttttgactgtgacatcacccttgatgattacctgctcaagagctactacaagactgcttctctgattgcagcaagcacaaggtcagctgccatatttagtggtgtcagcactgctatatgtgaacaaatgtatgaatacggaaggaatctcggtctctccttccaggtagtcgatgacattcttgacttcacccaatcagctgaacaacttgggaaacctgcaggaagtgacctggcaaagggtaatctaacagccccggtcattttcgctttgcaagatgaaccacagctcagggagatcattgattccgagttcagtgaaacaaattccttggctactgcaatagagctagttcatagaagtggtggaataaagagggctcatgagcttgcaagagagaagggtgaaatagctatccaaagtctgcagtgtcttccaaggagtgagttcagaagcactcttgagaacatggtgaaatataatctagaaaggattgattaggcagctttacttatttcacaatcggatacagaacctcctttgtgagcttacagtagctccccaaaaaggcaaactttttaaggttttgggccctgtttggatcagtggattgccaatggaaaataagggaaaatgacattattttcttacaaaatgatcctgtggaattctcacgaaacagaccatttggttatgtgagatgaatgatgcaggacaaaatcatcggaaagcagcgaccttgccaggttcctcccaccttgcgcctacatgtatcctagcattttatttttgcacgtcttgtaaataaaagaagtatattgacattagcattctttagttttgcaattttcacatgcatatagaaaacacgttgtgtgtacttgtatgggcacctcacctgacaggctctcacaacatttgtgtattctgtgctgctgagatatgatgttaccaattaaattactactaatgtgatgtatggctgaattagacaatactgaactacatattggatatgaatttaactgtagaaactatccccaaaatgaaactaaagataatttaattggggaaattacctcccaaataaaattcaaggtagcccctaagatcacatgattatgccaatgatgaggcaacactttctaatcttcaaagatgaatatatgatactccagcaaaacacatctagatcttcatgttcattggcaactgtgacagtctataaatcacaattcaataatccagaatttaacacttcaacgttgcattatatctgaaagtaatgcacgacatgaataaaacgtggttatttctgttgatagcagacaaactgctcagatcaatataaccacagcgaatttcagaggtacaaaaaagaaaaaaacttatcacaggagcccaaatagtcaggaacaggcaagtcatagatatagaccaggataacattatatattacaagcaactacaaatataatatcatacataaagccatgattccaagtttggaatcacatcattcagacgtgagcttcagatagattatacagatttgtccccaggaagatgtgaaggagaactgccgtcggcatgattcttcttcttatggaacatgcttgtaatatttggtagcataaagctctttttcaatagtgttctgctgttcttgtgaggtccatcattcttctcattggcttttccagcagaagctttctgtacaggggaagatgcagttccatgtgcttgcgcttctggagcaggctgagcttcagcagctttcttctgctccttctcgcgccacctctgagctcaccttctacagctctctttgctgcttcagccatctctgccctctttagtgcttcctctgttgccaattccatgtcttccatctctttccgagccgcctccaatttcttaatcgcctcattctcactggctctgacagcctccacttgagccatagcggcagcaactttcatctcactcaatttctctgactcctccacctttcggctaagagattcaaactcttcttttgatattgttatcttcgcacctgattcagatgttgaggcccgagcagcgcttgctctttctgatagttgcttgatctgatcaagggcctttgcttcagctgattttgcctcttctgcttcttttaaagcagattgcaacttttgttcagcttctgctaatgctactcgtgcagcttcagcttcatcccttaaatctgcagcactcttttgcattacttcagcttcctgcagggcattttttgactcggaagacaactgttggagggccaacatcaagtcatcagaagctgacgttgcttttgattcagcagctacggctgcctcaagctcagatttgcatttctgaagcttcacatgtaggtctccaactatggattcagtttctgtatccttctgtttcaattgatcatgctcctccttaacagcttctaactcttgtttaagtgattctactaaactccgaagagaactttcctcctctgccactttctgtaacatttccttagcatcatccaactctgtgctgacagtagcaatagactccaaatcttgagctcgagcatcttcaatctttttctgcatagatgaaatctccaaattggtctcatctagcttttctttgaggcttttataaacagcaggatcaaaatcctttttcaaagaggataatttcttctcggcttcttccaaagcttgtttgtatgttttcctagtaacatctttctcagcaaggatttgagcctcttcttcatgtgcttgttcagtggctgccttcacatgcgtaagagactcttgaattgtagcaatctccttgcgaagctgatcagccttttgcttgtttgtttcagctaagtgcaatgattcctcttcctgctgtgctgcagccaacctcatatccaatgaagcttcaaaatccttcttgagctttctaagctcctgttttgctgcatcaagatctgccaaagcaacaacatactgttcccttgcaacatccaattcctgctttaaagggccatcttttccaacagcctcaagcgagtctccaccttcaagctgctttgttcgagtttttgcatcctctgttgcttgaatagccagctctttggacttgttgatagcatccagcttattggtcaggtcctcaacagttttcttagctttctccagctcagataacgcttgcactctggttgtctcagcattgttgagctgatccttgtatttatttaactctttctgggccaagtgcagttctgtctccttagctaacaccctctgccacaggataggattttgatattgcaagcatcagagtatatttggataaccaaatacaaaatagataaagtgaaatgccattccatggataatgaagttatagactcagttaaaccatatgagtgttcagttattacttatacagttatactctatgatgtaaaaatatgaggtccatgcgattaaaatgaagaaatttaaatgcatgaaaaaacatgttaaatataagcacaaaaatgcatcctcaaaagataatacaatcgcattaaaaaactataaaattggaaaaagtaaaaacaactaagaaagatcctgagatactacatgtctggatgatggaggcagttgacaattttagttgatctatattagacagcatcccaacattaggcattgtgaactatctgcgcatgtacatttacaacatccaaaaaaaattttcaatcactgtctctaactgttcttttgttatgttgaccatgccaatccaaaacaaatcaaataaaatttaagcttaacaaagcatcctcccacatgtactagatacacatatgtgagaggtgcttctgtggactccctgtcgtgaccatgggactcactctcacctaaagaaaaaaactattgcctaggtctacaaatgaaatcccaatcacaaacaaaccattaggcacctttcaaccataaaagcagaagaatcacccactcgcccaaaaccgctatagttttttggcttgttttcagttacatggtgtcctagtaagcttagctatgctgaagtgacctacaaatcagccaatcatgtaagtcacaaaagatgtgtgtatagttcactaagacatgattcagtgctaattcgactgccatactgaaactagtgatgtcaccactaatgtcattaaaacacctgaaacagagccaccgcttgcaagctccaaaccatctcttccaggcagcccactcctagccttctttgttttctcttttctgctgcttgggtggtcttggctgttgctgcatggctaactgcctacttgccgctaccaccattattacttactaagagcctaagattgctaactgggtccagtcttactgggacactgatgtcagagtccaactcagatttgagtgtctgagttgagctaaaaaaagatgattcagggattcgcctgatatgcatgtaattgttgataaaaaaattatatatatcatcaaataaaacatactcttagtaagtaaaacactaaggcttgtttggatgacatcagattttggtgtccacccaacactcaacactgactgggtccacatgtgaagctgatatgctataacatgctattgttgcttgccgcaatccctaaaaatgtgcttgcctatgcaccatctaggacacattggctcgcttgcctgctgcgtaaacaccaagtgtcataggcaacagtgctttccaccatcatgccactgccacctttccatccaattaacagtcccaagtaccagcagctgccaccttcctctaccaaactgttgctctaacggtctaaccagctcaccgctgcccctatttccatggcaacagtaggtcttggagatactggcaaccatgccaggctcagagaagatgaagaccagtggaccaaggcaacagacaatgaatgggtatgagcaaaggattgcacgtcagatcccagtatcatggtgcctcgcaggcccctaagttggctcaaggacatcactacttgtaggagtgagactggggtgatactttgatcaaattagtcctatcttgatacaattccaatccagaaaaaacccagtacctgatgttttaacttttcagtgagtgaaagatttgtatctgggtttacgttcaaagcttataccatataacaaatttgatactcctgtcttaagctggaactaatgtttctgcattgcgtttatgtgattatggccatggcaactatgatgcaatattcaaataggcacatggaaggaagcatgggacaaccaatctccaggagtggcactatttggagtcgaaaacgaaggtgaaaattaaatccagcaaaacttgagcttacaggactgaacttttttaatggtatgaatgcatgtcagtccccacaccccccccccccccaaaaaaaaaatacaaacaaaaacttagacttctagtagtatcatatggtgaatcatcgctaattctttctctgtttctgccaacaagtcactcaattatgctctcttctaaagtgtagttcatcagatgtggaccaggtacaacaactaccaagacaaataatcaaagtaaaagtagaaggcaaaactactattctttcagaaatgcaaatcaaatttctgctgtgaaaagactcataaatggagaatgtgcattaatttaataataatctgtttaattaaagacagcaaataggctggggaacagcctgaaatttctaacagtgggaacacacctatttcttgcaaaaaagaaataggaatgaacaggaaagtaaatgcaaatgaaaagagttagagcatataaaaaacaagtatcttgtggtattcactggaacatgcaggaaatagtttgctgatatgacaaatttcattaaaaaaaacaaaggcgtggcttcaaacctaagtcataaaaagatcccggaacagggattttgaaaaatatggtatgaagggggaaatacctcttcaaaacgtttgttcaaagtatggaatgcgttccattagtttccgggatgatagtccggaacaatatcagaaattagaagccaagggcttataaatatgagcattccattgttatgcatacaataagcttaaatgaatatatatgaaattttatggcttatatgaaagaaatcaattcaataaagaactgttcataatattcagagtccaagagcaaaaatgaaataagatgaatcccttatccactcacagtcttatcccatcgatggaaagaatccatcccatcgttctcagccactcagcgtgatagcgacgatggagatggcactcccccatgcccctcggcgcgacagcggcaaccgcacttccccaagccccgcagcacgactacagcggtgcttcctgtcctccctcaggtcagtggcgacaacgctcccccaacccccttcggcacaacagcagcagcactcccccgtcctcctcagcgcaacagcggtggcgttcctccatgcactcaggtgcgatggcagcaagcagcgagggagcaataacagtgctcgcccgttgcggctgtgaccctggtgcattccccatccctaaacccaacccctctcagatttgccttcctcatacctccttatgttaggatgtgatccatccacgttcggtacgtcatcttgtgttgttcccgttccttgtttcgggacaaagttcactggacgaggaacacagcatcgttccaagatctgtgttacttagcttcaaataagtgctacatgaaactacttagacatttgaaaatggttatcaacattatggcatattggcatcagtataacacacttgaaggtcacagcattttgttgcgtaagatttgaagttagcagttctggaatcaacaaggcttaagaacatcaaggtctgcaacattgctgtacttataagtattccatgtaatagtaggcacgcataacattccacacaaatcggtatgttcaaccttcataaagatatatgcatgcacacattgaagtactattattaatctaatatgaaaaaaatgtttaatataagtacctacctctgcctgaggaggctttggcttccttgcagctgatttgtcagatgaaaatcgaacttccccaaataagcttactgcagctttgacggattcaaaaggagcccttgtgtctatttctccaacctctgttttttctgcatcagttgacggttgacggagttttgtagccatatttgcctttccgaatatgtattatgcacactgccacagaagatttaatggagttacaaaacaattattacagaaaatgattgtagtaatatgttcagtaaatgaattataaatatggccagttttacgaaagaaactgcataacatgtgctaataggccttgaaaccagtctgtttctcccatatagtttacgagcattctaagaaaacgtatattgattatgggcctgttcactttgatgccaaaaaaaaccttaccaaatttgggcattgccaaaattttggcaactatgccaaaattttggtaggatttcttatatagttaccaaaatttgacagcaaactaaatgtagccacttttttggcaactttaccaaaatttggtaaggttgaaagtggcatcaaagtgaacaggccctatgtctagcgtcacactaggttatattttatagaattctacaggggattactttaagataatgctacaggctaataagatgttagtttctagtttgagattgacaaaatacaggtaaggcccatcatcaaatatatttcaaaacaatttttttcccttccccaaacccatggccataggtcatgcttacccggtgactcccacagtgatagtaattttgtaagtaaagagcatgggtcatctggtgctaaatggattggctagcaaaagcttttatggtgcccaggatctcaaaacaaacccgatgtatcaataacgaccatgtctccatcttacattgtaaataacaatgtagcatgcatatcataatgccaacatgtggaatttcgattgagcaacaccaatttcacccagagtaagcaagtacatccgccaccctcaattccacgctaatcacgtagtcttaaaacaaatgtatgcatggtatggtatgatttttctagcctatagcattttgagagctgcacaattcctctcatttcaatcgcatacagccatacaggtgcaatccacatgcgcattccgcatctctcggtgtagaatcatcaaatttggcatgaccaaaatttacccttcctagggcacccattccaaccaagaaaggatgcagaaattacagcatttaatcgagcggcgcacctaacgcgggtgtgggggcatggaaccccttatttttgggggaaaaaacaaacaaatcgccattattaccagagaaggctaagccaaactaagagaaaagcttccagatctacccagagaagacgaggcttaacgcaacgcgcgagagggatgaggaaggaggaggatggcgctcaccggcgaggaggcggcagagcaggacgccgaggcaccgccggggtgcaggcggcgaggggacggcggaggagatgggtccccccggggagggcggcggggtggtcgccggcgaaggcggcggcggcggagggtggcagggcggaggggggcgttggggtttgctggggttagggcgtggtttccgatcggtggatcggtcggaaaggaacgtgcgttgcggggggcgagggggagggggaaagatgtgagtcagttggtggggcgcacgtattttccgggcatccaatagaagggttcaatggcgtggggtgggcccacgtgttgtctcctgacaggtgggcccgtgcgcacgggggagtcgtggatgtgtgtgtctatttgtgaggggagggagggtggtcttccgaagagttgaattaactcgcacacggaacatcccgtgtggaaataaaaatacacgaaaagtacctactctctctctctctctcatatttcatattatgtcactttcacttttttatagttaaacttttctttaaatttaattaaatttatagaaaaatttagcaatatctacaacatcaaattagtttcactaaaatcaatatttaatgataatatatttattttgtgtttaaaaatattactatatttttttataaacttagtcaaagctaaataagtttaactaaaaaaatcaaaacggcttataatatgaaacggagataatagtactccctccggactgataatacttgtcgttttagaatctttgattatgaatcatttttaaaatatatggctttcaaatatgatgactacatgtatagagtagtcttaaaaagtactttaataaaatcatatatttgtcaacacttttatacatattataatagaaaataatggtcaaagttattttttgaagaccgtgtccttgtccaaaacgacaagtattatcaaccggagagagtagtgtatttgtttttcgtgaattggtattttaatacgtctaaaaatgcatttttatgtttgatacggtcagatgccattttgactagtactacttaaaaaaagtaagttctttttaaataaacaggttgcatatattatcatagtttgtttaaggaaaaagtatgaattaccccctaaaccataaagccggacattttaaacctcaaattattgatactagacaattacccccggactcaatccggaacgtttgggtcctacatggcatggtatacacttagcgccaacgtggcaatccaatctctgctagtagaaaaattgaagatatttctagccaaaatttggtatgccatcttatttcgatacgatgtcgatatacgggtaatctttatctttacatgtttatatacttttgactttggtcaatgtcaaactgctccaagtttgataagtttgtagaaaaatgtaataaaatttttaacccaatataaatatattataaaaatacattcaattatagatttaatgaaactaatttggtgtgttgtaaatattattagggagtatattataaaaattgaagaatcgttcgtatcgcgtctttcaccgcatgcacgggtaacacgcacggattagcactccgatgttgtaggatggagcgcgactcccaaagcactggagcagcgaggatgatgaatcgcacgcaccgtgtcgtccgcttcgtggcaatgcaattcgtcatcccttttcatgtaagttcacttgacatccctgaactttacacttagtctgtctgaggttcccaattcccaataccagaaatccctacccctcaactattacaaaccgtgtaaaaaaggtcctaaagcagtatagaccaaatttaaccctaggttcgctgacgtggcatacgacaggccccacatgtcagtgcatcgttgcggcattattacacggagtcatctctctcattgggctagcggcggaggtggaatcaccgctaccgatcctcagcggcgcgcagttccacaacatcatgatgttgtggttcccattcgagtggtccagcgctgggcttgccttcgatggggccactagcaagcacaaggtcgtcaggctcttcaagaaactgagcggctaggcgagctctgagatgtacacgctagcaggggtacgtgcgcgtcgggagggggggagcgcctgatttttccccctcccccaagtgaccgagcgccaactcggtaactgtcgaaactagatttcggcaataataaaagggggtggctatcaagctggaaaagtgtatgggtttggagacaaaggatttatacaggttcaggccttcttataaaagaagtaacaccctactcctgtccggggatgaatccgccgagtgtattattgattgtatgatttgggaaaatcaacatatgcccctagaggcgcccggaccccccttatatatgggaaggagtccaggttacaaaagataatctatatccttaacggaatacacagatacagatcaaatacagtcgtgaccgactaagtctcagggtatttccttgatgcacaagttgagaaacaaacccgagatacacataaaatattctatctatattcggtatcctatattcagcccaaatatcatcgccgtgtagatatgggatatccataatctccacagtagcccccgagacctttgcagtcaaccatcatagcctgctcaaagacaataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcacaatcatgcatcatatgacaaaagcatacgcggcacccaaagaggcattctagccgactgctttttagtcacaataaaaggaatccgagtggttaacactctaaaaagttcacgaatgaacacacttgacaggcatccgaatataagactctaaagattacccaccaaatatcataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaagcgtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattctcacctccgatacccttaacaagaaaacccgagatccaaacgacgcttcgtcttccccgccggaactctcgccattttccccactccttgctacagtacagagctgcgccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcgatggcggaagagaaagaaaacttcgaaggccaatgggcgccgtccgacgtgacggaggagaacctgaaggagatggtggcgcacggcgttctccctgccaaggagatcatcgggtggcggccagcgtgcggtgaggcttttccgacccccgatacacatgaggtcgtggtcttctctcatttcttttatggtggatttgctcttccaacctcaacgttcttccgtgggatactgaatttctatggaatcagcgtacatcatttgaatccgaactccatagtccatattgcaaatttcgtccatgtctgtgaagcttttttgggcattagacctcattttgctctgttccgccgaatctttttccttaagcctcaaccgaacaaaaacaaaccatgcgtagttggtggggctggatttcaactaaggggcactctgagccagaagtatttctctatgcctttcaagacttcaaacaaaggatggcacgccaactggttttatattcaaaatcccgagcccgctcttcctgagtgctcctgtcttcccccagtataccaagatacctggaactctcttcccatgggagatgaagctgcccaggccttagaactgatggaacgcatgctgaagctcaaagagcaaggcttacagggagaacaaatcactcggcatttcattaagtgccgattagctccaatcaaagagagatcccgcacagcatttgagtttgacggcaaacatgatccaaaccgtgaagacccagattctctggactttaagatcatgaaggagaggatgtacaagatattctcgaacgccattgtcgtcagctactcacaccaactgccagttgtaccatacaacgcattcaatccacctccgcaggtacgtatcagaaatcggcaacccatgatcaaaacataatcttgtctccatgtcgaattaattaaccgtggaaacatctcattcaggagcacgtattgatgaaatctgatcccccaattgctcagcgccgatctcctcgccagcacaccattcagggaagtggaggaccgacaatcaggtcagacccgcaacctcaaacctccaaaccggctgggcagacaggttctcgcaagagaaagctggtacttaatgacgacgaaggcgatgacagcaacaaatctggggacaaaggaacgcccaataaacccccaaagcataccatgcccaggaaaaaactggctggccgtcaaatgccaaagattagaacatcttccaggtataaacctctcggtaccattttatttcggcatgcttctctcatagaaattacgctgaatatcgaaaggacactttgcaggaaaccgtccgatatagatccaactggaaaagaacctgatccagctgccacagagccaaatttatccaaagatgctgagccgactgccgaaagccagccgactgccgaaagccaaccgactgccgaaagtcagccgactggcgcccaagcttcggacgacaaggccaatccgagtgatcagccgccgactggaaaccagtcggcagcaactgaaactgcaacaacccgagagcccccgactggaaaccagtcggatgtagatctaaatcaagagattcctgaagctgaagcgcagacaacttctcaaggaccagaagttggtaatgactcagtgattgggtctccagataaagagcaaggatcacctcacgctcagccaggcacatcctcaggtaactcatcttctcaagtgatgccgttctgaataactccagcttgttcgtctaatgtcttgggaatacatcaggtccactaggcggcgacgaagaagaaatcctccgcataagggcagctgatgactctcgtcctcctatcttactcaaatgatgggacgagaactctcaagtttccggcattgtcataaatcgccaaaaagaagatgaggaagtgtgccagctgaagaaagtacttggagaagctactcgcattgtgaatgtaagtcttctaggtgactgcctttgatgactttgttttctcgttagcaaaactaatccatgaaccaccgtgcagagaatccatcttcgcaatgaggccaagaccacaaccttagaaaagctggttcctcatttgggaactcttgaagccgttaggagccagctacacgaggccaaggagcatgccaagaaaacggagaaggaattaagggaacgaatcgctcagctccaggattcaaactacgagctgagtggttcatcaaaaggtaatctctagatctgtcccattgattcaggccgtcataaccgtatcctcaaccatttgaatctcaaacagcgcaagccgccaggatggctcaaatggagaagcaaattgaagccttgagaaaagacaaggcagaactagctgcagaaagggactcggccttgaaggaggttgaaggtactgccagctgacgatctgaacttatctctttttaatgcaacaaattcttatcatgaatgtgttttgcagaccgcaagatcaaatcccaagctcagtttgacgtcctggttggtaagatcaagaggcttgaaggagcaagagatgaagtcgccaatgtcgctacaccacttgtccaagctatgtttcttaataacagtggtccgagtgcacttgacgcaaccgagatctttgacaagctaagagttgcaccggatgtgtacttcaagaacatcaagaaagctggaagtatgggagctagcatggcattggcaatgaccaaatccttgtacccgagaattgaaattgactccattgatggctttgcagacgggacaagcgaggaggccgcccttgatcttatcagcaatgctcagaatgcggctgacaaaattgcaagtgacattgtatatcaattccgtaacaacgaccttcagccaagtagtaataattctgatgatgaaaggactgattctgactgaatatgaatgtaacaaatggaggctcaatttgtacaatactggtgtatttatgctgtgcttgatagttctagccaaatctttgatttcttaaaagtttttgtcaagctttgttgagcctaaaacccaaagaagctattaaaaactttcagtcctcgcagactaagtagaaaaaaccaaacaaggcaatgataaaccaagtaagcaaattaaattgataagaaatcacactccattattatgataatagcccccgactgacaacttcaagaagaaaacttggtgttgacagtcaagatagggagatacaatggtaagcttaagcatagaaacgacgaagatgttcaatgttccaagagttgtcgacgagagtaccgtcttcgcgcttgagtcgataggaacctggccgggtgacttcagagatgataaatggcccctcccataaaggagataacttatgccgatctcgtgtggtttgaattttcctcaaaaccaggtcgccgactaaaaaggcacgggatcgaacattgcgattatgataacgccgcaacccttgtaagtatcgagccgaccgaatcaaagctgcttcacgaacttcttccaatcggttcaagtcatccactcggtcctcgtcgtagcgatcttcacggaaatttcgaaagcgcaaagactcgaattcaacttcacttggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgcgctttaatcccttgaagtatcataccattggctcgctccacctgtccattgctcataggatgcgccactgaggcatagcaaatcttaattccaaagtcttcacaaaagtccttaaaaactccgccagtgaattgtgtgccattatcagtaatgattcgattgggcactccgaatctatgcacaatgttgatgaagaagtctcgagcgttatccgctgtgattgtgacaactggtttagcttcaatccacttggaaaatttatcaatagccacaaagagatgcgtgtaaccgccgactgcctttttaaacgggccaaccatgtcaagcccccaaaccgcaaacggccaagacagcgggatagtctgcaactcttgagctggtagatgaatttgtctggcgaaaaattggcaaccttcacatgtccgcacaattttgtcggcgtcggacactgcagtaggccagaaaaaaccctgccggtaagctttgccgacaatggtgcgtgcagcagcatggtttccgcatatcccagaatgtatatcttgcagcaattgtctcccttcctctaaagatacgcagcgttgcagaatccctgaagggcttttcttgtacaactcagcttcatgcataacataaagtttgctccgccttgaaatccgctcggcctcatctttgtcttgggggagttcttgagaagtcaaaaatcgtatgaggggctctcgccagtcggcttcaaccatagctacgtcttgagtgcccgcaacttgagtagcatctttgtgaggtactgtcggcgtataaaggtgttcaacgaaaacatcagagggcgccacctcgcgcttggatccaaagttggcaagtctgtcggcagcttcattgttgtgtcgaagaacgtgactgagctcgagtccatcgaacttgtcttccaatttgcgtacctcttgtcgatatgtcatcatattgtcatcaaggcaggaccactctttcataacctggttgacaactagctgtgaatcacctcgaactattagacgctttatccctagggaaattgcaattcgcagtccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggtccagtgctccatcttttccgcgggggtatcctcttggcactcggtccattcggcgacaaaatcagctaacgcttgggacttgattgaaattcggggtttgaatgatatgtccaaagacatcaactccaaagcccactttgcaatccgtccgtttgcttcgcggttgtgcagtatatcaccgagtggaaatgatgtgaccaccgttaccgggtgaccttgaaagtagtgagatagcttcctggtagtgattaaaattccatataacagcttctgaacctgagggtacctcgttttggtgtcggctaggacctcgctgacaaaataaatcggtcgctggactttctggacatggccttcttcctcacgctcaacgaccaagacagtgctcacaacctgggaggtggctgatacatacagcaacaacggctcctgcgggtgtggtgaggctaggaccggtggctcggtgaggagtttcttgaaatcttcgaaggccttctgtgcttcaggtccccactggaaatcatctgttttctttagtagcttaaagaagggcatcccccgctcgccaagtcttgaaacaaatcggctgagcgccgccatgcatccagtcagcttctgaacatctttctgggttcttggcggtttcatgttgaggatagcagtaactttctccgggttggcttggatgcctctatgagacaccataaaaccaagcagcttccctgacggtactccgaaggtgcacttttcagggtttaatttcatcctgaaagcacggatgctcgcgaaggtttcttccagatccgagatcaaatcatccttttgcttggtcttgacgactacatcatccacataggcttcaacgttgcggccgatctgcgttgagaagcatctctggatcatacgttgataggttgctcctgcgtttttcagcccgaacggcatggtgatatagcagtatgccccgaagggcgtgatgaatgaagtcttcaagcagtcggattctttcagtcggatctgatgataccccgagtagcaatccaaaaaactgagaagctcacagccggcggtcgagtcaactacctggtcaatgcgaggcaacccaaaaggatctttagggcaagatttgttgaggtcagtatagtcgacacacatgcgccattgccctgttttcttccgaactagaaccgggtttgccagccagtcgggatgaaggacttctttgatgaagcctgctgctaacagcttggttaattcctccttgatcgcatctttcctgtcttgtgcaaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcactccgtagggataggactcctcggggaccaggcatcttcatcatcatgtaagtgtaatgcgggacggccatgaacttggctaacgccgggcgtccgagtatggcatggtatgctgtctcgaaatcggcgacttcaaagctgatattctctgtgcgaaagttttcccgagtgccaaaagtgaccgggagggtgatctggccgagtggagttgcggataatcctggaattactccatgaaaaggcgcattgcttggttttagctcggagcgaggaatctgcatatcatccaaggtcttggcgaagatggccaactcggtagcgaagagcttcggctttgcccggagccttggctatgcttcgccccgatggtcgttgattcgttttggcagttctggtcgaaaatcctcgtaacatgtctccaacagtagatgattggtcaaaagtgaagccatgccgtctactgtagcctttttgattgtgcgtttgcaacaggaacaaagatgaagaggttgagtaaatagaaagaacatgatcggtagatggccggggttttgcaattaatttctagtgatgaacgataaccataaataaaagtaggaatcacgctttgtccttgtgtaactaccgcccttcgcgatacaatttactcatcaactatatggacaatctatctatctataacctatctatctatctatctatctatctatacctatactaattggacacttttaggagctctcacgcgttaattagaaagatccgtagattataatacgtatttatatatgggttttaatttagaacgaatttattatatacgtgttccaaaaacccatctaatatacaagtgtgttgaccaatccatatcgtgtttcatcatctttagtccgtccgcacggtcgtttcaattgtttccagtggcttttcatcatgatcatgcacgcggccattaagatgttgtcatgttgatgaacaaaatcgatacttcatggacgatgcatctacctgacaatgatcatcgcgggcgtcaaactcggcgaattcttgcagtagtagtatctgctgcagaaacagtgcagtgaggagcgagcggccgctgagatggccacatctcgttcgtgatcccccggttcgaatctcctgccactacgccggcacagtgaagtattgtttcgttaatcattccaccatctataatttaagtgacggttctaatgacaggtatatgcttgcatcatgtatgcagttctgctgcagaacccgtgcaacaaagccatggcaatctacaaagcatattagcatagaccaatgacaaggtgatcgtggaagatttcttttaaaatatggtcataggcgggtgaatgaaggatgcaaaacaggaggaatagttgtgattaatttacaaatttagcgagcaaaccaggttaggtgcttttcttccttttgtcttaatttaaatatgcattttcttttgcaatcttaaataataaatttcaagcgaaggcatcattagttaggtttctcaatatggctcttcgttaatttaatttcgaaattaaaaattaataattaacaaattataacatacaccaactcttctttcactctacttcatatggcaaggttgttgcttggcttgtataattacatatataaaactccaatctctaaaactgaattcagggtatagcttctggcttcctattgagccacatggcgccctataaatctggttagcccttctaaaaatttgccacgtgtcaccacttgattcaaagccatcggattaaaaataaacggtagagatggggcaaaggacctaaccgtaaaacttgctatttaaagggagtttatggtaaaaggtaggatctctacactggtggagaaagcgtttgtagtcccggtttgtaacccccctttagtcccggtttctaaaccaggactatcaatccgggactaaagatcgctatctttagtcccgggtaaaataaccgggactaaagatggctcagccacgtggccggctgagccatcaatcgggactaaagattgagctgaccttttttttttgcatggccctgttgctgcatggtttatatataccatgcatatatatgtttcaatacatatatatgcatataatatattatatatatatatatatgcatataatatatatatatatatatatatatatatatatatatatatatatatatgtttcaatacatatacatgcataatatatatgtatttatacatatatatgttatgcaaatgcatgtgtgtgtatatatatatatatatatatatatatatatatatatatatatatatatatatatatatatatatatatatgtgaaagcacttaacattttttttgcatatatatatatgaccaaaatatatatttacattaaagaaaatgtgtacacatgcatatagaaaaatagacatgtattaattacaatccattatgatgtcctagctagctacgatttcgacgtagtagtagtcgttatctcagaagctaaggacctatgaattgtatttccgtcgtagtagaattcacccttgggatcaaggatttgtttgttgatgaatcccatgagttgttcttgaaccgccgcgataaattccttgtgtgtgatcaggttatccctcatgcgaataaactatatgaatgtatgaaattaattagtaattaaacaacaaatcgatacgtaatgaaaatttgaatttatttgtacgtacatcgagctctcttgtggtgatgatttggtttgcaaggcagtggcaatactcgcacacgtagtagccacacaagttagttccatgcttttgctttgcgcactataaataaatgacaaacggcgagacatctaattaatatacacttgtatgtatttgaattggagattcaatataaatgtagagcatgtgtactcacaggaaaattgaacttccgcataagtctttctctccatttgccgcggaccaaatgacggaaccgataccaagccctacatggagtttaaagctatgattcttagtagcaattaattataacaagattcttaattaacataggaacttatgacaatacctgtctataagttcgaaaaccttgtcaaacgtagactcttttttatccattgagtcatatatgttgacggtgcaggcctccaggtcgaagagtaacagcacctagtggaatctgcaatgtgcgtgggatgcattacatatgaaacacttagcatgttcgtatgggaatgaaatttggtataggaagacagtaaaattaaactaactctgtgttgtacggcaacagtatgaacgtcttgtaatgctgcgccttcaggagatggatgagattttcctctgtggcttgcggatactggtcgagcattgcgacgtttactttctgagggtcgatgaatccagtatcgaaaaccccccaccgtcgggccctttgaatctccattctacaacgataaaaggaagtatatattatatatagtctacttatatacaaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtctgtgtccctgatcctcgctccgatcatctctctaccggtggcgctcatctccatgtacagttgatggaacttgtacatttgtgtgggtagggactgcaactgctcaggcttgacaagcggtttaccgagttcgtacatgtatttcacttccgccttttcgattggtgcgcctcgtagcaattgatccgtagttagcttggtgtcattaataaattcttgtattccaaaatcttcaccggtcaccaacggctcgatctcctggtttggttgctctccaagctgagggactggtttggactttctagaagatgctttcttgagtgttcgctcatagtccgatagctttatggcctccttggcaggtgcagacatacccctgaagaagttcctgacactcgggtctataggaatcttcttttctggacttcgaggcttcaattgtctcctgacttctgatgccacataagcgtcaagctaatcttgcgtgcaatcgtaccccaggtccttgttcttggcagcgttaactttcgccttcttcgttgcccttgtgggggcagtcggtggagcttggggagcccttgacttggaaggtgtcggacgaggagcttgcggaggagtcggtgcaggagcctgaggaggagtcggtgcaggagcctgaggtggagacggtgctggagcatgaggaggagacggtgtaggagcatgaggaggagatggcagtgccggaggagatggtgcacgagacgccgcttgtcgcccaggaaggatgatgtaccacttgcgccatagtataatggcgtggcttgtgtctcgtagatgcgtctcaccgtctcctctagggtaatccaactcgaggtcctcgtacgcgccttcgaccaactgaacttcgaccttggagtatcctgctggaatcggcctgcagtggtaagtacctgaagggtccattgggatggccatgcccgacgccaccttcacgtggtgagaggttgtttattagtaatcaacatatataagcagcaacttgcagaatggacaaatctaaaatctataaactacgagcttacctttattgataagttctttaagggaatatgcagctcacatggtatccgctgagtgatgtcatcaacggggcaggtggtttcgtcctgggtttgcatggcgtccatgctctgtgatcctacctgccccgttgaggcgcagctgctacgatttcctgaagggctcaccattgcaggaggaatggtcggctggggatcatgggaccgatgtgcggccatgcgttcatcaaccttccttgccacctcctcttgcatgctgagctcgtagctcgataccctgtactcaagatctacaatcttcgcctcggtatctctcttgctcctcatccgaatcctgtacgtgtggatgtcctccctgaacccaatcttccaaggaatcacccctttccctcgtgttcgtcctggatgctctggagtctgcagggcgagtgacagctcgtccttctcgctgtcaggtcggaacgtgccctgagaagaggcttccactgcgtccgttagtcgacgcgcagcctcgcgtatctgatcgctgaagaccagggagccatcaactgggttgagcgttccaccgtgagcatagtaccagaacttcgatcgatctggccatttagcagtggccggtttgatacccctctcaagcaagcttgcctccatctcctcccacttcggcatcgcgacgctatagccgcctgaccccaagtggtgatggtacttcttcttagcggcattttctttgtttctttccaacatcgcctgcccttgttgacttgtcttatatgcaacgaactcgtcccagtgatcccttagctttgggaatgtgtcgaagttcggtgtctgtcccttcaggatatatttttggtacagatctcccttgaagctttgaaactgttctgccattttctttagagtccaccttttcactttgtcctatgtacccgtgggaagggtgaatgtctcgagcattattgtccacagcatctctttctccgaatctgggacaaagttctcatgatctccgagtgcccttgttctgcgctagtacaccgtactaacaggcatgttatcccgcacaacccaaccgctgtgtcgtacgtagttcttggctgcttccgccggggcactaggtcggccgtcttcgtccacttccgttatgatgtgccgaccctcaagcttcttcacggcacctcgttgcccgcgtgccctcttctgtcctgcggagggttgacttccactagcctcctcctccaggttcccctccacatccctctccacgtgcccctcctggttcccctccgcatccctctccacgttcccttcctcgttcaagtactggtttggatcctcgttcccctcttcttcgttccagtactggctgcttccctccgcgattgtatcgtacaatatctgttcctcatcgcgatcagccatctgttcatacaagaaatagttgctaagtctataggtcatttttgctttaacaatcttatatgctaacaatcatatatgctaagtcatatatgctaagtctaactgtcgtatatgctaagtctaattacaaatctaataatcttatattaaaactataataatcttatactaaaactcaaataatattgtattaaaactgtaatagtcaactatgctaagtctaagtgacgtatattaggaccctagtcaataattatatactaagtctaattacaaatctaataatcttatattaaaactcaaataatcttatactaaaactcaaatagtcatatatgctaagtctaactatcgtatattagaaccctacacaatcttatatgctaagtctaattacaaatctaataatcttatattaaaactataataatcttatattaaaactcaaatagtcatatatgctaagtttaactgtcgtatattagaaccctacacaatcttatatgctaagtctaattacaaatctaataatcttatattaaaactcaaataatcttatactaaaactcaaatagtcatatatgctaagtctaactgtcgtatattagaaccctacacaatcttatatgctaagtctaattacaaatctaataatcttatattaaaactataataatcttatattaaaactcaaataatattgtattaaaactctaattataatgctaagtctaagtgtcgtatattaaatctaatagtcttaattgcattaaaaatctaacaatcatatatttacatcacttgcctgcgcgaattccttcgagggctagctaccactccgacttgagggacgacgacgacaacgtcttttctgcaacatacaaaaagatgtattaggataaacgcaaagtaacatatattgtatttcacgttcgcgttctcgttaagttcatgtttcgttcatgatcgttcacgttcgcgttctcgttaagttcacgtttcattcacctacgttcgttcgttcacgtgcgttcacgttaacgtatgttaaataatgttcgcgttcttgttaagttcacttttcgttcacgcacgttcgttcgtttatgtacgttcaaatacaacgttaagttcacgttcgttcatgttcatgttcgttcacgttcgttcgttcgttcacgttctcgttcacgttcgttcacgttctcgttcacgttcgttcgttcgttcacgttcacattctcgttcacgtttgtttgttcgttcacgttcacgttctcgtttacgttcgttcgttcgttcacgttcgttcattcacgtttgtcacgcccagaaattcacgaaccagaatttctaagctgaatgtgtattaaacccctgtccaggaccagccagggtacacaaacgacaattgttgacatacagatccacgtcttacaaaaacataaaggattacaaatgcagcggaaaaggtaaaagcgagctaagcctgaagacttgactcctgcagcgggcgattccattccataggcaacccttgacggcagcgacgaaacccacctcttcaagacatctccaactgagaaaaacttcaactctggtgtgggggaaaagagagcaagactgagtactacccactgtactcagcaagtcataccggaagaggaggtatgatgcaggatataaccaaaggaagctaggggttcttttgcataaagcagacatttcaaagcagtagttgaaagcagtaaaatagctgtagtaattaatcaatattaaccaatcactgtccaacgctacaccacgttgcaacaggcccaaccaaccacctgaactacaccagttcattaagctagactaggggtgagactaatcacggtgaatctggttgatcgcccataaccgcgggcacggctattcgaatagttttactctggccagaggtgtacaactgtacccacaagacacgatcccacacatgtcgccatgctccaaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggctgacccaactccatcacgcccaccctcgccaccggtgcctaggaaagggtcgagctatacttcagatcaagcagttacccactcccgcttgtggtaagcacggtaggtctcccagggtttcccgtgaaccggtctttaactgccatgggtgcgaccagcaaaaccatgcacccacagcccaccatacagtgtattttaattaactaacaccattgcggtggcaccaatctaaagttatgccaatagacagagtctatgtaataaagtgatccccatttgtgtactagttgaactaagcatggctaagcatttcctaagccaacatctagtcattttaaatacccaagttatcaatggcatatggtaaacaataaatggctgagtaataggacccatcccacattacattgtaaaaggatgcaacatttaatagaaatgcgggatatttgtaaattgggtacaatatgatcaaacgtattgcatgacttgccttgctcttgcactgatgagacctcagcaacgtcttcgagaaaccgcggatcgacgaaacggccgaaatctacgcgacaaacaaagcacacaagcaaaacatgctataagactactgaaacaggaaacaaaagtatttttaatggattctttgcatttttcttgatttactgagacttgaatggacttaaacggagctcggatgaattacttatgaattttagaagataaactgtgtttattactataaaagaaaagccttaatgtatttattgcgcaataagtcccagggctgacgtcatccagggggcggcgccgacaggcggggcccacgggtcagcggctcaaaggggtggtctgccgtggaccgggtccacggggccggggtggtggtgtaccacgtggcaccacgtggctggccacgcgggccacgggatggacggccacgatcggccgagggccgatcaggcggctggggacggccggcaccgaggccagcccgggcatggcgctcgggcacggcatggccggcccggccatggcgcgcggcggctcggcgcggccaccggcggcgagcggcggcgcacgacggcgagcggcggacagcggcggcgctaagcggcgggcgtcgcgacaaagagagagagaggaagggagggagaccggtcctcaccgaggaggcggtggcggccggcgcggggaaacaaaggcggcggcgacgaccggcgacacgggcggcggatgggcggtggcaacacctaaagaaggtgaggagaggagttagggatggagaggacgaccgcgacgaccaaaatggccggccggagatggaaacaatggcgagcacaccggcgacgcggggaaatcggagctccggtggtgattcgcggcaacgaagcggcggccgaggtagctctcgcggcggcgaagctggcggaggtgattgagcggcgaggcgacggctctagcgacgacagcgtgcggccggaggcagcggcaagcggcggcgctagcggcgagcggcgcgggctcggtagaaggcacgggaggggacggcaaatgggtgaaacgagagaggggactcgggggcaggtttttatgggcgaaggaggggcggaaacggccgggaatggcccctatttggccggcgatgtggggagtggagggagagagagagaggtggattcgaatgcgaatcccgcccatttttgggcgggcgcgagagcggggagaggtgggggaggtgggcggcgacgtggacgcgggtgcgggcgcggagtgggcgcgggaagagcggaggaggcggcggcgtggcggattcggcggcggttgccgtcggaggcgggtggctggaggaaggggacgacctgacaggtgggccctacctgtcaacgtcccggagagagggggaaggagaacgggccggcccacaaggggaggccgagcgcgggagggagtgggccgacggcccaatagagaaaaaagaaggaaaagaaaaagaaaaggaagaaaggatttttcctgggatttaaaattgcactttggtgatttttaattggttaaaattatttccaaggctctaaaaattccactaaaattcttgttaatgcattggagcatggggaactcaagaaaaattccaccacactatttccgattattaattgcatttattaactagggatttagctctaggttaattaagataatttctccggacgatttatttaacaaatttttaaagcaagcaaaagggggaaaacttcagggtgtgacaacgttctcattcatgttcgttcgttcgttctcgttcacgatcgttcattcattcacgtggcggcagcggagcggcggtgtggcggcagcagagcggcggcatggcggggcggttgcggcttggcacgacggcggcatggcggcgcggcatcggcgtggcgcgttgcgtggcggcggcgtggctgcgcggcatcggtgtggcgcggtggcggcgttgcacggcggcggtgccgtgccgcaacggcgtcgtggcgcggcttcattggcactgccagtgcgacgtcgtcgccggtgccggccgcatcgaggtcggggtcggcatcgtcggcgcggcagagtcatgttcggccgcgacgacgtcggcgacggcgtcggcaacgaggcagctggctaaagatattttcccgctaaagatattttctatctttactcccggttattctcatcaaccgggactaaagatattttcccgttatttctaaattctctttaaacccggttaggggtaagaaccgggactgctaataagcgcactgaatattaatttctattacatatgtgtttctaaaatagaaaataatgcattaaaattatttaaagtcgaaaattaaatgacaattacttcgaaaaattattgttgtctgtagtaaattaagtggataaaacgtaataagcaaatatatgatttaaaattaataaaaattctaatagccatatatatttagcatatgaatgatattaaattaattgttaaaaactctaattaacatatgtaaatgccacatgcatgatttaaaacttttaaaaatcctaattatcgcatataactagcatatgcatgatttaaaattgttaaaaactctaagtaacatatgtaaatgccacatgcatgacttaaaacttttaaaaattctaattatcgcatataactagcatatacatgatttaaaattgttaaaaactctaagtatcatatgtaaatgccacatacatgatttaaaacttttaaaaattctaattaccgcatataactagcaattacatgatttaaaatggttaaaacctctaataatcgtacgtaattaacatatgccatacaacaattgatttatatggataatcaatacatccaaaatagtttacatcgtgtacacaataattatagcaatacatcggcggtgacggttgaccgcacgtactttctcctcactattgttccctccttgtgatcgctacttgagtaaggggtgtctttatttgataggaggatgctagggtcaatcgtcaccatgaaagggggttgcccatcaaactgatcgtaatcctcgtcagtcttgtcctcaactccgacgatttttcttttgcctgggagaaccacgtgacgcttcggctcgtcaggccctctgcccttctttcctttgctagacaagtccttcacgtaaaagacttgcattacatcattggcaaggacaaaaggttcgtccgagtatccaaccttgttaaggtcaaccgttgtcatcccactgtcatcaatcatttcggctccaccagtcaacctaacccattggcaccgaaacagagggaccttgagagaaccatagtcaagttcccatatgtcctcgatggcaccgtaatacgtgccagttgttccattgtgtcccatggcatcgatacgaacaacattgttttggtttgtgctcttcatgtcttgggctctcgtgtagaatgtgtacccattgatctcatatccctagagtgtcacgatcgacccagatggtcccctcgccaggaaggccagttgttggttgatcgtctcgttacccatgagatgttgtcgtagccacgcggggaaagtatcaatgtgatgccgtgtaatccatgcatcggacttaccaatgtttctggcgcgaactagagccaagtgctcctcgatgtaaggagctaccaatgaagattgttgcagaaccgtgaaatgggctttatggaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacgattacgaacatacttcttcagaacgcccatgtacctcttgaaaggaaacatgttgtgtaggtacacaggcccgagaatactgatctctttgacaaggtgacaaagcagatgcatcattatattgaaaaatgaaagtgaaaatatcaactcaagactgacaagacattgcaccacattattctgaagggcttctaatctatccggatcgatgacctttgtcacgtcccaaaacaactctaaaatacatcctctaaattatgcctagaataattaaaatccgtgtgaaagcctccaacaattaaaatgtgcaaagttaaaagtcaaataaggcttggaggatttttgtatatttcctaaaagtctaaaatgtgtaaataaattttagtggaattttcagagcacaaataataaatattaagaaataaacaaagttaaaatggttttataaaaagaaaagctctaaaaaagtccttttcccccctctcccccttgggccggctcggcccatctccttccccctccctttcctctccccgcggcccattcggcctcctccccgcgcgcgcgccgctgacgggcgggcccgcccaccaccctcgctgacgggtggggcccacccgtcatccccttcctcccgccgctcccgccgcctcccccgcgccctagcgccgccgccgccgcgaatcccgccgcctcccgccgtccccgcgcgtaataaagtggggggaattattccccgggatcccctcccccttttcccccatttttctctccctctctccctcggattcgtttagaaaccgctcccctaacctcgccggcgccattaatggcggccgggtctcccgcgcccatttccccctctccggccgccctctctcactcccaaccctatataaaccctccccgagctccccaccaccgtttccgccactcaccgccctctctccccgccggaatcgagctcgcgccgtcgctctctctctccgccgtcaccgccgagctccggtccgccgccgtcgtcgccccggaccacctcccacctcggcgccgcctccttcgccttcgccgcatcctcgccgacctcgtccacctctccgtttcggtcgccgaccgccggagcaccgtcgaccctgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgcagcctcacgccgctgcgccggcgtggccgcctccgggcgcaccgagcggctgccgcgtggggcccggccgtcagccgcccatgccctcgggtgcggctgctgcgtgggccccactcccgtggacccggtccgcgcgcccctcccctcggctgacgcaataaaccttttttttaattaaaatttaaatgaagaaatttgcaaatattcatttaaagagcatataaacttcaaatggccataacttggccatttgaactcggaattggaccgttcaagtctctaatttttccttaagaagtcaagaacccatttttgtgctttgtttcagcttgttatatggagtttattagagtaaaagccttttcttttccgttggtcgtgtagacgctgcagcttcggaagatccgctcttcgtggaagttaaagccgacgtttgggaaagcgagcaaggcaagtcacatcatccttgaacatattgaatcccagtttataaaattattttgatttaaattattgcattatcgctttatttaaattcccacgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaagcaacattaggtggttttacaactctagactttgggaattttctcatcacctggacactatggaatggtttgattattgtggaattggattcacaccgccccctctattcaaaatccccaaaatggttttaggctgggctcggggtgcctggttttgatagtagcacctcggccatataaggaccggtcttcgggcctctgttgcaaagcactaccgtacttccacatgtctagtgggtaaggcttagtttgtggctcagcctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctacctacctgtcccgggggttccggccgtaggtgggatttggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgttttaattcttaaaacctgtttaacaactaaaatgtggaatggttggcctgggttggcttgggacgagctgggacccagggtcgggttgccaggctcgtgtgggttcacggccttgtttaataatattgtatagctctaggaccgtatttacaaaatagctttgagcaactaagtgtcttttaatgctgtttactgcaaaccctaaccctttatattataactcccttgtactcccttgcatttattctgcacttgtgggtgtgtcttgttgagtacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattatctatttacgcttccgcttgttaaactctgaactgtatcaacttttggtgtaccttgcctcctgggacaaggaataatgcacacacgtaaggaacgcccgttgggttatttccggtcgtgacaaccttctgcgaaattgcgttcatgaatgcacatagttttgttattattgcccggacattgtctggaaggataccccttattacaactagtagcagttgtgtcatcaacacgtgacagtcatgagactttaggttcgtgaacttcttctccttcgtgcttattattcgcttgatatttgtggagtatccagatggtactttatgctctccaagcattcaaacatactttccttctctgccttgctaagagtgtagctggctggactcaagtaatggcttcctttgtcctttggttccgggtgaaggtcgccgcgttgttccatatgcttcagatcattacgtgcttccagtgtatctttcgactttccatatacacctaggaagccaagaaggtttacgcaaaggttcttagtgaggtgcttcacgtcgattgcgtggcggacgtccaagaattcccaatagggtaactcccaaaatatagagttctttttccacattgccgtgtgaccatcttcgctctctataggctggcttccaggcccttttccgaacactactttaagatctttaaccatagcaaacactgttttcccgctgcgatgtttaggcttcgtacggtggtccgccttatgttcaaagtgcttgcctttcttctgtaccgggtggtttgctgcaaggaatcgacgatgacccatgtacacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctgctgtttgtcctcgtcctacacagggacaccttccttcttccacaacagtttaagatcttcgaccagtggtcttaggtacacatcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccctatgtttcgtgcgtcttttccaaagtctttaaattttctgtcgatgtttcgccactgcgaaccatcggcggggtgtctcagcatcccgtcctgttgacactcttcagcatgccatcgcatcattctagcattccccttgttcctgaacaaacgccttagccgtggtattatagggaaataccacatcaccttagcaggaattctcttctttgttagctgcctgtcaacttctcctggatcatctcgtctaatcttgtatcgtagtgctttgcaaatagggcatgcttctaggttctcgtactcctcaccgcgatataggatacaatcattcggacatgcgtgaatcttctgaacttccagtcctagagggcagactatcttcttagtctcgtacgttgtctcgggcaatttgtttccctccggaagaatgttcttgacgagtttcaataaatcgccaaatgccttgtcactaacatcattttttgccttccattgcaataactccagagtggtatcgaactttttgtgcccctgctcgcaacctgggtacaacgacgttctgtggtcctctaacatcttgtccaatttatgggcccccttttcactttcgcagtcctccttggcgtcctgcaacatctaaccaagatcatccgcaacgttgttaccatcagcatccctttcctcctcgtccgtttgatttccttcaaatccaacatactgagcaaagtccggaatattgtcgtcttccacttcatcttcttccatttcaacacctcgctctccgtgggatgtccaacaattatagcttggcatgaaccccgactcaaacaagtggaaatgaatagtcctggatgcaaaatactccttctgattcttacacttattgcatggacaacaaataaaacccttatgcctgttagcttcggccactctcaaaaaataatgcacgccgtcaataaactctttggaccgccggtcagcgtacatccattgccgatccatctacatgacatgaaaaaaaatcgtacacaaataattatttttacaataatgacaatcatacaataattataaaataattacaaactctttcaacagtcatacaataatgacatatcattattcatacaaaaattataaaatattacaccaactaattcttgtgtactatttctaaagttttaaactaatattaatgtgttgtacttcttttaattttcatttttgtttgttttctattatttaagattaactttcactatattttccttctcaactattttataaaaccttctttagcaaataaactaaatttctatatattctttcttccccacacaaattttctctctcatcaacttacaactaaattttggagataaaaaagtgtgcaaaacatagctctaaatgtaatatgacaaaaaaacattggaggatgaagttgctaaccttttaggcacctccgattttgtatataatcaccaaaataaattcactagaaattttggcatgacctcccctcttttttgaagaaattttgaagcttgctcgggcagctagaggaggaagaagacatatatataggggtgggactttagtcccggttggtgttatcaaccgggactaaagatcaaatatgcccgttaccctttttaaccgggactaaagatcatctttagccccggtttttattgcaaccgggactattgtggaatttggctgaccgacgaaagatggtttctccaccagtgctatcttcagtcgttccccctcctacaacggatcgagatcctcgcaccgctataaacaagatcgatataaatcaggtgatgtgaaaaaaaagagcattgaaaatcaaagatgatgaaaaaaaaacacggcaaaagcaattgggagaataaattgaacacaaagttctttgtgtcagggttatggataccacataccatgtcttatacggaaacaatcttcggatataggaggagttccgcataaggaaggatgaatagagttctacatggaaacgacaagtactactcggattgtatccataatggtttccctagttctacttggataaggggacacctatgggtataaatacaaggccccctaggaggagaggggacacggaacaatagatcaagacacaagatcaacatacaagccaacatgcgccaagacaagacgccgaatatcgacttcagagataagtatgactagtcccctacggtgtctacggatattgtcaggagagacatagtgctgtctttgatctcgcaggatgcggattcgaggaggaatgctaccctattgtcgactacgagtcaacacttcagaccatcaagtcgacaacagttagataggctaccccaaatattatactggtgtgattatggtgaataagagtaacaaccggcttcggccaacagtagggtcattacttgacaatgcaggagcccgaacgtgtataaaaatccctatctccatctcttttattacaatctcgcatatatcctagtaccaacgatctccatactatgcaaatactataatcgcgacatcaaacgtagacactttgcatattgcttgacttcattatatcagctttctataccggggatcaaaattgcagcataaaacgagggaaggacaaacaatgaaataaaaagcaacacatttccaatacttccaactatctgctccctttggcaacaaaagaaaatccattactacgtgcctctgcccggtgacggcgagggaacggaccaaaaggaataagttcatcggaggtcccttaactttacaccaaattcgattttcgtccttaacctaaaaaccagatacaattggtccctgaactatcaaaaccggtgcaaatgaggtccctcagcagtttggaaggtggttttggttgacgtggtgggcacatggttggtttgactaggtctttcgtctcacgtgacattgacgtagtgtttacatggtaatttaaccctggaaaagaataaaaactgtcagcccacatgtcagctacacaccaaataatttaaaattggtggctcccacgtggaccgcacatttcatcctcactcctcgctccttccctcttccggctgcaagcagacggcgacctcggccgccgtcaaggacgcggactctggtgttgacctcggccgttggcaagcaggcggccacaccggcgacctccgtggccagcaaggaaacggccacacctgcgacctccgcggctggcaaggcggtggccaatgcgccggctgggcacacgagagctcagctcacggaggagcatcaccagcaatcctgctagcccttgcctgttcatgttgcctccggccacggtgcttgctagacggtggcatcgccgctgccaaaccgaacgttgcagtggtggtttcgtgtgctgtcgtcaaactttcagaaccgcttgcagtatatagatgaaattgattgatgaccatctctcaacaatctcgagacctcacaggatccaaaattggaatgttcgttacttcattatattttttaacacagtaatatcataagcacacgcaatcaaaagtggttttttttttctcgtgattcatgaaaagaaaccaaggctcggttcttcagtttctgaacttgaagcgatagtgctacaggttactaggggctcagcgacggaactcaagtgcaaccggagtgtcgcatggaggacttctctgcagtggcatgttcaggttcgtgtggtaagatgcagtggcgccgttgcccggcatagtggccggaccatcggatggacagcaaaacgccgccagcgcgccgccatgaagcaccagagtgcggcggcgtccatgtggccgcacatccaccagagtgcgctccggacgtcggcggcagtggcgaagctgtcgggggtgccggagggggccaacacccccctatccgacactccccctcccctggtgctttacgtaacaaggctaggtaggcagcaaacgtgagcccattagcatgttaattacccattatcactaaacatggtctagaaaattaattaacgagaaagatattagagagacaacacagattaaggtcttgtcttcatcgcttcagctttgcatgatgtgcgcacctctccatcctcccacgtaccgatggttgtggcctactggggagttatttctctgatctctctcccaatacaacaatacctaaatatttgaccgttttctatccctgacctagagattgtagtctaacttagtactcaatttgtgaagatgaaaaatcacaatgattgtatggcaaaacatataatacgttgttttattgtcgacattggttatttagtcttatggcttgtttcatccccaccacacccccctaaccttaaatcctagcttcgccactggtcggcgggcggggactccgtgcactcagcctccgcgagtccgcgacagccgcggacagcgccgcctcggcctcggcgaggaacgcggggacggcagcctcgcgggcatcgagcgccgcgagggattcggaggtggaggcatccgcggcggctagggcatcgtccagcgacgcggagattcacgggatcttcctctggtgccccggccgcgggcgaggccgacacagccacagccgcagccagaacacgacgccgtcgaagctctgtgacgtcgacagagccgccaccggacctgtccggatcagggtcgaggtcgcgcgtgcgggctagcagtgtcgccagcgatatccatgcgtggatcgaccgggagaacgtggcgcacctcgttgttgtgctgcggtccgatggagacgatgcggatgcgggtgccgcgagccgcggtgatgtctgtcttggggaagaaagggaataggggcggcggccgccgacgttaggcccatgggggcgggagtggagggagcagaggggagagagatgggagatggggagagagaggaggaagaagaggaggggattgagaatgacaggtggggcccacatgagcccaaccatttttttattattatatgtatgatgctcacatgtgggtcccatgattttattatttttccatgttgaattgcaccgtaagcaccatgttagatgaagatagaatcaaattagccacgtaggccgtcagctaaaaccgctgttcaaaccaccatgggacctgtattggatcggttttaacagttgagggacccgttgtatctgattcctggttgaagcacaaatcggactccatgacaagttaaaggatctcatatgaacttattccggaccaaaatgaccaaagtgaggtacagattggtttgtgggctggatatagctagtagtactactatggcccccgttcttttatctctaactagattttttatcaagattttcaacaaatataggtaacctacagaggggctggaaaaagaagaagactaaaatgcatttgatttatgggtcttctgaacttttacatgcacgtgttatataacccaatcgttaacagggctcgtgttttcctaaattataatgaaaataatgatcgtacctgatcgataaataacaactcacttaggcaacgtcgagggagacaaattaaaagcagaacaatcatgttttttctaaaaaaatacgagccgcacaagacaacgcgagtttaatgtattgatataacaagcgaaaaatacaagtctatagtcctgaaaaactatagtcagggaaaaaaacaaccacaccgcacgtctacaacacccgctgcaagagtgaaataggagattcatgttaaattctaagcaactcgatcacgttgatgtgctctatttcttttaaaaagaatgtaaaaatatgtatttccaagctaattagtagcaaaggccatcctaaccatcggttgattgctagaagggctgattgagtattgtacttaatctgtaccgtctgataataaataaatattagcaaattttgctactatagatatcacgaatttatatttagttttaagacatcataaaaatagatatttgagaaaataaaaataccactatcaaactatgattatttactactttcgttgcttttgcgacttcgtgtttttaactaattaaatttcagacgaattttgctatttgacaaattttggtttactcagttaaactatttaaatcctcacaaattttggttaaccgagtaaaagtttggttgcaactatttaaactatttaaatttgtgttgagttaaacttctctaactttggttgactttataaaaaaattaaattcataacaccaaattaatttaattagattcatcataaaatatgtcttagtagtgtatttatttattattatacatatttgtgtatttttacataaagtcagaagattagcttaggaataaaaaaagaatggttattattgaacctatgatattaattgaggccaggcgactatgccaatagctagctctcatataaatcttcacataaatactacatctactatctatcacacaaaaaatagagattgagatatcgcattgtatgggagcttgcaggtgcaccaagaggtgtgctgattttcaattttgttactcaaccaataccaccacagcagcaaggccaaataaccatgcaccatcacagcgtaccctatcattgtcgttgcgtaaacgaactgaagagattcttcatactcaagaatcagttgcaccgttttatcgtccgactatgctaaatcaggttgttgtcacttcatggataagagaggcatcttggtggttcctcttagggtccacttgtaaaaatagtgatttacagggcgttcaacttttacgatgcggttcctatatagctcaatttttacaagcgttgtttttaataccagcacatgtgaagactgtttttaatacctcccattgtatttttacatgcatgtgcattcttgtggaccgaaaattattttaagtagtgggaggcaatacatgaagctacattatcatgcaggtataaacataatgttttaacgcgaagcgagtgtagctcaacttatttagttccttgtgatgaaactgcctcacctaagttgaagtcatataattaacttgggtcctggaatttacaactaattaattttttttaatgctataggtggtgtacctcatgatagcgaggcaacttcatcaatttcaagatgtgccagcctagcctttcggaaggaatggactatacgcgtgtgtgcgtttataagagtgagttttcacgtgttatgagctcatacatttgtatcgtgtttcataagaaaaatgttttagttaactttaattttggtacggcgaaaaacctaacaattaaatccaataacaaggcatggggtaccatccagttcaattcaatggagatatatagcggaccataaccattcaaccattctttccattagttcaatgaacacgcatgtgtagttgcccaaattaagctagaaaacaatagggtcaacaccacctgattattgttcatttaattcggcctgctcattaaagtagaaggtacaactgtacgtgcttaagatatttgttttggtacaacatatagtatcatgccagccctatttagcacgtgtctataagaggacatcatttcaaaatttgccattaaagcataccatctaaaatctttaaaagaatactccccgtccaagttagctcatcctccgagcaaaggacaccaaaatattcatcattctcaaattaattcttattggttaaggtgctctatcgcttcgtgtcctgtagattgctcatgttttaaatattactatatatcattgcaccaacagaaattaatcttgattggttgtatgcaacatacttaatgatgcatattttactttttacataaatatacaaagagatatcactggtggagaaagtctttttactcccggttggtaaccccctatagtcccagttttccaataaagagtacgaatccgggactaaagatcgctatctttaatcccggttcaaatacctaggactaaagatcgatctttagtgccggttgatgttaccaaccgggaaaaaagagaggaatctttagtccctgttgataacaccaaccgggactaaagagagagtagcgtttttttttcttttgctagatttaatctctatattttctcccgaatctagtgccatgtatatccctaaatcaatccccaaatccacaattcaaagtaacatcctaagttacttataaacataaatcaaatacatcacaaatcctaaaaaaatacacttaaatcaaatacatcacaaatcctaaaaaatacacacaaattaaatacatcacatattatacatcttataaccatgcaatgaatcacaaaattacacatctcaatcaatcacaaattatcaaaaaaaaagaaaagaaaagaggccggccggta

SEQ ID NO: 8045 - DNA, 12172 bp, Oryza sativa
accaaccgggactataaagatgatctttagtcccggttgatgtcaccgatcgggactaaagatcctcggccccctgacagactactgacacggaatgaaccgggagtaaatatgatttttagtcccggttggtgtagatcataaaatagctgtggtgtttttttttgcaaccgggactattatggattttggccgaccgaccaaagatggtttctccaccagtgtatactggttagatgattatttgggaataacttaataacctagagaatgatcaaaacaggatgaagagagtatagttgaagatcctaagagggtagttattttagaacacagctaacatagttttattgcaaaagcgatatttggccttagggtccagatgcataccaaccattgtccctctcatcgaaataatgatggtcaccgtgctttgttgaaacttgaaacctgaattgattgcattatcataaaagataccgtctgctatttccatcacaatcttatcttgtagataatattccgtatggaaataagggcaggtcgaaacttttttctaaaatggcacaattggcaaacttccagtaaaaagaaacattaaatttagggataatttcgttcttacccctactttcatgtctaatattaattttgcccatattttttaggttttcgtttttaccttactttttttaaacgaatcaatcgtttacttttgttccgttaattcttgctaacggtgttaaatgtgagggataaaaagataagtaaacccttaaatatttttccgtacttttgacataatcaaaatacagacctattgatgccattttatagcagtaattttatttgtcaaaattttgtaaaagtttgccaaaatttgggtcaaatttgaaagtttgtatgaaagtaccggaaaatatctaagggtataattgtcctttttaccccacatttaacaccgttagcaaaaattaacggaacaggggcaaactgcttattcgtttcaaaaaagtgagggcaaaaaataaaaaccctaaaaaaaacaggagcaaaatcaatactggacatagaagtaggggcaagaacaaaattgccccttaaatttaacattaaagtcactacgggtgaggaaaatcaatgaaaaatgagtaaattttacaaaactatagttgcattagtcaaattatcacaaaactacatatttaacattaaatttcttatagaattacatatttaagatggaatatcgcaaaactacatatttagtaataaagttatcacaaaactatagattttatatcaatttgatctcaaaatttggacatttataactcaaacataatattattgccaatgatttaaactcaaatttgtagttttgtgataatattattattaaatttataattttctgctacttggcctttaacatgtagttttgggataaatttattgttaaatctgtagttttgttatacattacttttaaatctatagttctgtgattatttggcctatgtatatgttgttctgtgaaatttactcatgaaaaattaaagtgacataaataaaaattgacttcctcctcacaataaagtagatatatcgttccatcaagatgatccggctgatgcagatcagataatcgtatgtaaaattctccctccgtcccaaaatataagcatatttggactttgacatggtcttcgtgatgctactttgaccaataatatttataaaagtaatatgttttaaataaaaagagttgtaaattatgatagtttgtttagtgataaatctagcaatatcaattttacatgattgatcttttttatttttttgctattaatagttaaagttataaatatttgacttgtcactatgccaaaagtgcttatatcgtgggacggagggagtatgttagatctttctagtaaaaaaggaatagttgtatttctatatatctactagaaaaagtgcccgtgcgttgcatcgggtgaagactattttaatcttattattgttatatggtttagttaagatgaaattcactatgttaaatttgcttggatatatagggtgtgtttagttcacgccaaaattggaagtttggttgaaattggaacgatgtgacggaaaagttggaagtttgtgtgtgtagaaaagttttgatgtaatggaaaagttagaagtttgaagaaaaaatttggaactaaacacggccatattttgttagaaaatcatgagctgcaattaggagtccgatcgtctcaaattagcatgcgagtttttttaaagagatttcttgtgtattttcaaaagcgaacatttaaaaaccgacctagacgtaccaaagtactgacaaaaacatctttaatttttatatttttttgaataaaagtagtcgaaccttttgtaaggagtcggacattttttgaagtagattacggacgaaaaatcttttttagggagtcgaaccttttttagggacttttttttaggtagaagttttttttttctttttttttctcgtcttttttttctccaccagggagtcggacgcccttttatttttctttttgttttgggatagatttttttctcttcttttttttctctcctttttcttttccaccggaggagtcggacttttttttccttttttgccgattgaagttttttctctgttcttttttttctcaccggacggacgacggaaattttgttttattttttaagtagtatatatataagtagaagtagaagtagatatagagatatatagacacaatctgtacatttttgcaggtggggtacaaccatgcaacaagaagtttctttatccctccatcaattattcaattacatttgctattattcgcccatatactttgtgtaacgggcactcaccggctcaccactgctaaaacgatttagggagtgtttgaggagaaggggatcgaggagattgggaagatacgcaaaacgaggtaagccattagctcatgattaattgagtattaactattttaaattttaaaaatggattaatatgattttttaaagcaacttttctatagaaattttttacaaaaaacgcaccgtttagtagtttgggaagcgtgcgcgcggaaaaccaaacaaactctctctctttctccacccaacgaacgcagccttattcaggatccaggcgttcatattcacagggcgtcccaaatttctaggccacacagacactgctttttcaaaattgtctgtcctttctcaaggtcttatactgccaaaaaatcctatttcaacacgtggttatttaagaaaaccaaccatgcataagcagagaaaaaggataatatgccactccattcggtgggtttcgatgaaatgccacctaatgtaaaggatgaaataccactcactgagttattttcgggatattttgccactgaaaaattttaagaccaaaatacattggagagagaaagagagaggtgaggggagcaccggggaacatcgagacggcggcgtctgtgctcgtcagcggccggtggtgagggcgtggggacgaacgactatgggggagggggacggtggtgccgcgagcagcgggtgacgccgaagaaggtgagcggtgagcgcatgcgcgggtggcgccagaagcgacgagcatggagcgcgcgcacgggcggcgccgaaggcggcaagctacaagcgcgtgggtgggtagtgctggagagccctccgcatcgtcgccgcctcctcctccctctcatcggcgccaccctcctcctcccccagtcaccacccttctccaccatcgccaccgccgtctccccatcagcgccgtcgtcttcctcctcccatcagtgtcaacgtcttcctctccccgtccgcccgtcgcagccaacgccccacgcccaccgccgggaagcatgagtaccgtcgatctcaaccttccccgctcctccctcttccaatttatccacatccaagggtattttggtcttaaaatcttccaaagtgacaaaatatcctgaaagtaacctattaaagtggcattttatcctttgtattgtagggggtggcattttgtcaaaacccgattcggagtggcatgttgtcctttttctctgcataagcataaaggcaactaaggaggtttttctaacgaactgcacgtggaaactcacttctcatttctctcccctcctctctctaaagacatataaaaatgatttttaccggcgttatataacgaactaacattgaaaacataaataatactattttttttaaaaaaaagtcataactttaatatatcaagaacgaatgatgacaaattttgtatcaaaaccggaactctcgactagatatacaacattttacttgaaagttttctcaattgagatcacacgttttacttgaaagttttctcagttgacatcatattaggggcccaaatgttcattaaaatgtttttcttgttctgaaaataggttgatttttacgcaaggttctctttataatctgcctgcaataaatagttagtgcatgcagtttgttgatattttatttaatatggcatgtgagaatcactattagattttcacggacgagacctcttggaagctccaagcagactgtaatggcgttcgcatgcaaaaataaatagggtggatcaaggccagcttacggaaagtcattttcgcatattggcattttaagaggcccgcaggtgaaaatgagttttgcagtcagatgtaaagtttcgaatgcaaagtgtgtttgtcaaaatcaccttcctcccctattttttttctccgcctcctctatgtccccactcatttctctcccctcctctctctctcacttctcccccttgtcccgtctagcctctttccctcccactcctggcaacagcgagcggggccgcaacagtgtcgacaagagcgggggcgagctcgggcgacggtggtggccacaagaggagcggatccaacggctactccccctcctgcgtggatctcaccgcctctctgccctccacgtgtgcagatccaccgaggagacgggcagatcctacggcttcaagcgataatgatgacgaaggcggcagcggtggcggtttcgagcgacgatgatactactacgaaaaccatcttttgtggcagtcattttgggttttcgctgacggtatttagcgccgccacaaaaaaaaaggccaatgaaaacatagcatcttcgttggcggctctaaaccgctaaagaaaataacttttcgcttgcggacggctaaagacaaccgctagtgacaatcatttttgcttgcggctgtcgtatgtgggccgctagcaaaaatagtcttcgctgacggctaccttatgtgctccgccagctaaaatagtttttgctagcggcttcttacgcgatccaccagtaaaaatgattttctataaaaaaaagtaatccccaaaatctcttttcgccaaaaaaaataaataaatcagattttcgcagcatgtacatattcaaatccacatccaaatttttgagtatatattcaaatccacatccagagttcattagattcaataatgggtgaatagccaattcagtccttcaacttttgctcaggggtcgaattagtccttcatgttttataatatccaaacaagacctaaagattatcatgcggcttaatatagtccttagaccaacttaaaacgccacgtggatatgccacgtcatttgtgcatataagataacatttaaatgtccattttaacctttaattttctatcaaataaagaaaagaaaaacaagaagaagcaatcataaaacaaagaaaaatgtcaattatttttatctatcaatgctacatatttttgccaatggtcaaaagctttttttgccaatggtcaaaagcttttttttgtgtgttttctcaatagtttttcattatttcgtatgaacagataagggtgtaaaggacatttaaatatttaatttgcatgcatagatgatgtggcatgtacacatggcatgtttagagggtcaaaagactatattgaatcacacagtaaactcaaggtacttgtttgcacaatacgaaatgtcagggactagattgatccttaagcaaaagtttaaggatcatattgggtattcacctttcaataatcatacgagtgaacacgggcttacaaacatttagaacatgaaaaaaaaaactgacaaaaaaatcgagcaagccccgcagcaagcaccaagccgtcgctgaccaggtcgtcgtctcaccgaccgagcagcaagcaccaagccgtcacgccccgcagcaccgagccgtcgccacacccgtgggagggggagggggaggagctcgtcgcgccccgcagcaatgagtcgtcgccgcgaccgttgcagcaccaagccacgtgggagggggaggacgaggaggaggaggagctcgccgcgccccctgtcgccgtcgagccccccgacggctcctcccatcgtcgtcgccatgcccccacctcccgtcgcagtcgctgcgcgtcccgttgccgtcgagcccctcgatggctcctcctgttgccgtcgccgcacccccccgacgaccgcctcccgtcgcagctgtgcgcccacctcccgttgccttcgccaccacacacagctgccggagccgccgccaccacccgagaaccccgccgtcgccgcctgggaggaggagaggatgtggatctggaggggaggaggagaggagggtgcagggatttggaggagaggaagtggatctggatctggagagggagaagtggagatatttttattatgcggtggtgggtggataagggtatgcctgtatgggcgcgcagtgatttgtttatgtgcgaatttttttaagagcgccagcggaaatcaattttcacctgtggttgcttaagtgagccgccagtaaaaagaattggatcttcgctatcgggctatataacctaaccgccagcgaaaattatccatctttgctggcggcgcatctaagtgaccgccagcaaaaatgaacatatcttcgctggcggccggtataacgtggacgccagcgaaaatccattttcgctggcggtcagtgccccccaccccctcattacgatattgctggtggttttggtattttttcgccacgcataaaaaatcgtttttctagtatatgcgactggaagggaggaaccaacaacggtgatgtttgcagtggattcaagcatgacggtcgtgacagattctagggtttctggaatttggattttgatattcatattttttattattttgccttttttgttttgcaaatggacggcttaagggcccacttccaaaagttgtattttcgaaagcggttgcactacctgcatgccaaaatattcatttcatagggtacaggtgggaagcccagccgcttctgaaaatcgattttgaccgcacgtaaaaatcgactatgcagtagtagtaaatattttcttaaatattgtataagatcgctaatacaaacaatagggtcaacactatatgattatatattgttcatttaatgattgggcctgcttcttaaagtagaaggtataactgtacttgatcaataataatatatttatttgctaagtgccatacatcatgtctatctgtttcttttagcttaggattattataatccagattattgggagtaagctgaaagaaaaagacaacttattgatgtagcttattataatctgataagcttatttagctgagctttttacagattattgggtgaaaaattacccaccatgccaccccactccctctttagacttacaaacccaataatctaggctctaataatctaggaaagaaacaactaaccgcttattttactacagattattttactacagattataacaatctagcttacagtaatctgactcaataatctagattataataatctcaaactgaaagaaacaggcccggcccgtgtttctaaatttaccattaaatgttattatgaatagattaaaagaaaaaaaatgaatatcctataggcgtatcattgcattactttcagtaaaataggtttggagttattaattgatttacttcattagcacaaaactaacaacatcaatatttagcctaagggtccaacgatatcgatgcatatcctctttggagagggacaatataatggtctaaagatggtgacgatgctcggttgaatcctgtatttcatgcattaacataaaagattcactgagcaatcccacactcaacttttcatccataatattctccacagatataaaggcatatcgaaacattttctggtaaacttctaaagaaaatctgaagcactgcaaaaatgcatttaactgatgattgaaataactcatagaatgcattgttttacttttattttttttcatatgcaatacataatagacaagttgtaatgaaaaaggtgtagacatggtttcatctacatgaaacttgttttattttttacttcattaatttttttatcatatctctactattataaaaattgaatatgtttttgccgatattttttttaagttcgtttgctttgggaaatacatattcatattcggatcggtttttaagatcgttcacttttggtaatacagaagcaatcatataagaaatctatttaaaaaaactcgcatgctagcttgagacgatcggactcctaaccgtagctcatgattttctaaaattatatatatgcaagcgaactacagagtgaatttcatcttaactaaaccgtatagcaataataaaattaaaatagacttcacccgttgcaacgcacgggcattttttctagtctatctatctattattatatactaaaagtccattaaacttcctacaaacgctcctaaaccgccacgtgcccccctacaaacgctcctacgccgccacgtggcactctaataaattagaagaattaagcaaagcatctagccgttggtttttcatttaatctggtggacccactatttttaaccgttagatatagcataaaaaaatatcaattagatttattattatctttaaaaatccacacatgccccgtacgtgtacgtgcatgtatgttacatattttgtatgtgggccccactcccccttttcttttttctttttcactaacacatgaagaaaaaacaaaattcatattccaggccatatgattcggagtatgtacttgcatgtagggccccacgtcccacttttcttgtcttgtattatacgcacgtgagataaaaaccacgttaataattccaacccatagttgtacaaatataagttattttgagttgtattgtattatacgcacgtcatcgaaatattcataaaatatctaaataaatgaataatatacattatataatctatgagatatactaaaagtccattaaacttcctagaaatactctcaagccaccacttggtgctcctacaaatgcttctaggccaccacgtggctctattaaatctaaccgtctattttcacttaaattggtggacctaatattttagaccattagattaaatttaaatcccaccccacccctactccaccacctcctaccgtacgtacgtacgtacgtctgtccgtccaccccatatatataccctcctcacctattctctatttctattattaagtaatcaatttctcataaaaggaatcaacagtcagataagttcaagttaatggctataatttttaatccatatatctacttgatttcatggttttgaatggtttgagtttagaatttatttgttctaaaggtctttacacacaaatatatacaatcaacttaaaaaaaaagtcctaaataaaaacttttaagagaaaggtcaaaatcttaaaaaatcatcctgaatattacgtaatattacgtatttatgtatataggaaaaacttacgtacttacaactgaagaaaccaatgaaagcttacctactggtcgtgtcagaagaaaaaaatacgcacaaaattaccataaaattaccattggaaaaaattgatgatatttcaaacaggatttactattatttaatgataaatcttattactctataaatttacataaatatcaccgttaatttttatttaaattggtggacccgactaatgtttcagaacattagattacatgtctaaaagtccattaaacttttcaaaaatgctcctaattcgccatatgacatcctacaaatgctcctaagttgccatgtgatgttctaataaattagtgaaattctcaaaaattctaaaataacaaaacatattttcattaaaattggtggatgcattattttcaaccattagattaattttcaagaaaaaattcatctcctaaacccgggcccacctaagcctgtatgtataagttactttttttttttacaaaaacgaacgtacgtttgtacgcctcctcttccttcaattcatttgtccacttttcacctattccttcttctattttcatgccttattagttagataagcaataattttgtgttaaacaattaagcttcaaaatcatacaactaatttctgatccacgaaaatctttatattatttataactaaatttacagttgaagacataactaaatttacagttgaagtccatatttcactacaatttagctttgaaaaaaaatgccattttggtttagatttcttgacttttgcatgccattcaagcaattataaaaacatatgaaataacgataataatatagattttatcatcatacataacttcataataattaaattaggtctacaatcataaaagtaaaatgaatatactatgagcaatgtttccaaaatatgttagttcgaaagcaaaacttatgcaaaaaataagcaactataacatctaactcacacaactaatatttcatgaacttatctctttagactattttacatgtaaagactcatatccattgtaatattgactttgagaagaaatatgtcactttggagctatattttctgatttttatgtgtcatttgaacaattataaaattatagaaagataatggtatagattttatcaccatatatgactttggaataattaaattagatctatatggataaaaataaaatgaacctaactctgaggaatgctttaaaaagctactcccccattataacattagaataagtcaaaataacattattagattgtagtgttcgtatttttaatatctactatgaatatactggaaaagacaagtaaaaaggatagattttaatcaatcaataaatcgtttttcaatttttagttaaaaaataattgcaactaaaacactacaacccggtaaaaataattattacaattatatgcacgcgtaatctcttcccttcaactctctcttcctctcctcactcatttaacttctttgtctcctaatttttaactatgtgaaaaaaatcaataattagaaagccaaataattataattcttaggttaaatcataatgttaacttatttgaatttttgctttatttataattaaatagataatttaagatccattatacccatatttcactctacaaaaatgaaaatacgtgatttaaacatagacatcgttcctttgcatggtaaccaaatagaaaaaagacagaccataatacaaaatgaaaataagtattatattatcgtaaatcattgtacatcctctgagcgcacttaaggcgtcacgtgttacaccttaaataaaaataaaactttacaaattggaagaaaaatcatccgatcatcagtttccacttaaataggtagatccactattttcaaccaacagatgtactttttagaacatcttaagccacaatgtgttacgtcttaaaaattagaaaaaataacaaaaaaattgagaaaaaaatagatcatggttttacttaaatcttttacataacatagaaaaaaacacccctccacttcgccccccccccaatcatacgtacaacatggcattactcgtcccatcccttctaggcttgagctctctactctaccccttactgtttatatagccaaaagtaataaaaatattaaaacatgcataaattt

SEQ ID NO: 8046 - DNA, 5936 bp, Oryza sativa
  unsure (1)..(5936): unsure at all n locations
caaactaaatcgaacttccttctatataataaagagatcatagataattatttatacagatgtattaaatatgatatatttttaaacctaataaatatctttgaaaaaattatcaaagcaaaatacccctgatgtgtcttattcaaataaaaaaaagtacttttaaacatgggaggtgccagccgattgatattctgtttatatatatatttcaaacgcaatgtacaatcagggttagaaatttcggtcatttcagaccctttcgatacaatattattccggccaaatttttttatttttcatgaattttggtaatatttgttcaaaatttcacacaaaaatttcggtgatgcccgatcaaattggctgaaccaaaaagtttaacattgtgtacaatacatgcccaccattaaacttcctataaacgctcctaaaccgccatgtggcatcctgaaaacgctcataaaccgccatgtggcactctaacaaattagataaattcctaaaaaaatatgagaaaaaaggaaaaaaaatctagccgttgattttcattaaatttggtggacccattatttacaatcattagatttatcttcaataaaaaaaattcatctcccaaaccggacccacctgggcctgtacacgttaatttattagagaacgtgcgtacgtactcatgtccgtgcgcccctctcccctcctcaattcattgatcagttcttttccacctattcttttttatatttttgtgctttattacttaaatataaaagagcaaaaaaaaatctcttaaataattaagcaactataacaaccaaatcaactaatttttatccggttatatctttaaattatatatgactaaatttagagttgaagaccaaattttactataatttaactttgaaaagaaatatcattatgggttatagtttctgatttttgcgtgccattcaagcaaattagatctaaaaccataaaagtaaaatgaaaactatgagtaatgttccccaaatatattattcataaagtaaaagttatgctaaaaaataagcaaatataatatctaaatcatactataataactaatatttgatccacttatatctttagattattttatatataaagactcatatccactctaattcaaatttaaaaagaaatatatcactttcggggtatatttttccaactttttcatgctattcaaataactaataaaattattaaaaaataatgatatatattttatcatcctatacaacttcacaataattaaactagatctatagtgataaaagtaaaatgaacctaactctaagcaatattctacaaaattattcccccaattttaacattattagattggtagcgttcatagttttagtaaaaaaaagatagattttaatcaatcaataaatattttattcttttttatttgataaagtaatagcaactaaaacactacaaccctaaaaaatgataattataagcacgctacactctccccttctactctctcctcctctcatgtctaatttaattcctttgatgtcttatttttttaactaattactaaaaatgatcaataagtagaaagcaaaatgattattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgatttggagaagatcaacctctgcccctagaggcgcccagaccccccttatatatgggaaggagtccgggttacaaaagataacctatatccctaacggaatacacagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagtcaaccatcgtagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatatgcggcgcctaaagaggcattctagccgactgctttttagccataacaaaagaaatccgagtggttaacactctaaaaggttcacgaatgaacccacttgacaggcatccgaataaaaactctaaagattacccaccaagtattataaaaattatggcaataaataagtctaatagcctaggctatgactatttaccataatgaaaacaggcatataacataccagggaaatgactatggtaaaaacaagccactccaagttaacacagacagcttttgtagcctaaaaaagcttacaaaaacagcataacgcctttctgtcgggcaccttttaatttgcattgcaataattccaaagaattatatgaccgcataaaaaggattttatcagcattgggcaacactattgtgcgcataatattgccaaagcaaaatatgcctaagtccctaaggaatacaatgggccacgctgttaaaagtattgggctgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcactactccactcaaatccaccttcgaaaagtgcatcaaaatccttcccgtgatccaccgcctcaatccctcacttctccccggccatccctcgaatcaaatcagcgcattcgggtaaaatcgatgacggaggagaaagaaagctttgaaggccaatgggcgccgtccgacgtaacggaagagaacctgaaggagatggtggcgcacggcgttctccctgctaaggagatcatcgggtggcggccagcgtgcggtgagatttttccgacccccgatacacacgagattgtggtcttctcgcatttcttctacggcggcttcgctcttccgacctcgaaatttttccgcgggatcttgaacttctatggaatcagcttgcatcacctaaacccaaattccatagtgcatatcgccaatttcgtccatgtttgtgaagcctttttgggaatcaagcctcactttgccctgtttcgccggatcttcttcctcaaaccccaaccgaacaagagcaaaccgtgcgtagtcgggggggcaggattccagctgaggggaactctgagccaaaagtatttctctatgcccttcaagacttcaaacaaagggtggcatgcaaactggttctatgttcagaatcctgaacctgctcttcccgggtactcttgtcttcctccggtgtaccaagatacctggaactctcttccaatcggagatgaagcagtccaagccttggagttgatggaacgcatgttaaaactcaaagaacaaggcttgcaaggagagcaaatcactcggcatttcattaagtgccgattagctccaatcaaagaaagatctcgcacagcatttgagtttgacggcaagcatgatccaaactgtgaagacccagattctctggattttaagatcctgaaggagaggatgtacaggatattctcgaacgctattgtcgtcagctattcacatcaactgccagttgtaccatacaacgcattcaatccgcctccgcaggtatgtatctgaaatcttcaacccaaggtcaaaacataatttcatcttcatgttgagttagctaactgtggaagcatctcgttcaggaatacgtattgatgaaatctgatcccccaattgctcagcgccgatctcctcgccagcacaccgttcagggaagtggagggccgacaatcaggtcagacccacaacctcaaacctccaaaccggctgggcagacaggtcctcgcaagagaaagctggtgcttaatgacgatgagggcgatgacagcaacaaatctggggacaagggcacgcccaacaaactcccaaagcataccatgcccaggaaaaaactggctggccgtcaaatgccaaagattagaacatcttccaggtataaacctctcggtaccattttatttcggcatgcttctctcataggaattatgctaaatatcgaaagggcactttgcaggaaaccgtccgatatagatccaaccggaaaagatcctgatccggctgtgacagaaccaaatatatccaaggatgctgagccgactgctgaaagccagccgactgccgaaagtcagccgactggcgcccatgcttcggatgacaaggccaatccgagtgaccagccgccgactggaaaccagtcggcaacaactgaaactgcaacaaccagagagcccccgactggaaaccagtcggatgtagatctaaatcaagagattcctgaagctgaagcgcagacaacttctcaaggaccagaagttggtaatgactcagtgattgggtctccagataaagagcaaggatcacctcgcgttccgccaggcacatcctcaggtaatctcatcttctcaagtgatgccgttctgaataactccagcttgttcgtctaatatcttgggaatacatcaggtccactaagcggcgacgaagaagaaattctccgcataaaggcagctaatgactctcgtcctcctatcttactcaaatggtgggacgagaactctcaagtttccggcattgttataaatcgccaaaaagaagatgaggaagtgtgccagctgaagaaagtacttggagaagccactcgcattgtgaatgtaagtcttctaggtgactgcctttgatgactttgttttctcgttagcaagactaatccatgaaccaccgtgcagagaatccatcttcgtaatgaagccaagactgcaaccttagaaaagctggttccacatttgggaactcttgaagccgttagggaacagctacacgaggccaaggagcatgccaagaaaacggagaaggaattaagggagcgaattgctcagctccaggattcaaacttcgagctgagtggttcatcaaaaggtaatcttccagatctgctccatggatttatgctgtcataactgtatcctcaaacatttggatttcaaacagcgcaagccaccaggatggctcagatggagaaacaaattgaagccttgaaaagagacaaggtagaactggctgcggaaagggactcagccttgaaggaggttgaaggtattgccagctgacaatttgaactgtcctctctttaatgcagcagattcttattataaatgtgttttgcagaccgtaaaatcaaatctcaagctcagtttgatgtcctggttggtaagatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8047 - DNA, 11173 bp, Oryza sativa
  unsure (1)..(11173): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgggttcggtggaattgggtcatgtggctgttgttaaagctacttaggctgtgtttgataattggggttgggaacccaactccatcgcacggaaaacgaagcggtccattagcgtgtgattaattaagtattagttaattttttttcaaaaatagattaatttgtttttttaaagcaactttcgtatagaaactttttgcaaaaaaacacaccatttagcagtttgaaaagcgtgcacgcggaaaacgagggaaaggggttgggaaacttgtggaaagaacacagccttaattactttattatggttacttttgttcagagctgcttgtttagtattacatgcaagcatttattttcggttggactaccagtgtaatactccttggaatatatgctctatatatttttaaacgttcttatgatccataattatttttcatatacgatctaaataattaaattaaacgttcaaatatagtacggagtaagtatatacttaggcccatatttcgggtattgtgcaaattttacgtcgactaaaattaggcccacgttgagttgtagctgttccaacatttgggccgtaaacaatttcgctaggtcttttgaagggcctgacatttggcccacgtacaaacttttatctgggcactggcttcttccctcgaccgcaacggtgccggctgggcgcggcggtgggctgggcgaggggctctccggcggagaaaagagcggccgacgcggcgacggcgaggcgtcacggtagcggctgggtggcgggggaggatcttgggcggagagaagagcagccgccgcggagagggcgaatccccctccagctcattccgtcgacgggtggtgtctccttcccccgttttttttctcttttgcatcccttcgttttgctcgtctcttttcttataaggaagcagaatgtttatctcgtcgcttaggtcatttggttcagttcctatatatggttgtccttgcgtaagaaaatagtaacagggagagtcaatgattatactggaatcgactggtttagggatgtggaaatttgggagttttcttcgattgctgctgtactgattaatcgcaatgcgacttgcagaaaatttaatgcgccatagttttggtctcaatatataagtatataaccagcgcagtatatgcgaatttgagggttttgtgttcactcgcctccaaacaggcatcgtagtttacaaaaatggaaaaccaactactaaaatcaaaatcaggcatcatgtcatgcattattgacatggcgcatgattcatgtattcatggttgttcagttgagttcgccagggagggactgtactccataagctgtgcaatgtgggctgctactggcttgcgttgaatggggctagttgctacaaaagataactcaattttcaggtgtcaaaataaaccacagattttaagaaaacaattgatgccaaaactagtacacgtgctagagcctggcacaggaactgcaatctatatattaccagttatgcattgttcaccccaagagatgataatgggacaaatcatcattagaaaagcaggcaaacatattacaatgcagtactaatgaggttggccgtgtacatccggttggatgtagaggtcgggtttattccattttctaaaaagaaactaatgaggtacaattacaatagtattttctcatctcagaggcaaatcgtgttctttctagaaaggccatgtgcacattcacttttttctttttaccacatgttagtaatatgcatggccttcggactccaatgccatcattttctgtttatttcttttaccatggccacaacatgcatcaactaaaaatttacggcatttggattgcaatgcacaatagactaaatcactgtaactgtaaatgagaaatcatctcatacaattacttttagttgttgattccttgcaaccattgacgacccatcagttcttttgctctgtccactagagcaaagagaggtgtgccgcattccataaagcctacatcacccaagaaaaccatgtagttctcaacctttgagggcgtttcttctacaattgacagtgcgtccatcatccggaattcattgaaacaattggcatagtgagaattgcactccatcatgtatatggattgctcaagtatcaccctccggatcccagggcagtgagcacttggtttcatgtttgcattcagtgcatccactagcctcttcacaaatctttgcctaatatgtccgtgatctagctcttgggcaaattcttcaggattgactttgcatatctgtgaactaaggccaatgagaatctctagttctgccccttcagcattcattattctttccaacacctgtagtggataatgtagcatgattggtaacaacataattcagcaaaacacggtatattatactctattttactagtaataaatgacccagtttgaaaaaaatgcaggtggaattccctcctctaacataaaataatttatgcaaaaaagcataccacactatccacctcaaatattgcatctgtagcattaagtagcagggctcacctctcgtaaggtgtgagatagttcttttaggtctaattctgtgagcttagcttgggcatgctggcacatactacgtaacaggcttggcgccacatatatgtacttttcatcttggatcaggatcatatttttgagtttagtaatgaactctggttccttcaacataactaagcagttgtgcacattatccattgctagcattgctagtgcttgcccggcgacctttggtagcaagaaatcaacatctgtgttggaggttctatgtaagtcgaggaatgccttcatcagtctggttatgagcaccttcatgttcccaatctcctgccttgtgttaccatcaatggaaatgtttctgaggattcctactgcaagcttttttaattcttggtctctgatgttgtctcccaagatatctgcgaggtttcttaacaagaagggatgcttcgatatcttgtaccgcagtgctttgccgatttccccttcaatgcttgtcagcctctgcaacaccttcagtgatgacttcactaggaccatttgctgtgcttcactgttcattgtgtcacttctgaagcttgtaaatcctatgatcttcggaatgaggtcagttactctatcaatttccacacagttattttgatcacaactagcaagcttgtcaacaatcaacatgccaagtgcaggaagttgatcatggtatgtcaatggatgctccttgggaactgtccagtactctgaaatcttctgcaagcttctgattatgcagttctgttcatggatgtgggctgatcgagtttgtgtctccggcaggttatcagtgccttgaagtgtctcttgttgtctttgctttgggggatcatctgcattcctaattgcattcggtctttcctcttggctatttgctgtgctgagaatgggatcctgcctctcctcttgttcatcgtctacctgcagaagtggatttccctttttaagtttgccatcggtgtccagaagggcagacacaagctgcattgccctaggaacagcgataacttggaggtccttcgcaagctcagcagttactttcgcggcatataatctgaccatcatataatttgggctagtccagcccaacatacttattatcctagccatggtctttgtagaagtgatgagcttttcaaggagccgcgcccttgtcgtctccttctccagaaggctatgcatcagttgaatcccatagagatgattcttgggagagtctgagttcagggaatccatggcaaagttgcccaggctggttttcttcggagcaaacacagccttttccatgcatttctccaaggcatatgcataatacagattgacatattccactcccagctgacctctgaatccagcacgccggatgagggatctccgggggatgaatgagaagatctcgagggtgcatgccacggtgtagagtattccttgggccgtcaccatcgcatagaagacaatgagagatggtaccaggttagtctcttcgtcttctttgttgttcttatgtagtgccataaggtgtgacagtgcgaggcctgcgaacacaacacgcaagactgctgctggtatctgcaagttgcccgacgacaccatcacagcaacaatgactagcatcccgattatcatgaaccgaaagaagccatcagtagtcagtactaccatcactagcgcagcaagcatgcaaatgttctgaatagatcgacgccaagacactagttttctgccccaagcactatctaacaatttgatgattcttgggaactttagcctgctgattgtcaccacgaggacggataccagcaatagtagaaatactatccatttggcaactactgtggacctagttggagcgaagccacccgttcttgtggttatcgatccgtttcctgtaatgttcctgacaaagtcccttgaatggtcatgctgcatggctggagtcatcaacagtatcgcagctaaggggctccatagtgatatggcacggcgtaacgggttgcgtagtgatggctgaaactttggagtcatactcttgccaagtataagcagaattatcatagcataaagcactacagctgccataacattcttatggggaaggggaatcaacagcttccaaacatccagaatgcagacgatggcgatcagccagttccagtcaagaggtctgaaagcactttggttcggaagaacaattggtaatcggacctgttgttgctgccactaaacatcctgaagtatataggatgtgtaagtaaacattaagataaattttatagtccttgagaagcattgagagaaatttttatacctcctagcattgaaggaactgagagatactaaattttacgttaaaaaatgtgatacctcccgatatctcctcaagaactgtaaaatcattcaaacaataaagaatgtgcaaggcagagttccttttagattatttgtgaatgaaaaataatggattaccatttcttaacttaatggattatcaatttgcttataggaaagattaagtcttactatacgttaaaaacctaataaatagcttataaaaagatataaatgttctaatcaatatataaaaagtgttttttttgagaaatagtatttttagaagtatggagcaaatgaaatcatatatagtaatccagaaacttatggcgatgcatattgtctgttgtgacggcagaggagccgcctccagctgatcggcgatcgccatgtattcccaatcgattgcaaaagggtatgcagactagtgattggccgattgcagtgacctgagaaacactccaactttaaatccccataagagcgaattcagattgagttgtttgagggactaagttcccgatttaaaaggatacatgtatcatgttagatgtataggccgggtaaaaatactattctctaaaaaaagaaaaaaaatccccaatccattggaaatcaacacaatggaaacagaacaaataggccctaacctggcggattctaggaagattatggctgtcgcgaaccaaaaatcgttgtacgagccgagtgccgtcagggacgtcgggtatccgccgagcaggacgacggtagcccaggtgaaggccagcgtgccgagcgcgttgcccaccctctcgaccagcgccaccaagctaacgaagccattcagccacttctccggcgcggctgccttcttgccttgctgttgctgcccgccgcagggcttggctgctgctacctgcacccggtgctctcctccgccgccgacggtgacggtgtccgccatcagctcccgtttcttctatccttgttgctagctagctgctcaaatgcagatgttggttacttggtttcaccttttttaaccgctagtttataagtgagcactgttgtttgtccattttgtcatcgcgtgtcgcggctcgcggctcgcttgggtcaaaggtctttgagaaggattggtaagtcttccgtcatccaaaggaggcgagtaggcgacaacgggttgggcccacgatgctatagacgtcttggacggcaagacgaggagcgcgatatgggccttacgtgatatagcggacctgtaggcgatggcacctggcaaacgagcctggaattttttttatttttacattttttttattaaaatatttacgaaaatacttttttttctagaaaatttacaatctagtcgtctcttgctctggatccagagggcgataagggacctaaatgcaatttttttatttgtgtttaaaccctttccaccgtttttaattgcttaaaaactaataatacgtattcgatactctaaatgattttaaatggaaaagtgataaactacaaagttatagatctcatcgagatctacaacttttatataaagtttatctccatccgatgtcgtttgagatgtagatctgagattttttaaaataggttttttattttataatgaatatttggatatctaaaacatcttaaatgaaaaaatgttaactacaaagttgtagatctccttgagctctacaattttgatataaatttttatttcatctgactttatataatataattttaaattataaaatcatagagcaaacaagctgtgctggaaaatttgcatttaggtcccttatcgccctttggaagggcgatttttaaaaatcgccctcctagagggtgagaggcaattagatttgtaaatttttgaaacaaaaaattatgtttgtaaatattttaataaaaaatgtaaaaaaatcgctgcgggtagtagcatagccagtggggaatgcgttcactataggtccctcaacggcgcgtctaaatttcgttcctgaatcacaatatcagatttgacacgtctctcgcaactcccaaaaccagtacaaataatgtcttaagacggtttggatggtgttttagctggtgttgatgtggcacttataatataaaaaaattgatgggacccacatgttagtgagtgtctggttacaaataaaaaattgtagtgggtccccaccttattttctttatttctcttttctcttttcttgcttcttctccttccctgcatctgatagctaggtggcagggagaaggtgagcgtggcgcctttagcgacgacgactggcggagacaaggcgagcacggcgcacgcatcgatgcaggcgtgctcgaatgtctagcccggctagacaacaattaggggtagaggaactccactaacacgatgacgaggacattggcaacttggagggcaacgtcggtggcgaggatgggcaccaccatgtgcagcctcttgtagcatccctacccccactgtagccactgcggaggctggcgtggtgatctccgtgcgagtgtcatggcccagtgggagagcgtgtggggagagaaagaggagtagctccaggagcaagccgtcgggggcacccttgatctccctaaactctgccgcgccacaagtgcagctcaacatttggtcttagagcgcactcctcgcgggcctactcccagatggcagtgctcccgacgacgcaggggacgagaccgcccgagccgacgagatctatgcatgggaggacatcgccgcctctagctccaatagcggtaggaggtacgattgccaacatagggttatgtgcgtggcgtcccctacgaggcggagtaggtgcggcacgcgaggacaagatcgccatggaggaactaactcaacggcagaagcctttactccacccccatcctctccctaacttgatggcgaggcgctatcctcccacccttcctccattggcgaggccttctactcccttgcaacggtgccccaccctcttcgcttgccatttcgttctcgttggcgtcacgtggggatttgggagcatctcggcgtcggtgactaactccaacgatgccaccacctctcccctcaagctcggcggtgccgctgatgcatccgacctaggctacctcccctacctcggctgcagctgtggcctagagcagataagggaaaatcggttggctgggccactggaggcatcgttcgatccccatccctcctttgccgtcgctgttaacaccctcctccacgtatcgccggtcaccgtcgcccgtgacctgtggccttgctcgccacatgtagtgcctgctcccacaccgatgctgccaagaaaaggagagagggagccaccaatttttttttaatttatactgaattgtcctaacatgtggatcccattctgactcagccgccacatcagccgaaaccaggcactatactaccttgggacctcaagtacattgcttttgtaaattgagggacacgttatacctagtattacggtttagggacggatttaatttgaactcaacgataaatcaagaaacctaaagtgaacttattcctagctagtggcaccgcaccggagtggacgagagtgtgagtacgagctccgacggtgagcaggaccagctcggtgtagaaagttccgacctgcttggccacctcccttccaaagaccaggcatgagccatccttaccttttctcttcccattccttctctcacgctggaaggcaggaagtcgcactgagatggtgcacgatagactgtgatcagggttgtagcctgatagaccgtgatcaaggttgtagcctgtagagcttgcaagtgtaagtctagtcttatgattcattaagctagcagcggcgacgcccgcgggcgtgacccccttggggtgtcatctacctcccttctcttcttttggtgagaaacaatgggtgaaaacatgtcagtctttggatgcacaacaactgtgtccttgatgccataacctttatggagacacgtcgtgtttggagactctacactatagtgttgttgtatgtctgtgaccatcgaccaatcttagcaacgatcgattgggtgctaggtttccctccgagaggcttgtttctgtctggttgacacgtggttttgggagtacactacagtgcataaccactattttttctaacacatggtctttactttttcgggcgaataaaaaattttctgcttgttaaaaaaaaattgtttcgcccaatagttgagaagtaaaatcgactacttgcttttcttttttaatgtactgaagatttttcaatctgagccgaatctatgttaacggcctaatcaggttacggagtaaccgggatatgacaagggctaattttacgtcgataaccgaattaggccccatgttgttagatgggctgctaattacgtcggcccaactaatcttacgctggcggcgctgcagaagacagcggcggacactgacaggcagccgcggagaagttcgccggggcggcgaccctcggctgccgctccggtggctgccggattcgcggggaggccgaattgtccacgctgcgccgccgaaaacctccggtcagttctcgatccagtaccccctctcccgagaggccgagaccctccgccggccgctgctggaggcagcgatggcttccagaaccgccaccctgtacggcggcgggagcgtgccctgcatgcagcgcggagcccaccggatcgagcccccctgcgcggtggcgttcctcgagatcgctgctggcagaggagggcggaggcgatgatgacgacgacgtcccggcagggggtaagggaggaggggtagttgcctgtcaaatttggtgagcttttgatgaactaactgctgcaatttcttcagcttattatggtacattttttgtgtgtggccgcatttgtaggtgtacagttcatatatatatagtagagtatacatcccgatctgtgaatttcgggttgttcttcgttagttcttcgttagagggtagactccctaccatggtgggttttgatgatacagaaaatgatggctaatcaatgcagtagttgcttggtacatctccatcaattcagcagattgcagattatggtagctccaatcagatcgctaatttatgtggaattgtggatgactgattgatttgaatgatactatgttgctggtttgtgtatgaatgtgtcatgaaccaactttgtcttgagttgctcacgctatgtgtaaaatctgtatatacctttttggtttcaattggaagaagtatagctggtgggttgatccagagcgtcctgtttaagtgaactgtaaataatttccagaagggacttaaacgtgattcttttctcagaatcaaattaaattaagacatacttatcccaacttttttttttcatttcaggtactgtcgtaatgtcgtgtacacactattgcaagagagtatctgatgtagctgtacagaaagggtgagtctccatccgtaatatcgctatgcatccaatttttctttataagatagctccaaaattacaaataaatgaatcattatagaaaactgaagtgtttctacaagtatgtacttgtaaggaccatctggtcatatggaataactgtctctgtttgtatatctgcactctgcaattctttttcttgtttttgatgcatacatgtgtggcgctgtgtccagaagctctgctaattctgggtgcctagatgctgcaaatgatgatgaaaataacatagaaataaataaaatcaatgtatttctaatggattcaaatggttcagtccagtggttctaaagaaaccttccatatttttatgcaacttttccattatagtgcacaagactattctaggactgatataatgctatttgtcatgttctctttccatcttcccttgaaactcatgagcaactgtcaagctagacattcctgccttggattattttcattccattttaagctgaaagtgtaatgaaatgttacatttgacatgcttatttgtcatgggctttgggcc

SEQ ID NO: 8048 - DNA, 4715 bp, Oryza sativa
  unsure (1)..(4715): unsure at all n locations
agcccatgacattattggaccttttcctgaaactatatacttctctgtttcttttttaactatagttgcttctcttaagcaaaagaaggaatatcataagatttaaactctgttgcaactcacgggcaccttactagtttctaggatatgttttgtgagttcctcttgtgttactatatggacagatgctactcactttgcaacaccctgactcccgggtgtgcctgtgccctggcccctggcatgtgtgcaaaattgcaggttacctgctgcctgtgctgcaaaatgactcgtaacgcaaaatataatgatcctagcaatatggaattcagtatagacacacatgaacaagtttggcaagtacacttgtttggatcagtcaaaatagcatccttgtttggatcaatcaaaatagcatccttgactcacaaaattcagcttgtagcaatttagttagtctactagttcttgccagaaattttctgacccccaaggaattgaattatttcccgagctaattcactagtaacagtcatattgacactttcccattttgttagctacccttccaggctaaagaacttgtaaaattggttgctgtggcttgtgcaactgaatatttatcactaaacatgtaaggaccatctggccatatggaagactgtctctgtttgtatgtctgcactctgcactctgctatctacttttttttattttttattttagagaagggtattttttacccggcctctacatccaaccagatatatacggccaactctgctatctacttagggacatctcaagcttgtagctgtagtcgtttaggataattggatgtgatatttatgatgaggttttcatcactagcatcttgatagagagcgcacaatgctcccagaacataatatgcatcttgtcctatttggacatgttttcgtgctgatatgaagtaacttattttgtcagctaactaaatgtttttcatcatgctctgttaataatgtactgtcatatgtattgcaattatggagccctgtatttgtataacaaaaactagaaagtagtcattgtccaaatcattttcagtacaatactctttgctctgctttctgcaattccagttgtatagttaaatcacaaaattaataagacacacaaacttttattcattacctcaaatacatacaacaacatgggatcgggacgggcaagggctaacatattacagcttattataaaagcatatagtttcatgaccggctgtacattattgtcacatcatatgattataaccagctagtatagcagcttatttatcatctggcgtatcgtacccaataggcttatttactatttcccttgttcctcacaaagtggctgcagactgcatcagcgagatctttaaaccggcaggtcggtattctcatcaaagggaaatggcgccaattttgggtgtgctgcttgtaagatctttccaattggcattnnnnnnnnnnnnnnnnnnnnnnnctccaatgggtcaacatttgaattataatcctgaagcaacattcataattttatttaaaaaaacatctcagttgcaaacaatacatgaattctattttgcatgtttttggttttgtagggtggcactcaccaggttagcatgcatcctcttgacgaaagttttgaatgtgctgtagttctgtccctccagcagctcgtctgataatcggaggtaggtgaatccaaatagcttgtgctcaggaggtccattcttgttgatgcctgtcggccttgaattccttagtattgtgttgtaagctgttgcatcgtatcgaccgagtgcgttttcgcatgccacatgtaagccctctctccatccagcactcaggacctgccatttcatagttcatagccagaatattttgataagtgctcttgtgctattctagaagaagagcaatgcagaagttctaacttatagaccagtaagtactagtatgtaatagtccgttatttacctgttggactagttcttctggtgcactctttgcctctgagctttgttcagaatccctcatctcagcacatgtgaagttaacgcaggcacggtgccttgtgagcatgcgtgcgatggttctgtagccatctctgttgtccaagttgtagtatccagcagtgagctcagctgcatggtttggaaccctataccaccaatgaatgccggagatctgccagcaaccattggagcatgtgtcatttatgttctagattcaacaattaatggaacattatatatatatatctgttgcctattcatctagcctgtagtctaatttgaaatcattgaagtcttcaaaattatgtactataattcgccgagatctttagcatgatacttactttgattgccagctgcactctgcatcccaagaagaccttggttgcttcatccaagatcttgtctccatgttttatcagcttgtttgagtaccatgtgaggaagaacttccccttctcagtgacatatgttccattatccgcgaagaaccgggtcttctcgggagtgtcattgtactctccagcatcgtcgggcaattcccattcaggatgcccagcctttgctgcttctgctttgaaatctgcctccaggtatttatcatagcactgcagtattttttttattgtaataactgttagagcagtgaattactaccatttgtcatgcattttgtcccatttcatatctgttcagcatatttagaatttgatttcctcttcttttgttgcttaatttcagtctcaggcttgcttctactgttttttttttttctgttagtactgtttttggtccaaacatctttgtgaaccagaaccactttaatatttgtgctcattttccaaagattttttttcctaaaggagatctgcaattggaccatgattgttgtctttggtcatcagccatcacatggaggagaatatttttatcaacaacttatttataaaatgagggcagccataagaatctttactctggtaaagactaaagaacactcactatgaattctcctatgcctgggaacacccatccctggctctgggggtaggaagggtatctcatctcaccagctggaccaagccccacctcaatgtccacaatgacaccagtatccaagaactctgccatgttctccctgaagctcttcatgtagtcagcatacatctgtcacagcccagacaagagaagaatgtaatacatataacgaaatcaaaacctcatttttatctctttttttttctaaaattcatcggactccatatgtgcaggtggtggtggggcttgcttatcagctaaaacctggatggcagttcttccatggaagagagggctggtcatccactccaagggtgaggtactcgatgttcctcgccccaccacggttggtgtagaagatgtcggggtcgctcgcgccgacatcccgcacccactgcgggatcgggatgttgacgatgtcgccgacgttaccaccgcactggtggaacgacatgatggcctgcagcttcagcccggcctcctgcaccagcctgaacagctgcttgtaggcctcccagtcgtaggacccggggcccttcccctccaccagcccccaccacacgtccaccatgacgcatcgacgccggcctccgtcagcttcttcagctgtgcccgggtctcatcgaccttctcgaacttgttgtccacagtcaccacatccagctacatatctcgcaacagaattcaggtcagtgtaccacaaattcgctcttcttgagcttgttacagaaagtttgtgcctatgttaatgttaatgttgccagtgctgtgactaaaatttgattatccaaatagaactagagcttacggggagcatgacattgacttgaacatagttggctagcaagttcccggccattgtcgctggctgtgtatgctctgagaacactagcttcactgtcttgttgctcactgagctcggcttgatgaaatatagcaggacgctcatgggctatttatacttgcaaaaaggagaggggggctcttctccaccggcgggaaccaaccaatccttttcttccaggtacctacttcctctgagaaaattagagatggtgtactatgcccactatgaactgaatttggttaccgcccctgtcatcccaggcttcgatagttgatatcattcagcatttcagttgttgtgcacacattttgttcatcctcgagtaccatcgattcatgcttgcttgctgcagttcagcaggctcatggtatggtaccgctgtttttacctggttaaaagttttactatagctatgtacgtcagcttgcagtcatgcacggttctcatagggtggttaatttctactccctccatcccaaaatataaacacttttagaatagtacagagtcaaaatatttttaactttgactattaatagctaaaaaataaaaatatcaatgatgtaagaataatatgactagatttatcattaaacaaactatcataatatgtaactctttttatttaaaccatcttatttttgtaaatatttttagtcaaagtaatatctcaatgaccgtgtcaaagttcaaaaatacttatattttaggacagagtgagtagtatttactatcagctccatgaatttactattgctcagtactccctccgtttcacaatgt

SEQ ID NO: 8049 - DNA, 3167 bp, Oryza sativa
acatttatattgatgttaatgaatctagacatatatatctatctagattcattaacatcaatatgtatgcgggaaatgctagaatgacttacattgtgaaacggaggaagcacttttttttttgaaactgaactcagtacttgatgctgaaagggttggtctcgttgcaacgtgtgctttaatttgtttgcagtggcattcctggcttggtagttggtagcgaccgtttttttgacaaattgacccttttggaaaacttacttcgaaactaacccctgccaaaaacttcaaccaaaaataggccgtcgcctcagcgccaaacacattggcgctgacgttggtcgtgtcagcgccaacgggactggcgctgacattgtgccaccgtggcggccgggccgatcccctagctgacgtggcagctacatcagcgccaaccgcttcggcgcggaggtgcccaacctcagcgccaaccggactggcgctgaggtgggacttggccgcaacccccaggcccagaccagcaagcctcctggatggcttgcgggctgggatctcagcgccagccataatggcgctgactgtgggaaactcagcgccagtccacctggcgctgaggtgggacttggccgtttcggccgtggcccagcccagcaagccttctggatggcttgcgggctaggacctcagcgccagccataatggcgctgactgtgggaaactcagcgccagtccatctggcgctgaggtgggacttggccgtttcggccgtggcccagcccagcaagccttctggatggcttgcgggctaggacctcagcgccagccataatggcgctgactgtgggaaactcagcgccagccaacctggcgctgaggtggaacttggccgtttcggccttggcccagcccagcaagccttttggatggcttgcgggctaggacctcagcgccagccataatggcgctgactgtgggaaactcagcgccagtccatctggcgctgaggtgggacttggccgtttcggccgtggcccagcccagcaagccttttggatggctgggctgggacctcagcgccaggtgcactggcgctgagtttggacatgtcagcgccatttagcatggcgctgacgtcccagccctgctaaaacttcagcaaaactttgcacacaacacaggcaaacatcaaatgacagaaatttacaggcagtaatatatccagagacccttacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatcccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataagccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaattgaaataatatacaacattaatgctagaaacgaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacagtaggtccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcaccttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttaaaccagggttcatcctaaccattacaggccaggtggta

SEQ ID NO: 8050 - DNA, 17127 bp, Oryza sativa
accttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaatggccgagcaagcaaaggcgcacgatctctctccgagtgtgagcggcgacgacggggaaccaaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggcgcgcttcaggttgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccgtgtcgtcaaggcggagggcgcggcgagcggcggcggctgcacgtcattcggctgctactccctcgtcgacaccttcgactcggaaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcccccggctggtggtgttggctgtagagcctttgtggcgagtcttcggaatgtccgttggcccccaaggttccggcccaccatcactgagaagtacgatgggagcgtcaaccccaccgagtttctccaggtctatatgaccgggatcgaggccgctgggggtgacgacagggtcatggcgaatttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagcttgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttctggcaaacggcgaagtgaggccaagcagaaggcccccgctgttgacatcgatgatggtgaagatgacctaggtttccaagaacctggggccaccattgccaccgtcgatggaggagcgcgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccagccgtctcaaccaatcatcggtgtgacgccggggcacacatggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccgacagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcggcttaaaaaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggcctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacctttgtttaagctcctcaagcgctcggggccgttcacttggacggaggaagctgacaatgccctcgcccagttgaaggcgtatctcagctctcctccggttctagtcgccccggagccaaatgaacccctgctactttacttagcggcgaccccccaagtagttagtgcagcgttggttgtggagcgcgatgaggacaatcctcattctgcgcacccccactctgtgccgacttggcccgggagcaggcagggaggagaagcccccgagtcggacggtggcctacggcccctgacgaccggagtcggccctctgcccgcttgtcagacggtgctgggtgcccccgacccacaggaaggccccgaggccactgcgggaaggccgcacctatcgccctttggccccgaggctaaccctgtgctgactcgacccgggagaaagcagggagaagaggcccccgagccgaacggaggccagaggcccctgacgaccggagctggccctttgcccgcttgtccgatgacaccaggagcccccgacccccaggacggctccggggccactgtgggaaggccgctcctgtcgtcctccgaccccgaggtcatcggcacagaagacgagtgcgccccaaggggccacttggacgaagaacgccccggggatacggcccctagcaaagaagatcggccccaccgaagggtgcagcggcctatctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggctagcacgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggttggggatccgccgcctcctggtgttaggcgactctcagttggttgttaaccaagtctgtaaggagtaccggtgctctgatccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgttggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttactggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagattgataagcactctgctcttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtggtcggtgtcccccggccgggctcggtacggctggccacgggcgacggcacggagctgccaaacccgtggaacattgaacaccttcgtcgcttctacccttgaagggggggggggtcgggtgtcaggttttggctcgggctaaccccgcacccccctcgggtgtgccgggttagccgggggctaccacacatgcacagctttacttttcgtatttcagcatttcaataaaagaagtttcaatttcctaaaggttgtgtctgtgccgtttttccttctgaagaatcttaacttgaaataaggtcactcgtgctcaaccttaccctcgggggctcggttcggtcagctaaaatcgccaaacggggcccagaaccgagccgtgccccgggacgtggtgaactccgggggggaaccggcaaaaacccacaatcgggtcacccatacccctcggtcaccacgttcccggcctggccagtctcgacatgcggacttgggcacgagcccttatttcaagctaaggcgcaaaaggaccatggcacagatcatcctcatctcatatatagcaaaataaaactaacacaaaaattttttttcatcatttctcattgcagattgagttaatttatacaaaaaagaggcatgaaggccttagaagaaagaacaagaaaaaagttaagattggcgggggcctgggggctcattccaatgcgcccgggtcgccggcctcgtcgccgccgtcatcctcatcgctggcgtcgccctcctcgtcggagctgggggcgaacgcgagcagaggggccgacccctcgaagccgtcgacgatatggtcggcagcatcccggacgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttgtcgagctccacggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgctcgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcccggagggagaggctgtccgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgcctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcgagaaccccttgggcggcgtcgagcttgttcttcaactccgcctcccagctcccgtgttgaaggcggagggagtcctgcgcctcgatcatcgcggtggtggcgacgagggcggcctctcgctcctcctccacctttcgggcgatctccgccagcgccgtcttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacttgggcgctaaatccatctagcaccgcggtgtttgcggcggccaaggcctgcataatgggctcggcgctcaccggggcgacggaagaggaggagaagagccgccttggagaaaatgcgacgcggcttggccccccgaaggatgcgctgggctcggggatgtcccccgggcccgtttggtcctgggcgtcgcccggtgaggtaggcccaggcgatgtgcccgcggcctcgtcgcgagcctccccggaggctgtcgcctgagggttgcccgagggagtgggcccagttgacgcgccagcagcagctgttgcctcagcctggcgagcccgggcggcctcctccttagcggcttcctcagcccgggcggcctcctcccgagcagcttcctccgcttggcgaacccgggcggcctcccgggcggcctcttcagcttcccgaaggcgatctgcggcttcacgccggtcagcttctcgcctccgctcttctgcggccgccggatcttcggcctcggactggccggacttggggtggcgggaggagtgcgacgggacatcgctgaagcagaagaaaaaaccagaagacaaacaagatgggtaagagaaaacttgtttaatgggatagaagaaagacggtcgcaatgagaatggggcgaacctgcgaaggggtcggttgaatgaccactttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccaacataatggttagaatggagacgcggtcgggatcgatgcagagggggaggatctcctgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccgacggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcattactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgttatctcgctccctcgtttcccgtgcccccgcttccactaatcccattcgcccgcttacggcgcatgaagtggatatgcgttggtggcaatcgaaacggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatgaacaaccaaagttaccaatatcaatgtgcatgaattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcacacctgtaaccggaaattaaatggaatcattagtaattgcaaaaaaattaacaaatgaatacgaagactcgttagtaattccctgacgctgtgtcacctgtgactgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacatgttagtcttgttctatttatctgagctaaattacgatatttgtatgattttcattcgatgaaacagtatgttagtttaaacgatagttactttttacgagcagtgaaataaaaatgaaagagcgaactgagtaatcaagaataatataaaatcataaagattgaaaacaatccttggagcaatgggcagagttggcgatacttttttttatagtttgcaatcaatattatgacaatttcattttgtcctcgacaagcatttgattcagaaattgatcatgtacaaattccctgctaggtacagttccatggtaatagaagctctttgtgaaattggggatccaaatggttcggatgttgatgcaatttgccactacatagaggttgtgcatctgcacaaattttcttatttggtatcactatttgccagtagttatttttatttcttctgaattcattcaagttttgttcgttcttgatttcgtaataaattatgattcagatatgtgtacaactaacatgatcagaatattaacaaaatgcgattgcttgattctttttctcttctgaatcattgcctgattgactgtatggtataaagtccctcagttattggtatatatgtgtgccattgtgtttatttcagcttcctatactttaggaagcttctaaaagtgcctttgctactaccggagctttcactttggattttataataatttcctgcacaactaccatttcccatttcccgctatcttcctcgcataatcaatagctgggtacacatttagggcctctgcatgacgagttgatgactatgcataacattggttggaggatagggaagcctcactgagctgcctcactgagctatcttctcagcatttgttttgatttgagggaaatttgcgatttaaagattttgcaattataactctgcatcaagcccataattcagattcttcattttacttctcttttgtaaaattggcattcaataactcaatttacaattattcattgtggaactgtgcaagtggtagctatctaactacttatgttgacatttatctaactacattatacttttgacatgattcgatcataaaaataatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctggtaagatcctcgaattgagttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattgacttcctcccttaacggcacattgtcctctgcatgtacttcttcccttaacggcacattctcctctacatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattagggtctataagttctttcttccctatcctaccatcttttttccatgcaaacacctcaagagatttgaaatgtgaccccaatactatatctatatatgtttgccattcgatctctccattcaagtctaacataaatttatgtgacatgacaccgccgcgcacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttgggtaacttaaggtttatagaggggtttaccttctcttccgatcccaaactcaatgccgcacaaatcaccttcgattagagaggtttttgggggagattgggcgaggagaactcggtggcgaccgaaccctaggcgggcggctggggaaaaaacggaggaagaactggctggggcggcctcggccgggctctaagtagccaaggtcagcgccaacttacttggcgctgaggttgggcacctccgcgccgaagcggttggcgctgagttagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaaataagtttttgaaaagggtcaatttgtcaaaaaaacggtggtagcgagccctgtgcacttccgataagaccgtgtttccatggtaaaatgcgcatccgatgaaacagaaatgacagaaattaaatcctcattatgcaaatgtatcaagatgtttccatggtacggggcactctgaaattactatcttccatcttcagttataatcctgttaatttgtgtttgttgtaataatattgcaggatgcattcggtatattgttaccaaatgccaataccatggcaaaggtttgcagatgtgtgcttttctagctttcggctaaccatagaactgattgttttgtacgtacatacgtgccgtgtgttagggcacaacagaaatttgtttggctttggacgcgcattgccgccaaaccctgtgcaagttcaaaccgcggagttttttccgatcgggatgtaccaccaaccaaatttcgttctccgcgattcaggattattacgttatgcgttgcaaatcttgaggtttgtttagagcttggaagtatcgcattatatatgaaatgtataaaatcttgaaatgtatcgcattatatatgaaatcttgatatatacatttcctgtaggaattatatatgaaatgtccgtgttccaaatgtgaccgtgtattaaaacccatatgcaggcagattattctgtagcctgacaaccaagacagacaacactaaaatggtaaaacggtaagtggatggctccaagtaaagaggggaaagattagtaattatttttgacattatatcataacccttttacgactactatctacaagacagagagtacatgctgtacatcatatatgtaatgatatgcctataaacgtgttgcccttgtaacacatgacatgctatactaaacaaatgaaagcaaaccgcataagagcaagtttaatagtaccgccatcaactagttataaacatgtagtacatgtcatccgaggggtcagtatcgtttgtgatgaaaggcgaacccaggttcgccgttgttgcatccagaccatccgtacttcaatcaacggcggcatggtttagcacctcaaagacgattaacagctaattaaataatataacaatttttgtatattagtccaattaattaacaagatcggttctgtctattaattttcttataataaaatactcttgtacaacaaatacagtttagttttttcaaaataaatgtttaatttttggaaggattttagcagtagagttgctagatgcttaaggacgtgggataattattttactattgtataaataaaggattttcttatcctgagattgtttgcttcttgattttatcttattttttaagttggttccaaaaggcgagggaggtattagttgtatttgatttaccgttggagatcgtttccttgattttttttaagagagaacaaactcttaagctgctaattagtcactaagagggtgctaactgctaaactatggaaccgttgattgacatatggatggc

SEQ ID NO: 8051 - DNA, 1478 bp, Oryza sativa
ctgaatggaaccaatggtaaactttgcctttggtcccagaagcagaggatacgaccccgtcatccgagagatgagagatagaaataaagatccaatagctgactattaatctacctacacacttctttaggtagttaatttttttagaacattgctacatgtactaaatttgcactaacaatcatctcagtcgtttaatttacatagatgaaaattataaaaaatctagatgcactgatagtatgacgtgtaagtgttagtaagaattttatgaagaaaagttagtacgtatagacttttcctttatttatttattttttattctaacttgctattctctgtcctatcctgtgtgttctattgatggggccatatagcaatattattagagaaaaaaaggacacggattagcatcgattcctgtaatttgcatatagcttcttgtgctgcagctcagcgctcgctggagcgcccgttgccctctccctccagctttctctctcctccacctatgaatctggatgacgtggcactactaccgccaactgagtgtggcttactctctccatctacttttaatagtcatatttcatcttggcacaatgaccaaggataagtaattaattctacttatcatccatttaaatatgatactaattattcctcgtaaacaagcgattcattaatatttacatttctctatgcccatgtagccaatcttgtgtagaagaatggagagcaacgcagtaaatccgataaagttattaagaggataggtggttgaattgaaatatgtctatcaaaagtaaaatttccagatttagaaatatatctattaaaagtggatggagggagtattaaacttgctctaaatccatgaccttgattactgaactctcactacttaaaaaaaaagatttttctatacgagaacccctttaggttgcagacggactgtaagtgacggcgtcggtaaaaaatgacctttattttcgcatgtagctccttaagacacccgtatagaaaaatcgattttccatgcgggcctcttaagagatccacatgcaaaaattgtatatatcaaggttttaaccaacaagtaaagtctatatattccttatatatttgaaaggaattgaaatgatgaaaagtgaaatcagagaagtattgttctatacacactcattattattatcgctataaattcaaatggattaaatctatatacggattaaattagcacgatgagaaggtactgtcgcgtgtgaatatatacctttatgtaccaaatagggaaccaaacatgcctcaaagttctttttacttgtcgacaccaaattacggttcgatcgaaaaaatcagctgttacccaccgtgcattaattagatattgtacatagcttctttttttttgaaaaataatgggtgaaaatatggcctctatatttatactaccttcatcccaaaataaatcgtgt

SEQ ID NO: 8052 - DNA, 16299 bp, Oryza sativa
taatccaattagtattatttactttatctactcccaatataattagtttctgcttcacaaacatcgatgcaatagttacttaaaaataaacttattttgaaacaaatgaaaggatcataaaataaacttattatgagacgaagggagtacttcttacgcactgtagcttgtttagatccaccactaaaaataaaatatttagaagcccatagatcacaaataataggtcagctctccacagcaaacagaaaatctcctgcagaatcgacccaaaaaatcaggccctcttaaattgattatgacccgtgagggtatcatatcatctatttattactcccatagttcctagtaattgtcagcgtcggtaggcattgttacaatttggaaataagagatgattctccctcatgctccctccccattaattttgtattataagttgctttgattaaattcatagaaaacatatgtttttaacacaaaacaaatatattattagattatatttaatgttagatttaatgaaactaatttggtgttttaaatgttgctaaatttgtctataaacttaatcaaactttcaaagtgtataatatgaaacggatggagtatctattatcagaaatggtttgaaatggttgttttaatagtaatttttttattaaatggaaaacacacatgtgctttccctcttaataacaaaaaatggtttactttaaattgcgatgaacaaagttatacggttgtttttacgtatttttttcacgagagcaatatatttgatattgtggcatgcaattaattaaatacttacaaatttattactaacaatagagtgatcaaagtttcaacagaaaattatatcataaaaagaaatgaagttataccatttggtcgtttttaaaaatattatttcaaccctgccagaaaaacccccaaaattagtgccaaaccctcttgaactgaggccgaggttagtactataataagaactattcttaaaataaatttttaaaaggttaaaatatcataatttcagtaattgggacgcggcaccaagtcaccgcaattgccatcaatcggcatccataacactgtagctgtcgaatctcacggcttacgaagacaggcatgtacggaaacattctccctccgtcccaaaataaatgcagttttgcattattcacgttcaacgtttcaccgttcgtcttatttgaaaatttgttataattagtattttcattgctattagatgataaaacatgaacagtactttatgtatgactaaatattttcaaatttttcacattttttttaaataagacgaatggtcaaacgttgggcacggatatccacgtatgcacttgttttgtaacggaggtactatagtttgttgctgcggtggcacgccagtaggagtacgccactcatcacatggctacctacgtacgaccacgtaggggtacttcgtacgctaccgacacagtgggttggtatagtccattcactgtagtattgaatgaatgacaacgatttggaaaaacattgttacttaataatggtagttctatgattctgatgtcctcgtgatccaaaatattttagaacggggtattctaagcttcccaaatccgtgaatatatgattacgttggttaatcatttgttctcattttaaataaaataaattttagaattttaaaaccactataatttaacttacaaactttataaatctatcatggatatgagatatgaagccgtgtcaaatataacctgagtattgaatgttgaatcttatccaaattacgttcagtaaaattccgccaatatcatggcgcacatgttctttccttttgaatacgccttaagcgatggaagataacaacaaacctatgacctaagaaaagttatagtaaaaagtaaaaacacatccacacacatgtaagaggatatatccgtaaaaacaagttaattgttgaaaactcgtaaaaatcatacctaaaagttttataaattcatgaaaaaaagatactaaagatagatgtcgatataaaatatattcttaccaagtctcaagttcaaaatcaactttatttaggaggtaaaaaaagacaaatttcaaatgaatagtaacacatgacactatctacccgaaattgtttttttccttaaacaaagttgagtttagatttgaaatttgatgataatgtatttcatatctacatatatctgtagtattttttatgaggttaataatttttttagtatgattttcacgagtttctaatatttagctcattttcgccggatatgtcctccacgtgtaattgcccgaacaagctttttcttgttctattaaaaacacacacgacacatggtacaccactttatacgcactcactagtgtgcccctggcgcatatatgtgcaatcgcacaatacttctttttactacacaaaatacgccaaacacaataattaatgtgcatacactcgtaaatgtatctataccataagcttaaaaaagacagagatcaatacgacaaagtttggactcgatatatcctattgaaaacacacctacgtatttggcttaatgctttctagtaacagtcttgttgttgtaacctacagtatgtatcaatataattaaacttctccctatcttaataaatatatgtaggccagcttttcttctgtcggcatggtaaaaaaacacgcctacttatcaataatattcgtgtatattagaatctgaaccatagagaatggtgtcatgtaagcatgtaattaaccacatcttcaccataacatacacccaatactttaactatagatgaatcatacaagtcaaggcatatatcccttccgtctaaaaataagtgcaaccatgagtttctatggacaattttaatcgttcgtcttatttaaaatatttttcaaaaactaaaaaacataagtcatgcatacgtactattcatgttttataatctaataatagtataaatactaattttaaaaaaatttaaataagacggacgatcaaaactggacacagaaatttatggctaatcttattttgggatggagagagtatattagatagtaatagctcgtagggttctgattttctcagatttttgaattaattattttcttctcggaatggctgccacgttatcctttgtgcgacttctcgattgggtggatagcattggtagcacgcggtaccacggtgattatgttgttccccaggcgtggttatgctccctcgtgtcccggttgcattaaccggtggtgtccggtaagggctcgcaagcatgctacacgcatcttcatgtatttttgccaaaagaaagaatccttggtaccttgaaaaatactccctccatctattttttatggtcatatttataaatctgaaaaatttatttttgataggcatatttcaatccaacaacttatcatcttaatggctttcttggatttaatacgtgactctccatttttccacacaagattggctacatgggcatagataaatgtaaatattaatgaatcgtttgtttacgaggaatgactagtaatatatttaaatagatgataagtagaatcacttatccttagtctgtatgtcaagatgaaatatgactatcaaaagtagatgaagggactagtaaagtaaccctttcaccacttttactccgttataaattttgtgaaaaactctatatacatttgagaaatataacacgaaaaagagaagattatatttttagagatggcgctataatactaagaagcacaatgtttttttttatgcaaaacttcctctcaaacttatcttgcctggtgtatctgtatactccttcaaaggtaagtgggtctcacttgatattgagtgaaccgtggcctcaaacgcacttcccatgtcaccagtggcggacgtagcgttaaaatataaatggggcggaaaacgaagatgttcactcgataagagtaatcgaacacgacacatatcgtattaacagttcgttcgtataagtagataagggggtctcgagagtatggggcgacacgagccgtagctgagtcggtcgacccaccccgcctaatgggtaaatccacccctgcatgtcacagatgccgttgtgagtttgcaactatatatttcctctgtcttaaattaaactaaaatctactacggtatgtaatatattctagtacaataaatctgaagagtaaaccgatttgtttaaattcattgtactgggataaagggcctgttcactttactgccattttcaaccttaccaaattttagtaaagttgccaaaaaagtggctacatttagtttgctaccaaattttggtaactatataagaaatcatgtcttgccaaaattttggcaactataccaaaatttggcaatgccaaaatttgataaggtttttttttggcatcaaagtgaacaggcccaaaatctattcagatttatttactatgatgcatcacttgtacaaaattcgtttattttggtacttatagagtacgtggcaatactccaattttttcctgacgcacacgtattccagcaaggctaacagaatatccactcgaccttgtcgaacacccagtcgatcaactcggcgaggccgccgccgacgctcatgtccgtctcgccgtcgaacggatacggcggctccggcgccgtcgcgtccagcagccgctcgatggccacctccggcccagacctctccagaggcctcatgggcctcccgtaccgggccggatccggacagcaatcctgcacaagaaagcccatttctcaggcctccttttatgggcctagatttagcccatactaactggcaaaatgggcccaaacctgatcggcgtgcattttcctgacgaaggccttgaaggcccggaagttggtcgccgtcaggagctcgtccgacagccggaggtacgtcacggcggcgacgcggcgcggcggcgcgccgccgccgccggcggggccgacgccgttgggccgcgcgttcagcagcatctggttgtacccgcgccggtcgtgcctgctcagcgcgttctcgcacgccgcctcgacgccctccctccacgccgcgctcagcgcctgccgcaccagccgctccggtgagctcatcgcctccggcggctgctccgagtcccgcatctcggcgcaggtgaagttgagcacggcgccgtcgtgccgcgccagcatgcgcgcgacggggcggtacccgtcgcggccgggcacgttgtagtaccccgcggcgagctccgcggcgtggctcgggtgccggtaccaccagtggatcccggacaccttcgcggcgagcttgaggctgcagcccaggaacgccatgttcgcctcgtcgaggaccctgtcgccgtgctcgagcagcttgctggagtaccacgtcaggaagaacctcccggcctcggtcaggtacgtgccgccgtccgccgcgaagaaccgcgtgtcctccggcgtgtagttgtactctccggcggcgtcgcccggcagctcccactccgggtgcccggcctctgtcgccgccgctctgaagtcctcctccaggtatttgtcataacactgtaacatttacaaactgaagtgactgacaccgaattgtaaactaatttaaacgtttttaacatcaagaatttaaaatgttaattgcagaaggaaattgatcctacctggaactgtccgatgccggggaattcccaaccttggctctctgggtaggatgggtatctaagctcacctgcagggccgaggccaacctctatgtccacgatcaggccagagtccaagaagtcacccatgttctctctgaagctcttcatgaaatcggcatacaactagtgtcacagataaacaatcgatcaagtcgattagattatcctaaatttgatcatatggttgtgatatgtaattttgcaatctcaatgtaacaatttatgaaatcagtgtacctggatggcagtcctgccgtggaacagaggccggacgtccacgccgatggtgaggtactcatggttcctcgcgccgccggggctcgtgtagtacacgtcggggtcgtcgtcgccgacgtcgcggacccagcgcggcagcgggatggtgacggcgtcgccgacgttgccgccgcaggcgtggaacgacatgatggcctgcaccttgagtccttcctcctgcgccacgcggaacagctccctgtacgcgcgccactcgtaccgcgccggcccggcgccctcgacgatgccccaccacacgttcgccatgacgccgtccacgccggcctcccgccgcagccgccgcagccgcgcccgaagccccgccgcgtcctccagctcgttctccgcggtgaccacgcccagctgcgcgccacgccacggcgcggcgccgctcgacacgatcagttcgaacgaaagcttgaggagattgcgtgagctcggagcttaccgggagcatgacgtagacggggacgtagttggcgagcatcttctcctcctcctcctcctcctgggtgagcaatggcggaggctgcggtgaacgagcaatgcagcaggaggcaggaactcagtttgaatcaagaaagttcgcgcgctcggcgtgtgcctaggtacctcgggtagaggagaagcctgttcgctctcagcggcaatagcacggacccggagagaagccgccgtcttctgggagtcggcgacgagccgccgccgacgccgccgcccggttgccggcggtggaagaagaggagcaggagacgccgctctgctccggcatgtccatcgttgctgcagcctgaccggctgcgacgatggcgacgaggttgtaatcatgatgggcagcagcgaagctgtccgggctatgtttgtccaaatttgaaaatttttgctagatgttcttggctttgtccggtgaattctcggcatatatcgttggcgacttggcgtgccatgccatctgcgtgacacaaaaatctgtcccctttttggcgatgtgtgttgggaagaattgagcaggtgttcatgaaggtgtggtttgcgtgagctctcaagcgtgttttttttttttctcccgttaagtaagaggctcataccatttcagtttctgcttttctagtggtgaatattgagggttcagaagaagctactagctgttgttgtctgtgcttttggttttggctttgtgcagtgatagctacagtaagggtgtgcgttcaacatgcgagcaaatggcagaggatggctgcttccccatttttcaattccacctgaagaaaataaaatcgatgttttcccaaattagaggatgtctttattatttcccaaatattgaagatgattatcgtaaaagaaaaactattagtatgacaaaatataaattaagataaaaatacttaaaataaaacaatacttatatcttttttaaactaattggccgaacctctttgtttttcccgaaacacatatactcacccttataaatccacacatacgcacaccttatccctataaacaacttctttaataacactaaaaaacacaaaacactctcttctgttttcagaaaaaaaactttcttctgttcaagaataaatacttcaccttttatccgagcaaaaacactctcctgggctctacgtctctattactacctccatttcatgatgtaacaatttttagctacttgttatattttgtgacggaggtatggtaagctaagggcttgtttggcacagcgtggagctggagctcagccaaacaattttagttccatctaaaatgagagaagagttagatgtaacgctatcacaaaataaattagatatgtgaagctgggtttaaactttctttccaactccatttcagaaccaactcatgaaacaaaatttaagttgccgtagcactatcactccatcatccaaagcctatgtccattcagcccattacggtctggcccaaagtccgtatccgttcacctcgtgctcctattccgcttgtccttatctcggcgtccgagcccaccaccgcaccaccgccccgaatccgcccccaaatctcctcgcgacctcgaaaccctagcctcctccggccaccgtcgccggccacggtgagcggccccacccccccgcagccatggcctccccggagggctccacgtgggtcttcgactgccctctgatggacgacctcgccgccgccgccggcttcgacgccgcccccgccggaggcttctactggacgacgcccgctcctccgcaggcggcgctacagccgccgccgccgcagcagcagcccgtcgcccctgccaccgcggctccgaacgcctggtaattgcggggtttacggcctccgatcgcgctccagccagccctggctgggcccggtgccgtggtctggggtgctacatttttttttcgtcctgatttgtcgcggcagcgtgttagtgcgtaagttgagactgggtatatcgtgatcgttgctattgattgttcgattggaggtcgatagaagcgtatcatatcagactatcagtgggattcggattaggggattagccattgagtgtgtctgaacatgtagaactagttacgtactccctccgttttctaaaatatgacaccactgacttttcaaaatacacttgaacattcatcttattcaaaaaatttatgtaattattatttgttttattgtgacttgatttatcgtcaaatattctttaagcatgacttaaattttttatatttgcacaaaaattttgaagacgacgaatagtcaaacgtttatcaaaaagtcaacgacgtcatacattaacaaacggaggtagtataacttagtaggagccgtcagcctgttttactgaacagagggctcaattcctggttatattgaattgtcagcttcattttcaaatctatttatttgtgtgcatacgtaatgtatttaaacctaatttagggcctcttcatgatttataattctcattttaattgtgatgcaaatgctgcatagcatagcatatatagtttgctaagcatgcattgtgtcatgtttatctggtgtcatgtcatgggatagttgaactgaagaaaacatacaccataattgatgatgtttatgatgccactattgtacaagattcagtttgccgtgtaatattacaatataagaactgataacaagtaaaccaaatggtgtcaaattggcgtggtggtgggagggtggatggttgtgatttgctgtaggtccaactgtctgagataccagattttaaaattttttgtatctatatgcaagtaaattgcattgacatgatattttgagccaggtattgagatttgtcctgagctttccagtggatttttcaatgaatgatctatgaaggatcagaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttcaccagtgctgaaatcaatggctctgtggactgtgaacatggcaaagaacagccaacaaataaacggtttgttcacatccattatccaatctacatttcctttcctgttttcttttgatcatttctaacttggcaccacaaaacattagtccgagatcagaaagtggcactcgaccaagctccaaagcatgcagggaaaaagtaagaagggacaagttgaacgagaggtaattttcgcatcatttttaattcaacccatttttctggttgcagcattgttttttctaactctaaactaattcatggacttaatttctgttaggttcttggaactgggtgctgtcctggaaccagggaagacacccaaaatggacaaatcgtctatattgaacgatgctattcgtgtaatggctgagctgcgtagtgaggcacagaagttgaaggaatcaaatgagagtctccaagagaaaatcaaagagttgaaggtatgtctttttattttctcttcataattatttgccatgcatctatttttatgggcacccccgcagcagctgtgtacatattgttgtctaaaatgtaatgacaatattgatagttttgttggctcagcatggtgttaaccttaggttatatggtttgtatggactataaagtgtaaatccaaaggacaaactaagcatcatgtccttcaattttgcaggctgagaaaaacgagctgcgtgatgagaagcaaaagctgaaggcagagaaagagagcctggagcagcagataaagttcctgaatgctcgaccaagcttcgtaccacaccctccggttatcccagccagtgcattcactgctcctcaagggcaagctgccgggcagaagctgatgatgcctgtgattggctacccaggatttccgatgtggcagttcatgccgccttctgatgttgataccacagatgacaccaagtcatgccctcctgttgcataagtcaaagcaaagatcaatttgcctcgccttgtaggaaagaggtgaaactgccttccattcaagcccagtttggtcgtcagtgtttaaactacctagctaatcccaggattaaaccgaagcttcgctgtatcgaagtatcaaccggtgacatgtgaactgacgaaagatgacaccgttgtatattacatattagtaaataaattccatctgtccaattaaatgagaattagatgccatataattatatcccaccgtgttttgaccattgagaagcataattgggttattggtggccatgtccgaagaaaaggaaaacaatatataattgggttattggtggccatgtccgaagaaaaggaaaacaatatgtgcgctgtttggtgcaacgtgttcacctcacagcaagacgtgctctacatgctccctggcatctatggtattagccgtcagggaataaaatattccattattttagtaccattttgcgatttttctccttttctttcatcggcatgcaatcctgatcatgttcagggagtttgctacttgtaatttgcctaacatgatctcctcgggttcaaattaaattatctttgagatgcttgtgtttaattccaggtttgccttgtactcaacaaatcgaatagcacatgtaaacacaaacattatgttgatcaacgcagaaaattttactgtttagtaatatagcagcaaataccttcaaaatgaaacagcaagaatcttctctttaataaatggaactgcaaaatacagaagggcttatgtatacacaacaattaattaatacacagcaaccctcaaaacgagtaacaaaacgcctctggtgcaagagaagtttcaccacacctcgataaatatacgtagaaacccgtgtatttacgtacgccacatgtaaatagtaattaaaatcaataagaaatataaaacgatattaatttctttttatatcgtttaggcggccatggccaccagagcagccaaggccagcccggccacggccaccgccggctgcttccgatgccgcggcgtggacgccgcgctgctgctcgggccggccgccggcgacgacgccgagttcgacctgtgctgctgctcgtcggcgggaggcgaggggagcggcgccggggaagggccggcgtccgcggcggcggcggcggcggccgaggcggagtaagggacggtggtgaccttgacgtgcatggtgccgttgaggcagtggcgcgggatgctgcagatgaagtagcgcgtgccggcggcggcgagctcgaaggtggtgttgccgccggagtggacggagacggggttggtcgagacgcagccgtcgtagtccgtctcagccggcacctccaccacgttgtggtacggctcgtacttgaacgctgcacgccattgttgatctcaatgatgagctcgtttgatcaatcaaccagtaattaattatcgatggacaatggcatttgagatagattaagaataagaaagctattagcatatgattaattgtgttttaattatttacaataaataaataaattagttgatattccaaaacgacttaaatagaaattatttgcaagaaacatatcacgtactagtagtagtttgaaaaacgtgctaatagaaatcgagagaaaatgtacatcttaatcaaaaccgggtctacctgccttgcaatggaaattaattacctatgggggcccccaccaataaccttttttccggcgcccccttgtatagtcaacctaggttccacccgtagaacccgccaaccgtgtattccttggccaccgccgtcaaggccaccgccgcaaccgccttgacggcggcaaccaatgctacggacctagccttcatgtttcccttgtggtagatcgatcgatcgatcggctctctctgatgctgcggttgtcgtcgcctgatcgatcgatatgttgtcaccagcaagcaatggctgtttatataaggagcaagaacaaggcagaactagatactgctctcttctctttttttttttttctgttaagtaattggggccagtgtttatggcatgcatgtatagaggagttgttgtgtagatgatctggagttgcttcccgttcattctacaaaattggaatcaaaatgatttaattgtgcattgcacgttgtacctcttgagttgacttgtatattatatatagttccttctttttaatgaaattgcttctactctgcagcatgactaagtaataaatttacctacctgatgtcctcatttgcattcatggccattcaacatttccagatcaaattccacctattgtctttataaacaaaaatagaacatgtttaatcaattttgtttattttccaatattattttttctgagtatttttgttaatattatggtaattgatgccattatgtgtttctacccaacatatgtattctgattatgttaatgcgagtattctgtgctggtggtggtggtagggtcaagtaatctaaatagtacaagtagtactccctctaatagtactcccggtttttaacataggttactgttgatttttgtcgtacttctaccatttgtattattaaaaatgttaggtaattattattcattttattgtgatctattttataaaaaatactttaggcatgacttttttttcatatttgtataattgctgaaaataagacgaattatcaaatgtatattcggcaacaatacagtttaaaaaaacataggcatgaccaaaatttacagcttttgggttgccaaggactcaagtcaacacaatacaaaccaaaagcatgtctgtagtttgacttttcggaatcactattattatttcttctcgctgccgatttgatggaagcaatccatgcaagttttcattgattaggcaatggaataatcaactaatcaattttgcagaacgtgaagagatgttacttgccccttgcagttgcaggttttgcggacacactcgactcgattgtgcgttacatcatcgactatcagctttcatggtcgcaaagagaacttcattttacacacatacaactcgtggatgtggatcagttcttgaaagaaaatgcagcactatggtgttgcctgccctatctttgctcacacaaataaatcatacttcctccatttcatattataagactttttaatattaccgacatttatatagttgttaatgaatttagagatatatatacgtatatatctagattcgttaacatttatatgaatatgcgtaatgctagaaaaatcttataatatgatgaaacggagggagtagtaccgttgtatctttcgtaattgctccgggttgcaaacataatcgctagttttctttttgttttcttactgggatatctcacggaatttcgatccccttgcgtcgctggtgaggtcgatggatattggttgcgaatctgcgatggagcggtgacattttggaccggcatgcgccgtttgatagtatgatggcctgtaagactgtttgggctgtttgcggcgcctagatgggcttttttgttttgcatgcggccaatcagagctgcgttcgaaacagaggatgtggctgagtttttcctggcaggaaaaatgagatgagtagcacataattaagtaactactccatctatcctaaaataactttaactttcaaataatttcatctttcaaacaatgattgtattgaaatttgagaaattaggaacacatgcattaggcctagataaaatgagagacaattgcattaggatttgataaagttgagggcattctaatctttttttctttatattggtatgtgtgaatgggtgaaaaataaagttattttaggatggcgatagaattagctattatacacttgaaattggatttatttgatttttaaaaggaaactagcaaaatacccatcgttgccacataatttaaaagatcacatcagagtattacagagaggaaatctattttgagtttcagagcttagtttcaggggatgctataaaaggaatcccgttcggatgggatggcaccggttaggtatcagatgatgcttaccaagtatcatacgattcttactaggtatcaggtgatacttgcattgcgaggtatcaggtgatacctttaagtatcatcttatatctaggtgttggtacctgttgataccacatgatactcgttgataccagagtggtacctacaagatattaggagccgagcattgaggggaggagtgactaggagacgaagaggacgttggtgacggcgtaaagcttggccgtgccaagttcctagacgcgggcgccgctgccacccttggtgtgcacctcctagatgtggcgtcgctaccatctccgtgaagaaatctattgcccgaggagctccactaccatctcccgcaaaaagaaatccggcatctgaggagctcattcgcacctgactcttggaccatcgccgctcggctattggacatggcgccactaccatcgccgcgaagaaatcatttgctgctgccataggagaggaagcaaccctgcatacacaaagaaacctgtcgttggcgatgtggtaggaaggcggcactgtgtcgttggagggaaggagtggttgggaggtgagaaggacactagagatcttcgacttcttggaggagtgggaccacttcaactgggcgacctcattgtcttcgtgaggagcgggtccgccttcatcccctccatgctcaccatggaattagggcaacccgtgaggaggatggtgaacaggatcccgtcccccagcatttatgtagttttaaattaattagggattgtttgttcttatgttaccagtctcgtaaaaaaataatccagttattagcggcgtgcaaggatgatcatgattgagagctccagggtctagtcgtgacttctactcttctattgtatgtttgatttggagtgaaaatagacaatataagatgatagtagattcaccgctcactaccaccacaactaatccctttgagaataaaaggttatctttaataaatatatcgtttagtagttttgcgaagtgtgcttgcttaagatgatagagtagctcaccccaacttgtctttagaatgtgtgttactagagggagctttttccacgtttatcatgagcacacttctctaaacactaaacggtatgttttccgaaaacattctatatcgaaggtctttcaaacatcagataaattaaaatttcaagttctcaattgatcttatcctgatcacttgcaccgttttattaagtgtagtcgataaagctcacgtcgattcttgatttgaacataaccttagactagtgagagcacacattattattaaaattaaagatgatgttagccagctatacaggctgtagaattagatttgtgctgaccgctgtgttatagaggaggaaagaagaaccaact

SEQ ID NO: 8053 - DNA, 692 bp, Oryza sativa
cggaaacccagggtttgtcattttttgggacggagggagtagatggcaaaaagcccgaggcccgacggcccggcccacggtacggtattttggcccgatccaagcatggcacgggccgaccatcgggaccgtgccagcccggcccgaccgccgggccgtgcctgggcctcccccccggcacgttgggccagcccggcacgaccgggccagcacggcatgacgggccggcatgccaggcctggcaaataaagaatagggagtagaaatagacatattatataccactgtccaaataatagtgatgaaaaatagacttattttagctatatatatgctagcccaaatatgagggagggaaaatagacttattgtcattatatatatatccagcccaaagaagagggaagaaaatagacttattttaaaaaggtatgatgggccccgcgttccttcgggccggcacggcacggcccgactgctggtgggccgtgcctaggccggaggtgcagcccatgggctggcctggcccgacacaaagtgccgatcaggccgtgccggcccgatggctggtgggccttggctagccgtgcctgggccggaccttatggccatctatattatactttgctctgatttgggctgtgagcctcactcattcgacggccgacgtaatgggtgaactaataaggaaa

SEQ ID NO: 8054 - DNA, 244 bp, Oryza sativa
ctacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcg

SEQ ID NO: 8055 - DNA, 33016 bp, Oryza sativa
  unsure (1)..(33016): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggccatttgcccattttcgctcattttcgctcaatctgctactgacttggtcacaaattacactctgtaatggaaactttcttttaagttaacggtccagagcaatctgcattctacagcactagcgagctgtgtgtactgcagtaatttctcagataagcagatttttggaatcccaatatacagtgatgtgtcctacgcttctgtaggtgattctgtagcattgggctcgtgtggccaagctcttgaccacttatcacaaaatgacaatatatacagtttcaagttccaactcgaaacaaaaacaagcaacaagccaactacactagcgatggcaagctctgctttaggccctgctacctgggagacaattgtgtcacggtttgagaataaccagagcttccatcggagaaagatgctactggaatatgaactacaggggccggcagagtgctagtagcatcgctattaagtaaaaccatgacatcggccattgttggacgatctatagggttctgctggacacacaggagaccaatgttaacacattttagcacctcgccttcagggtagtttcttcccaaggagtgatctatgatctccttaatgtttccctctgcccagtgcctccatacctagtattagatacataaatatcttcagtaatcagtatgcatggttatatgttagaaagtactaaaagtgcaagtggcaatcaatggtgcattagtcttggtgaattagcaaaatatatactccctcttttattaataaataatattgttaacttttgacataatgtttgattattcgtcatatttaaaaattatataaatatcatttgttctgttgtgacatgttttatcattaaaaaagctttacgtaagacttatacttcagcacatttacactaagttacgtcatctatttagaaaatggaggtagtatatacttactatgcttattatatcttcgtttggctcaaagaaatagggcccgttgttccttctccggcccgtcacgatctctatgacgagaatgccgaagctgaacacatctgatttcgtggagtactgcccatgcgtcacgtactcaggagacatgtacccactgcatcaacatccaacaagaataatcacatggttagaatgagaattgcatagttaattattttattacatatatatttatgaactaattacaatgtcccaacgatgcggtttgtaatctctcgagtctggtcttgtccgaagagcctagcaagtccaaagtccccaatctttgggttcatgtctgcgtctagcaagatgttgctcgccttcatgtctcggtgtacgatctttttctgggagtcctgatggagatattgaaggccccgagcaatgccttcaatgatcctaaatcgtgtagtccaatctagctgtctccttttctcttcatctaattagcatgaatcatgttcattgcagaaacatgaaaagatggtaacatatctaaattcaggggtgatatcagtagtaccaaaaagaaaggtgtcgagacttttgttgggcatgtactcgtagacgagcatcctctctccctcttctaggcaaaaccccacaagctgcacaagattcttgtgatgaagtttggccaccaaaactagctcgtttttcacctcttccaacccttggtttgaacccttcgctagcctcttcactgctacgtcttgtctgaaaagaagcccctgaaaaatttggtttaataccttcttacatggagatatggatagaaaaaactgaattttgaatggcttaaaagcttggtgctgtaactaatttacaatattaggcgatcttgaatgatatttgccaaatagtattaattaattaaattatcaaagtaacaattaaggatcagtacactcatagtaaaaagttatcatttcatatttttaccatgcttaattcgccccgtgaaataaaaaattatttcctcaaaagaacacataaaaggttacttccataccttataaacagcaccgaatcccccttcgccgagtttcatgctttcattgaaattatccgtcgctacttgcagtgatgccagagatagcagggttgacttgacactttcgaagtcctcagctgcatcagctgtcaaattttcatgaatttgataaactgttaatgaatacggatgattaacaatgtatagtggaatttgataagaattttatgccaatgatgagaaggatcactcacgtccggtgaaatgctctgctttccctcgtcttctcttcttgcgtatattccacaagaggatggaaactgcagctacgattgcaactgccactatcggcaagacgatttccagaattttgtttgctgaattattcttgactgcattttggagggaaaataatcagttcaagtattcaaaacagagcacctgttttcttgtctgagcagctgattattgagctaccagctgctcaacgaacaaaattgactttctcttcgcagtggcggatccttcatgggtctatgggggtctcgagccctccattacccgtgtcgtaaccataggagcccccacgaagaccccactaaaattttttatcatacattaattagaagatgggtttataatttttgtatagtttgttcagaccctcatattaattctttctggatccgtctctgtctcttcgtgtgccaatttatgatttttctaagactcaatgaaaacaatgagctatgaagatagtcatcgttaattgacatactactaatatatatacgtgacatgatgtaatacagcatttgccatgctaaactatgggtcttgactgtctgcgcggtgattatctgacataacaccaagaatgtgacgagtaacaaaagtcagacttatcagttcaaaagtaatccggtataacataaacaatgcagaaatccatgaaccataaaaaagtataatgacttatattttctcatatttgcagtaaatttgaacccagcaaattttcaaatatcatgtttaaaaattaacgatatcttatatttaaaaatggagggagtatatgttatcgaaatgacgcggtattgtcacctcccgtagtgcccggcgcagcatccggcgacgccgccgccgccgccggcgagaggccgtcggcccacagcttcagcatcggggctccggtgtagaacttgtcctgggatacctccgacctcaagctgcacctcgtgccgacgatcctcgcccccaccgtggtccgcgggaacgtcttccaccacctggcgacgaggtcctcgaggcagctccggcacagcgccggcgacaggtccggcgtgcactgcgccgccgagtagatgttcgggaaccccgggtcggcgcccacccgctgccccgtggcgaacagcctcgtggtgttcactaccgcgtacatcagggtggcgctgaggagttccgtgacggcgcggtcgtagccggcgacgtcggcggtggtgacgttgtcgctgttcatgagcggcgcctggccggagttgttggcggaggcgaggaagtcgccggccgccgagaagcgggtgtagcactggttgtagacgaggatggcgtccctggtgcggttgcacgccggggcgacgtcctggccggccctggtgccgcagtcgtagcagtcggaggagctcacgtcgccgcggcagaggatgaggccgtagacggcgtccggggcggcgccgagcgcgccggcggcgaagagagtgggcgacgtggaggcgttctgctggagggcggcgatgaggctctggaggttggtgtcgtaggtgctgttcgccgtgtacgtgccgccgccgccgcctccgcggcggccgcagagctgccacggctggccggcggcgagcgggagcgcggcggccgcgaagaggagaacggcgaacgtggagcgccgccgcatggcgcccgtggacgcagctgtcacagtcagcaggatgcacagtgggatggaagctagcaaaagaggatagaattttcgcgcggcattgaaatgtttttttctcgtgcacgtacgtacgatggtgttggcaagttgccatggcgatagcccacagagactgaggtcaccacacaacgttaggcagatgttcatgagaaacacccagagtcttccagctagcttcacaaggtggtgaggtagacgacctgaattcgaagtcactcttctaattatttgatattaggtcattttctattattcgtgtttttttagacagatgcttacgtcgtaaagtacgttcattcaggggggacgtttcatcgatcattcgttgtcgaaaataaaggtgagcggaaaccaccacgcagcagctgtttcaacatgcgagtactagtagtaattagcacgcacttaatcgattggaacacttgacccattcttaactagaaataatcaaatggttgggtgtggagtgcgtgcacctggcgcccccgtggaaaaaaccagccgcggtagctgcaacaacttgcatggatggtcagatggatatccattactcctacgctaaaagtatcttatgagaaactaattaattgaagtcaaaagggaaaaagaaagtgacatactactggttttcctcgtatctccatgtttataatttaactttacaattcttgattacaaactgataaaagatacaatttcaacggaaaacaaaacaagcatcaacgagcaaatcctatatacctatacaaatcatccccacttagtgtagttattagcaatttcctgctttgaggttgagccacgtcaccacttatttccatccgttggattcacgttcttaacggtgcaaattgcttcctcgaggccttttctcttgctcgctgaggccagcccaattttcccacctgggccagccagtgaacctttcctcttcctccttccgactagtgtcgtaggcggcgcatcaccaggcctctccatcgtgcgttgtcgagtcctcttcccctcatcgattcgcctcctccttgatggctcgatcaaaaactgtcatttggttcatcttccatggttccaccatcccacggtctctccctctgcgaaaccaacagcctcttccacttctcaaggaatataagaggaaaagaactggaagggtagctattaaaggatcttcttgcatgctgagctcccacaaacaagcaacaacacaacgaatcaatctgttcgcctacgcagctacacccacgtccaactactatcctacaggatacatgtatacctggtagcaatggcactaacaagttgttcatccatacccacgaaaacgtttcttcctggtccagatacaaagatccatcaaatccatttcccctgttagcgcggtttccatctgtaaaagggctcatgtaatcatgtccaactcatctggtggcttcggttcgatgcagcattttagcaggcattttagcctccccttttgctatgaaacaaattgttgcagcacaacagctggattcgccaatcttcatattgatttattggacacaaaccgacacaattgtttctccttcagtgagattgtttcattgcacacaagcagcccattcattcgtgtcttcctggcctataccttttttctgttcccatggggtcttcttgctgaatcaggtgcttctcttccctcattttcccatgttcagctgatcagctcattggctcacaaggttgaaacagatggctttgggatgagtttattggttgtactcattcctcctgtatagaaaaaggcaatgctcctgtttgtcttcatctgcctagccattggctagatctgcatgatatcacttttttatccttcataaaatttaatgtcacatttcccctccattcatgttatatcatgctgatggattttatcatagatgctcttactagctaattgggaaagtaaattctggtcattaatttctacctctattcatatttgagctatactacgattcaacgagaatgatttctggaactttttttttttgatagaaggccagatggcccagcttttatataaagagagtttttacatccacaggctggggagaccagctcaaacaagaaaggagcgttttcagccaatactttggcccaacacaaatagtaggtagcagacgagaaagaaaacatgcgaacttagatgtaactcttcttgagtagggggaaaaggacaaaacaaagttcaagattatcaccttcagtcgactccatttctttggttcacagaaagaagttgcagctcccaggatcatccatttcaataactccgtctttgcttctccattttgtttcatcagcttagcccactctattattttatttattattgtaatattatttattccaatcaaataatataacgccatctcttatatatctctatcagtctgtcatatattgctaaaaagaatagtacaactaatcctcatttaatttgtagcatagcgcaataaacaggtctttgattgttatacacctttcctgtccttacacatatattacgcaagtttcacaatctcctcataagatgagtttgtattatttccaaaatttgtagtcaagaaaattcattttcctataatcgatgaaacaggatgaagctctgctaaggagtacttggacctatccaacccatatagtatgttaaatgtgatggatcaaatgtcctcatagaatttcgctttcttttattggtatgcactatgtctaaatgtgatggatcaattgttctcttagaatttcacttcattttgtttagatacattatatcccgcagcaactcgcggggtattttctagtaccaactatgttttagccccctgctatctaggagacaattgtgtaacggtttgagagtaaccagagttcccctcgatggaaattgttgggctatgagttgcaaaagccggcagagtgctggtagcatcgctgttaagcaaaaccatgacatctgccattgtaggccgatctacagggttttgctgcacgcacaggagaccgatgcttacacatttcagcagctcagcttcagggtagtttcttcccaaggagtggtcagtcatctctacaatatttccctcttcccagtgcctccgtacctagaatcagttacatattgtgagttatatgttaatattgcagatcatatattgcatggttatcttcaaatgcaaatattaaaatgtaagcggtatcaatatactccgtatttgtctatgagttagcaggatactcactatgcttattaaatcttcgttttgttctaagaaatgggggccgctgtttctccgtcccgtcacgatctctatgacgagaatgccaaagctaaacacgtctgactttgtagagtactgcccacggatcacgtattcaggagacatgtacccactgcatgcaacaacaagaaaaaaatgtacatgttagtttgttagctacatataagcacaaacagataaagtgtttgacttcgttacaatgttccaacgatgcgattggtgacatctctagtctgatcctgcccaaagagcctagcgaggccgaagtcgccgatctttgggttcatgtctgcatctagcaagacgttgctcgccttcatgtcacggtggatgatcttcttctgtgagtcctggtgaagatattgtagtcctctagcaatgccttcgatgatcttgaatcgtgttgcccaatcaagttgtctgctttgctccgagtctaattgacacgtgatgaagagattattgtaattattgcatgtcagcaaacgaaaggggtatatatatgtagattaaaaggtaattataattgtaccgaaaagaaatatgtcaaggcttttattcggtatgtacttgtagacaagcaacctctctccctcctctaggcaaaaccccacaagacgaacaagattcttgtgatgcagtttggccactagaactagctcgttcttaagctcttctagcccttggtttgaaccctttgccagcctcttcacggctacctcttgtccaaaaagaagtccctgaataattcttagtttattagctaatttgctttatacatggagatatggacagaaatggtgaattttgtaatgacttaagactctaacatgcatatgctactaatttacaatatttggtttttccaataaagccagatcaaagatcttttgtaaaaataaactataacaaattagcaatggagtactagtgcgctcaggaatcaagacatatttagaatttcatatttttaccgttctcgattcataccttcaaatcaataattcttttctaaaaggaaatcagcaattgttcaaaagttacctgtgaactactactctcccgtcccaaaatataaagaattatgggtggatgtgatatattttagcctgttcagattcgtagtactggaatgtattatattcacttaaattttttatattttgggatggagggagtaccatctattatattattaaaggaatagaaaaagtagcctccacgttcgctctcatggcctagaaattctcacattaatcggaaaaaaagaaaaagcaaagctgaaatttggaattaaaaaataagaaatattagaataggagagtacagtccgctctcatggcatagaaattctcacattaatcgaagaaaaagaaaaagcaaagctgaaattcagaattaaaaaataaggaatattagaataggagagtacagtccatatagaaatacaatttagaaataactgaaattcggaattaaaaaataaggaatattagaagaggagactagagtccataaagaaatacaattaagaaataactgaaattcagaattaaaaataaggaatattagaagaggagactagagtccatatagaaatacaattaggaagtaactgaaattcggaattaaaaataaggaatattagaagtagagtatagagtccatataaaaatacaattaagaaaaagaatagaaattcggaaataaaaaaataaggaatattagaagtagagtacagagtccatataggaatttaaaactaactaaaattcagaatacacataataaaattaaaagtagagtttagagtccgtataaaaatacaatttacaagtaactaaaattcgaaattaagaaaaacacgggaagaagagtttaaagtcaatataggaatacgatttagaagtaactaaaattcgaaattaaaaattaaagaatattgaaagatgagtttagagtccacatagaaatacaattagaaataataaaaattcagaaataaaaataaataatattggaagaagagcttagagtctatatagaaatacaatttacagaaaattcggaataaaaaaagaaatattaaaagacaggtctatagtacatataggaatatatataatttacaaataactaaaatttgatattaaaaataattaataactaacacgtatataaaaatacaatatgaatattacacattagtagtttcataaagttattgtaaaatttaaaattatgtttcattttaatatatttgaaaaatataatgagaaagcaaatatgctattatatgagagaaaatataatgatgctagccgcgcaatctgcgcgggccagcatgctagtttaccttataaactgcaccaaatcccccttcaccgagtttcttgctttcgtggaagttatctgttgctacttgcaatgacgctagagttatcaaggtcgacttgacactttcaaggtcctcagatgcgtcaactggaaaatttacatgaatttgatatagttaattgatattcgaatgttagatggaatttttgaagaattctacgctaaattttgtagaggactcacgttcagagaaatgttctgcttttcttgatcttcttttcctacgcacattccatatacaaaaggaagttgcagctacgattgcaacggccactatcggcacgacgattaccagaactttgcttgctgaattattcttacctgcacttttgcatagaaaatgatcagttcaagtatccaaagtactgtaccttttcttctatgtagcacctcattacaacaacacagtgctaggctgctagctgcttctcaacaaacaaaatataattgtgaatgcacgttaactattttcaatttaatttgttttttttattggattttgtagaagttgaatttaaccatgtatttttgtggactgatatttttcatattaatttaaatagattatttggatggcatatgtaagaaatgagcggatatctccagttctccgcgaggattgaaaatacatctccaactaaatactctctccgttttgaaatgtttgacaccgttgactttttagcatatgtttgaccgttcgtcttattcaaaaacttttatgaaatatgtaaaattatatgcctacatgaaaatatatttaacaatgaattaaataatagaaaaagaattaatagttacttaaaattttttaataagacgaacggtcaaacatgtactaaaaagttaatggcgtcaaacatttcgaaacggagggagtatgttgtatgctcacctcccgtcgtagccgccggcgccggcccttgcgccggcgcgagtccgtcggcccgcagcaccaccatcggttggccagtgtagaacgtgccctggttcagctccgacctcaggttacaccgcgtgccggcgatcctcgcgccctccacgttcaccgggaacgtgtcccaccactgccccacgaggccgtcgaggcagctccggcacagcggccgcgacagcgccggcgagcactgcgccatggagtagatgtcgctgaaccccgggtcgctccccacccgctgccccgtcgcgaacatcctcgtcgagttctccaccgcgtaccgcacggtggcgttcaggaggctgaccaccgcggcgtcgtacgccctgacgtcggcggcgcgggtgatgttggtggagctcatgagggcgacctcgccggagttgttggtggcagcggcgaggaagtcggcgtcggagacgcggacgtagcactggttgtagacgagggcggcgtccctggtgcggttgcagactcgccccacgtcctggccggccctggtgccgcagtcgttgcagtcggaggtgctcaggtcgccgcggcagagcatgacgccgtagacggcgtcgcggccgccggagccgacggcgccggaggcgtagagggtgggggaggaggaggcgttcccctggagggcgctgatgaggtccaggaggttggtttcgtaggtgctgttcgccgcgtacgtgccgccggtgccgcagctcggccacggctggccggcggcgagcggcagcgcgaccgccgcgaccgcgaggaggacggcgtggacgagcgacgagcgccgccgcatggcgccggccggtcagagtagcttagcagaggcagtggtgggatgatggaaagctagtaagctcgatcgatgtagcaatggcacagcattcgttttgagtttttgagctggaatgcgtatcattttggatgtgacagctctgggcaagtggccaacttggcatgcgatggccccaccacaggtcagactgaattcactgaaccccgttacttactctagttgtttatatgtcatctgaagtaaatagttattaaatttttctaaaaaaattgacaacatatactaatataaaatatatcactccacaaatatgtaaaaccaaattcaacttctacaagttgtaaaaaaaattaaactgaaaataattatcgtacattcgcagctatatttgttactgtatttttttagaacttatagaaattaattgaatttaagttcgtatgtttgtggagtgatatatttcgtattaatcaatgttatcaaatgtttttaaattttttttaactatttatatgatatgcataaaatgaaattactttcgcttacttacttgtcaaaacccacgtgcatgcatggacgcagttgatatgatagataacagttgctgaaaggaaaaggggaatggaaataaacaaagctgatcgtgactagtctcaagggaaacctccccgtagccgctgtttcgacatgtttaattagctcctaaaatgtacggagtattaaacaagatacttgtagaactcaatatataattaatactccctccatattttaatgtataacgccattgactttttaaccaacgtttgacaactcgtcttatttaaaaattttatgcaaatataaaaatacttatatcatgcttaaagaacatttgatgataaatcaagtcacaataaaataaattataattatataaagtttttgaataagacgaaaggttaaacgtttgtcaaaaagtcaacattgtcattgaaatacggagggagtaaaatttaggagcaatggattattggtcacgggagtgcttgcaccttcgcgcggtcgggccccatgaaaaaggcagtcgcgcggcaacttgcatgaagaatgtcgatcatatacttcccgaaaatctactgatcggtctaccgatttcacaaaattttatcgaacgctcagactgaccagtgtactactcaagatttaaaatgtttttttctcattaaccgcttatccgattatatcattgtattgttgtaattaaatctttataacaagatatcgcattattatattataataaaaaatatatatatttaaaattgtcagaacctaatgttttatacgtgatagtgatatatacccgtatgtgtcttcagtgtattttacaaaattcccgaaactacctaccactactctctctccatcttatccatacatgcacattctattgagcttcaaaatgatttttctcctaaactaattatccaatctacgatctgattacaccgttgtattcgttgtaattaaatctttacaataagatatcacatgattatattttaatgaaagaaaaacgtatgcttcaatccgttaatactagttgtttcatatgtgacagcgacatgtttcaacgtatatctttaccaagtttcatataacttttaaatgttccaattgatggttttttcatcattataacttgatgtttcgctcgttggtcaactggaatatttgaccgtccgattatttgggcatcgtgcgtctgatggatagattctttttatacttcctccgtttttaatatataacgccatcgatttattgatatacgtttgatcatttgtctttttaaaaaaaactactcctaaaaaatatataattatcatttatttcattataacttgatttaccatcaaatattctttaaacatgacttaaatatttttatatttataaattcttttaataaaacaaatgatcaaatgtaaacaaaaagtcaatggtgtcgtatattagaaaaagaaagatagtgctaccttagggtgaattaattagagccaaaaacaaaataaaaggatactgggagtggcatgtttttaattagtggaagtttttttgaactcccacatacggcaaagggagcggttttattttccttttattttaaaaacatgccactcccatcactttttcactatctcgttcccccatgtttaatcgtttccatctccctcctctttcttcaccatctattcctccatccctgcgactgcaaagaggacagcggtgatgacggcagtggtggcagtggctcccgagcactcccgccgtggatggtgtcgaggacggcgacggcggcagctcccgagacctcctgtcacggatagaggacaacgacggtggcggctccctcccgccatgcccgagctcccacaccgcctccgctgcctgctcctttggctccggagcccaccttcctcctcctctgccggtgccttctcgtcggccccctcccgaggctgcccgctccacgccgcgctgtcccagcgctgtgcgcccgcggtcgcctccctcgccctctactaccgcatccgcgaggcctcgccgcccaccccgttcaccttctccctcctcctcgccgccctcgcgtcgtcgtctttcccgccccttccccatccacaggctttgcgcgcctcgcccacgagcatgcattcaagtgcgatgcgctcgcgcaccccacctgatggagccatggagatcgccgaagtctgtgatgactgtgcttgtgcgcgtgcaatggaagttcaccagcaagaggaatatgtagtggcggggaggaggagaccgtgtcggcgacggagagggaaagggaaggcgtgcgcaggaacgggaccctgtcgttaccaactccctcctcaagctctaccgctcgccggagagggggatgaagtcaggaacggaaatgaggaaggagggaggggatgaggacggcaacggagacggcgtgagagaggagacggaaaaagggacgggagtggcatagttttaattatagaaatttccagtggcatgtggccgatatgatgaatagtagtggcatttttttaatttcgcaaagttgcagtaacatggatccaattaacccttttaaaaactatccaatccattgtcaatatgtcatggagtagaagcaattgataaatcagtagtacattgtaacttggagacgaactggatgaaaattttttgaacaaatcaaaataatacaatggtaaggaatagatatttgctctttactgggacaaccggacaaaatgttagcaaaatattggttggttcgaatataagaaccaagccaaccggaggcggttgtatggtagaaacaccaaaatcaattcttcttgcaaaattaaaagattaccctcaaactttacgaagttgcaccggtcagatcgttgtgatgacgtcgtcggtcagaccgcctgtcgatctccttgtctgcttgatgatgttgttgctaccgccgccagtccaaccgtccgttgtactccagttagaccgtcaggatcaagaaaaaaacaaaacggcgaaactcttgaaagtatattgactttatatgcatcaatatgtgtttagaaagtgcatctaaaacacttggtttgtgctccttcgatttgccactgccgtttgatttagttcaaataaacggacgaaaataattcataacaaagaaaaaacatgatccccctcactgcccatctgttctgatcagtgctcttcactccaccgtgaagaatcagctcctctctctaggaaccctaatccccaaatcccctcgtcactttctccacatcaagagcaaatcaacccaaaaaatgggtccccaaaccccctcaacagcggcggcagggcagtatagcagcaggcggcaggaggtggcggcggcaagggagcagcagctgccggcggcgttaagagcaacagccgggcggcggcagcagcagcacgcgtcaggagcaacaaggcaacagcaggagcaacatggaacattacatactccacatcgaaaatgcttgcgaccccctagctagtttattatgcatttttatgtgggttctgaaccgatccttcttgatctactagctagaacatttatttatgggagtagctatatttatggcgccatattttttattaaaaaatagtcgctatgtatttacattgtaagtcactaaattacatatgtaattttagtgtatttacaatgtaaattccaaaattacatatgtaagtcctaaaattacatatgtaattctcaaaattacatgtgtaagttgatgtaattcccaaaactataaatttgtgatgacaccaatatttagtttttaagattaattagtaatcctacttagcaaatactaacattaaagcaacagaagagatcagaagagaacaaaatcggagggatatgtgtacacgtgcgatttctgcatccgacggttgaaacaaccaactgaaatctatcgtaatttgtggcgacatatttttagcaataccgttatttatttatttattttgcttatgttgtaggaatggttcggcttcttgacaattattgttagagttgaatctcatttgaccatatcagttttggagggcaaatcaatatgtaagctttttatggcaaatatgatgtcaatcttgaatttttgtgtgcaggggtatccttatcctattctttctgaaaaccagccttctaacggtgttagtctaatttgttagttacatattttataagggttaattagatttataccattataaatttatctgttttaaaatataccattataatttatctaattggaaggatgccattgcaatacttctaaaatcggatacatgccattctatacgtttgagatgggttttgaatcggtttttgtctattgtattttcgtacagaccaaactaccccttatcctaccactcaagcaccgtaaaaataaatcaccatacgacccacagcatttcaaatcaagattgaaatcgctcgtgccagtgcaatgaaaaaaacagatttgaaccacaatatttcaaataaataaactgaaatcgctgatgttaaaaaaaaattcagaatcgatatgcagtatttgatcctgaaaaaaatacagagaggagaaaaaaaagggaaaaaggaaaggaaaatgccactggagctcgccgttgtctccaagaacttgtcgcgctgcgactaggactagctcgcctccgccaccttctgtttgcttcgtcgtcgatgcgaccgttgctgctttctccgcggccagcgttgccgctgccgccgtctccgccgccgccgtttccttcaccgctgccgctgcttgtggtgcgtcgccactgccgaagccctcggtgccccgccgctgcttgctccgctgccagcgccgctgccacttgctttgtgcgtgatgccgaggccctgctggctccgtcgtcgccgttgcttgcttcaccgctgcagcttgttgcgtcgccacagcgaaagccctcggtgccggtgccggagcctccgccgccaccgccgcttgctctgctatcgccactgctcgctcgctcggctagggtttggagctacatttggggatgattttaagctgtgaagactgaagaccaacggtagtttggtccatacgaaaatacaatatataaaaacaattcaaaacccatctcaagcgtataaaatggcatgaaccagattttagaagtattgcaatggcatcttttcaattagatgaattataatagcatatttccaaacagacaaatttgtaatgctatgatccaattaacccataataggaaattcacaatactggatcaaacaagtgacaaatatgccctatttatttataccataacgtgaatgcccctaactaggaatccaactagaactagacttctaatcacataggaaatctaagaaaccagagaaacaacatccccgtacaactccacactctaatctttccaaacttggattccaatccaaatttgactactctttctatacttgcacaacacctcgtgtatgatatatggaaactttcatctccacgtgcattgttctctagcctagacatcccgcgtgatatccttgattgtttggatctcagcttctcccaagcctagtcctaatctatcactggctatactcctatggcctcaagcaatatttgcacatgaactaacaaagaaataccatatttgagtacaagttcacactaaattgactgacatcaacacacaaacaatattacatacatatagaaacaatctagaagtcataaacatgaagtaacatagaaattccacgaaaacaatccgaaaccaactccccacggaatctgccgatctgaccggcaacctagtgccaccctgcactgtttacccgcgaaaacagtattcaccataatttctaaaacactcacttttgactatttgttcatcatataggttgaatctaacaacttgatttcacaatggaaagggctatctctgaacccaatctttaacacataaagaggagagaaggagttgagacgaaaagcatggagcgagctgcctgagagattgaatgggataggaatctcccaatgtggacacttttcattaatcctttcttactataaaattgatgcccattaactcctaaaactcatcatgcaagtgtgcgacatcatcacccacactagcaattattatctagagtattttaaatatcatgcaaacattacgtatcatttacaattttgctgtattattagaactcaatatacaagcaatggcaaattattatctactcatcattttcacattatttaaacatatacatttaccatttttataatgtataacatgcattcattcacatatcccgcaacaaagcacggggtatcaactagttaaactatatataacccctgaggagtaatagtcccccgaaactcttcattaattgaagttggatgctacggattgcaaatcgagaatgaatagtttcaatatgaaacaacagaaagcaacaacatcggtgacaaatctagctcccagctaccaaccagaccattatgttgagtaacctgttgagtaaccagagcttccatcaatcgaagatgttggcctaggtgcaggaaccggtagagggcaagtagcgtcgctgttaagcaaaaccatgacatccaccattgtaggtctatctacagggttttgctgggcacataggagtccgatgttgatgcattttaccacctcagcctcattgtagtttcttcccaaggaatggtcgatcatctctgctgttgtcccctcttcccagtgcctccatacctagcaatagtcacaaatatgtatgtcttcagcagtcagcagtaattacgatagacatgtgcagctatccacaaatatgcaaatattgcaatgcaaagcaatatcatgaattcctatgtgaactaccggggatactcactatgctcaatatatctacaccattttgctcagagaaatatggcccactgttccttctttggcctgtcacgatctctattacgagaatgccgaagctgaacacgtctgatttcgtagagtactgcccgcacatcacgtattcaggagatatgtaaccgctgcatcagcaaggaggattgtatttcattagtttgttagttaatataagcacaaaaatatgaagtattccatcaacttaattacaatgtcccagcaatgcggctcgtgacttctcgagtctggtcctgcgcgaagagcttagcgaggccaaagtccccaatcttagggttcatgtcagcgtccagcaaaatattgcttgccttcatatcacggtggatgatcttcttctgagagtcctcgtgaagatattggagtccccgagcggtaccttctatgatcttaaatcgtgtggcccagtctagctgtttcctttgctctgtgtcttttttcaccaaatgtaaaaaaaatgtcactattattggtggagtgaaatgattacaggagtaacaaatgatcaaagataatgctaatagtaccaaaaagatgggtgtcgaggcttttgtttggcatatactcatagacgagcagtctctcccctttttcgaggcaaaaaccaatgagacgaacaagattcttgtgatgaagtttggcaacaagaattagctcatttttcagctcttgtagcccctggtgagagtccttggccatcctcttcacggccacttcttgcccggaaagaactccctaaataatttagcttagtatcttactttcttactaacttatacatggagacatgaacagaaatacaaaattttgtaatgggttaaaaatataataatataacataactaattttaaaggttactataaaaaatcaaagtttctatgtgatttctttatagaaaaagcaatcttaatgaaagataaccttcataaaaggaattggagaggagacaagcaatatagtgtctacaatgtgcaagaaacaattcaagacctatttttattgccatgttgctcattttgcacgacaatgtgttcttttccttacaatatgcctcctcctgaggtgcccaaaaaaaaatagtaactcgcttcggggagtgcctagacacttgaaattcatcaatttggcattgaaaaaaaatgataaaagatttttataacagaaaaatgatgtctaactctgcaatgcaggttatcttcttatcgtccaactgatccaaatgttggtctatgttattacgatgggaggagcagtatattatgctatattcttagagttagttaccaaaggtcttttactttctatgggtggcgtaatacatataggcttactttttgctagaatttatgtgtctttttaagtctatcaattggttttcttccaaaggtatttgaggatttgtcccatcacctatgtctttttcaagttaacttgttacctatgtattatatggctaaagtcgaggatgtaatatattttcactattaataaaatacaataactaacctgcactaatagtttttctaaacaagaggcaggagcttcgccatttgtttcaagagaacacaaaatttgcgactcactcacaattgagcagtagtgcattcatacttctaggtactcccttcgtccataaatatttgacgccgttatttgaccggattcgtcttactcaaaaaatttaggtaattattaattattttcctatcatttgattcattgttacatatactactactacttaagtttttaataatattcatagaagtttttgaataagacgaacggtccaacatgtttaaaaaaaatcaatgtcatcaaatatttagggacgaagggagtattaggctgtgtttagatccaaagtttggatccaaacttcagtccttttccatcacatcaacctgtcatacatacacaacttttcagtcacatcattttcaatttcaaccaaaatccaaactttgtgctcaactaaacacaactttaatttagaatttatattttgaccatagtcaattcacaccatcaaatcgacacatttttctcaaaagaaatcaacaatgattcagaagtagacgtaaagactactggcctattaccttataaacttcaccgaatcccccctcaccaatcttcttgcttttgtggaagttatcggttgccacttgcagtgatgtcagagataacagtgctgacttgacactttcaaaatcctcggttctatcagctgccaaatttgcatgaatttgacgaaatgttaacggacgccagtgtataagaatgttaatatttatgccaaaattatgtgcagggactcacgtctggagtctgcttttgccaatcttctcttcttacgcacattccagatacaaagggaaattgcagctacgatggcaactgtcactgtcggcaaggtaattaccagaattttgcttgctgaattattcttacctgcatttttgcagtgaaaaataatgagttcaagtacgtgaagaactaaatatgaaacggattacacaataatacagttctatgcttctagctgctgctcagtgaacaaattttagttattttttcgcttgataataatccatcaatctatctatctatctcatgagaaaagaaaagaaaagaaaagaattttgactataaatggtataaatggatcgacaatagttgtatataaattaatttgtatatacaaaaacataaagtaaaagatacccaccaccaacaacaatatgtgcacgcaaaaagtgagagaaaacctaaaaaataatcgaattccttcaatataaaattttcatcgctccttgatatattacacggtaaaaatagttttttaaggctttaaaaatatatacaatacactacggtctttgaggaggtaccatgaggtaccaaaaatttagtgtaaaatttggtacctcatggtacctcatagtacctaggtaccgagagaatccaaatttacaatagaaaaaagggtacctcatggtaccttctcaagtaccgtaaaattgctctttttttaaaagaaaaccgttgcaacacacagactgtacgctagttgcatatgtaatataatcatatttatgtaagggagaatagctactatagtccataaagtttcaatgtaggattagtttagtccctaaccttttaatggtctaaaaaacccttaaactttttcataaggcttagaataatccttgggtccaaaaaatcattatatggatatgccatgtcatcattcatgcaaaatctatgatgaattacccaatttacttttacgtatatcatagaaaaagaatgtaagggtgaattagacataaccataggaacaaatacttttcccatttttttcacccttttacgtatatttttactcttacatataccatatatatatttttaacttttttccttttttctaatttttctatgatatacgtaagagtaaattagacaaatcatatagattttacataggagggtgacatggcatgtccatatagtgattttggtaggaccaagaacaatattagcccacgtgacaaatttaaaggacttgtttggacactatgaaatattaaggactaaaatgatctaggagcaaaattttagggatcatattggctattctccctttatatatgtaacataaactaagaggagtataaatcaaatttaagttaacagttaaaatcaagccccgtgcaaaattacccgggaaaaatatgggacagcatgagcgagacgaggaagtataatactgtagtttaattaatcacctcccgtaatggcaggcacaacatccggcgccggcgtgagcccgtcggccttgaccggcaacagcaccatcggtctgccggtatagaaggggcccggccccagctcggacctcagggagcagcgcgggccggagaccctcgcgccttcgccgttccgcgggaacaagaaccccttccaccactggtccacgaggccgtcgaggcagctccggcactgccccggcgacaggtccggcgagcactgcgccatggagtagatgttacggaaccccgggtcggtgcccacccgctggcccgtggcgaacagcctcgtggagttctccaccgcgtactgcacggtggcgttgaggagctcggtgaccgcgcggtcgtagcccgcgacgtcggtgctgctgatgttggtgccgctttggagggcgctgtactcgccggagttgtcggtggcggcgaggaagtcgcccttgtcggagaactgggcgtagcattcgttgtagacgaggatggcgtccttggtgcggttgcaggtcggccccgcgaccgcgtccctcgagacgttggtgccacagccggcgcagtcggaggagctcaggtcgccgcggcagagcaagaggccgtagacggtgtccggggcggagccgagggcgccggaggcgaagagggtgggcgaggaccccgaggaggcgttcgtgcggaggatgagcgcgaggttcttgaggttggtttcgtaggtgctccctgctgtgaacgtgccgccgttgccgcatttcggccacggctgggcggccagcgactcgaggagcgcgaccgccgcgaagaagagaacggcatggccgacagacgagcgtcggcgtcgcaacattgcgccgatagagctaggatgcagctagctaggggcgtgggatagatggcagtataaaactaacacggggtgcatccccttaaaaaggatattcgatcgcgtcaaaaaaaaagaaggatattgatctcgtctttggcaagttgggcatgccatgcatagtccatatagactgaattctctgatcaccattaggtacgtgtgtacttatgtgcatgcagacgtgtttcatcgtttgaacgaagaaaaagggaaatggaattattcaagttggtcgtcgagattaacagtatcttgggaacgaactcatagccgctatttcttttattttttacagctcgcactagacagtgcaaagttcatattgatatagcaggaaaaaaaattacaagattacaaccctacactaaaataaaataaaataaatctatactacctacgtgtatgaaatgttgacatatatatgtaactgataaatctatatactaaagcagggaatacaaatcaactgcaggaatttgaactagtgaaatgggcagatcagcttgacaacttgtatttgattgaaatggcttattgacctaattactattagtagaattcagacaaaactagctagctgacaaactaacaaaactagataccgattgctcacaaaaatataatcaaatcaagaagtcaattaactagcttccatgaaattactagagctagctgaaccaagtttttttttgaggggtaaaagcaggagctctgcctatttcataaaaggagaagagagggaaaccgagcttgtacaagcaaggttacaaaaggatcccaaggggaccccttccaaggtcaagttggtcaagttgaaccaagctgaaccaagttttaaattcacaaaactaactgctgacaaaattagatcaagtcatatttagtagccaacaaaactaacaacaccatgaactaattaattattgattaaactagctgctaacaaaactgcatttagttatatatgaattcagacaaaactaacaaaatcaggtactaattgctgacaaaactaactgttgaccaaattgctccttggcttatacaaattcagtcgaaactaaaactttaacaaaactgaccaccaagcactgacaaaactgacattaagatatttggtttagctaacaaaataggcgaaaaaacaaatttgactgtaaatatacgttaactagatgttgtttaatttgtttttttcgttacgagatataaaagttgaatttgaacttatatgtttgtggagtgttatatcacatgttaatacatcttcttaattttttccaatttttttcgtaaccatttgagtaacatgcaaataacgatgtcccctcgagggattaaaatatatagtttcccgtctagtgactattcttgtttattatgttcaggtcctaacaaaactagtccacaaaattctggtgttatttattgacgacataatatatctagccacatttaaagtttggaaaaaagctagcataacaacattgactcaatatgcatctacatgcatggctacaaaacattttagaatgggattattgtcaacatgttcgcacgcatagccgcacatactaggaccccaaccagcaaaatcgttgagcttgcctcggatgtagaaggtggagcatgacctcggcatcgtagagcacgacgagctcgtacgccttcttgaccagaccattcttgtgcttggaaaaggtcacctgtctgttgatcttgttctcgatccgcttcagctccaccctccccgtcacaatgcctacctcatccacaacctcctcaccctcacgctactcctctacaacctagaaacctttctcctgcagctaacatctagctcaatcgattgatctcacgaaacgaagctatggaatgtacctagacagagaaaaaaaaaggtgaggaggaggaagggaagaggagagtagagttttaaataggaaggggggatcggtgcctgtgcccccacccccccccctcgcgagtaatgtaggcgtatgaacaaggtacatcaaaggttatcttggtgagccaaatcaacacaaatcttggagtgatctagcggccacaaatgcggcttacaaaaccaaataccaatagcaggtaaaaggggtaccaaatccttatttaaataataattaaataataaattactcccacccatttaaattttccttcctaagacttacaaatccaaatttaattatgtaccatatgcaaatcttaatttacctacttaattaactaaagttggaaatccgcaataaatgataagcaggttgtaataggcgtgcatgcacttttttaagctaaacaagtatttacaaagaaaaaacaatatgttagcttggaagactggtacctaccctaatctcgaggttactgtttaacaatataattgcttgtctggtcttccttctcgggcgcccctaatgggacccgcccctcccctatactcctctcccttctctcttttcatcatatatttttttaaaaaaacaaagttagtaaaaaaaatagaaaaaaaattaatactctcattcatgtgcatagactttataccgtaaactttgcacgcataaattttatatatagaaatattctatatataaaatatttgaatccgaatttgaatttggattgggtatataaacttttaacttataaacattcgctctacaaactttagatggataaattttagatgtgtaaactttaggtgtataaacttactaaaagagaaaaataatgcacacataaactttacgtatagaaatattctatatataaaatatttgaatccgaatttaaatttgaatcgggtatataaacttttgacgcataaatattcgctctacaaactttaggtggataaattttagatgtgtaaactttaggtgtataaacttactaaaagaggaaagtaaagcggtgccaaaaatggaaactgcgtgggggggaggggaaccgatcgcccctcgcgatcgatcgctcgataggtttttcgttctcgttaagtcacactatagactcatgccttgcgcagctgcgtgaaaatgtgtcatacaacgccataagcccattttgtgttcccattgatggtcttgtttcagaggataatttctcaatccatcatgttaaacctctattggatgggtcataatcttgacagattctggtgcatgcattgaactttagttcaaattaccggcctacaaatgttggtgagctggattgaagcccatttaacaaggcctaataatagcttttgaatagacgggtttgacctcatgagtttctgttaacggtgaaatttggcaacagtttcttgatttacctcattggtgtcaccttgtttataactaatcatgactataaattaacagcaaaatcatgacatccgccattgtaggtcgatctactgggttctgctggacacacaggaggccgatgttgacacatttcagcacctcggcttcagggtagtttctgtccaaggaatagtctaccatctctacaatatttccctttgtccagtgcctccatacctagcattagttatatatagatctccagttatcagtaatatagatggtacatatgagtggttttctggaaacataagcaatattagtgtattgatttgtaggaattagaagggatactcactaggcttactaaatcttcgttttgctctgcaaaatagggcccactgtttctttgccctgtcacaatctctaagatgagaatgccaaaactaaacacgtctgatttcgtagagtattgcccgcgaatcacatactcaggagccatgtatccactgcatgcagtaagaatgaaattgcatgttagtacgtagtttttaagtgaaatattggcacataagcttcaagtgttctgcttaattacaatgtcccaacgatacggttcgtgacgtcccgagtttggtcttgcccgaagagcctagcaaggccaaagtccccaatcttggggttcaagtctgcatctagcaagacgttgcttgccttcatgtcgcggtgaacaatcttcttctgggagtcttgatgaagatactgcaatccacgagcgacgccttctatgatcctaaatcgtgttgcccaatctagttgtcttcgttgctccacgtctaattagccccaaatgaagacatcattgtaattgttgcacaccatcacatgagaaagaagtgcatgaccatatatactgaaaggaggtgttaatattaccgaaaagaaatgtgtcgagacttttattgggcatatactcatagacaagcaacctctctccatcttccaggcaaaaacccacaagacgaacaagatttttgtgatgaagtttggtgacaagaactagctcatttttcagctcttctagcccctgatttgaaccttttgccatccttttcactgctacttcttgtccaaaaagatgcccctgcatattttttacttttcattgatatactgtattttgtaatggtttaaaaacctgagtgctgtaaaatagtttacaattattggtgtttctaataaagaaagatcgaaagatcttttgtagaaaataaaaatcatcatcatcatcaatggagaaaaacttttagatattcatattttgagcttttgaccatgcttgactcgcaccatcaaatcaacaattatttttgaaaaagaagtcagcaatgactcaaaagttacacataaagactactggcataccttatacactgcaccaaatcctccttcgccgagtttcttgctttcgtcgaagttatccgttgctacttgcagtgatcccagagttagcaaggttgacttgacactttcaaggtcctcagatgcatcaactgcaaaaatttgcatggattcgatagaacaatcaattcatactgatgattaagaattttaagtggggtttgtaaacaatccgatgccatattgtatttgtgcagaggactcacgttcggacaaatgctctgcttttgtcgctctgctcttcttccgaacagtccacatgcagacagaaattgcagctacgattgcaactgctactatcggcaagacaattagcagaattttgcttgctgaattcttcttaactgcatatttcagtgaaaaataatcagttcaagcatcggagatgagtaaacattaggtgcagatgacgtgaagactgaagagacgtgacgtgatcactttgatgggtagagtaattggtatgctgctcacctaacgtagtggccggaacaacatccggcgccggcgccgacgccggtgagagcccgtcggctcgcagcagaaccatcggagctccggtgtagaacccggagccgagctcggacctcaggtagcaccgggggccggcgaccctcgcgccctcgccgttccgcgggaacaagaaccccgtccaccactggcccacgaggccgtcgaggcagctccggcactgcgccggcgacaggtccggcgagcactgcgccatggagtagatgttacggaaccccgggtcggcgcccacccgctggcccgtggcgaacagcctcgtggagttctccaccgcgtaccgcacggtggcgttgaggagctcggtgaccgcgcggtcgtagccggcgacgtcggcgctgctgatgttggtgccgcttatgaggaggctgtacgcgccggagttgttggtggcggcgaggaagtcgccggtgtccgagaactgggcgtagcactggttgtagacgaggatggcgtccttggtgcggttgcaggcctgggcgacgtcgtcgccgaccctggtgccgcagtcgaagcagtcggaggggttcatgtcgccgcggcagagcaggaggccgtagacggcgtccgggccggcgccgcggacgccggaggcgaagagggtgggggaggcggaggcgttcgcgcggagggtgctcgcgaggcgcaggaggttggactcgtaggtgctccccgccgtgtagttgccgccgctggtgccgcagacaggccatggctgggcggcggcgagcgggagcgcgaccgccgcgacgaggaggaggaggagaacggcatggaggacagaggagcgccgccgcatggcgccgtcagagcaagcttgttcgatcgtcgggctttgcattgcaattgcaaatttgcaatcctctgctaatggtacctactccactactgcagtatcatatcggtaaactgttttaatagccagtggacgtccacccatttattgcatgttatctagatgaatataaaaaaattaaaaaaatatgaataagatagatcaatatgtaatatatcaatccacaaacatgcaaattaaaatttaacttttacaaattgtaataaaaataacaaaaaaaactcaaattattataggtatgtttacaattaaatttgttatttttgttacaacttgtagaagttgaatttgaatttgcatgttcgttggagtaatatattatatattgatctgtcttgttagtttttttgaaaatttttcgtaaccatctaattgacatgcaataaacgggtggacgtccactcgagctattagaatccatctccgtatcatatcttcttgttttttttctcttttttacaagcttttagtacagtactacctatacttttggaagtgatggctcttgacaagttgtcaacttggcaattgccatgcgatgccgattggccgaggccgacaggtcagactgaattcagtgaacccgtctggtggatgtcaaatggcacgtgggacagggactaattatatattcgtcgacatcacggaaacctctctgtagcagctgtttgcaccctgccttaaaaaaggaacacgcatgctatatatcgcttaattagtcaaatgaaacttgacccatttctaactcaaaatgactgttgcggtcgcgtatggaatgatatcgagaaaaatcggtgcatggctatgtgtaaaccgttccactttttaccgtacgtatacgttcaaacttggaggcgtgtaaccacgcgcgctgtacgtcgtgattcaactatgaccccgtgccaggttttcggctaataaagggtaggatttgccaatatacgcctattttcagtcaggagagcacgcgcagcgcgacgaatcagtcactggactatatttggactggagagaggcagcaaggtcgcgggtcgcgcgcggcacacgcgcgcgcacgcacgcatgcatggccgcctctctcgtcgatgcgggccggccggcacccaacatataactcctacatgagcgcgcggtgaggcgatggcacgtatgtgccggtgtcctccgcgcgcgcatcccagcacgttcggctcggccggtgtgatcagcgtcgggcagcacgtacgtacgagcacggtgaggagcaaaaggacatgacatgatatgagtatatgatcaccaaccgccggcctgcctgcatggtgcctgtggaagggagaaactatataacattccgacagtttttgttaaaatctttcaaatattactctagtatactagcatattgcctgtgcatggcaacgggtttccaataaagaaaatttttattaatatgttattattatctcttaattgttgtacgtatttgttacttatatgtgaatcttgttagagcatcaccaactatccacctactccctccgtcttattatcctatataataaaggattttgactttctgcttgtactgtttgaccactcgtcttattcaaaaaatttgtgtaaatataaaaaacaaaaagttatgcttaaagtactttggataataaagtaaatcacaaataaaataaataataattctaaaattttttgaataagacgaatggttaaacaatgcaagcaaaaagtcaaaatcccttatattatgggacggagagagtatttcatttcgaaaattgaatttgagagattttagtccaaaacacagctccaacggatccgctactctcctgccgaagtttccgagttctttttatttacaaatgagtcactttttattacaactaggtcctttttcttttcttttcttttttgcaaatttcctcgacaccaatgttggtggtgccgttctccttcacattagtgacttagctttcacccgagggtggagaggacggcgccaacgtccttggtgctgtcatgttggaccacggcaccaactacattggcgccgcgaaaagcaccatttctaaaataagttattttaaggatttatttgtagaataagttttttttcaaaagaactaaaaggtgaaaaatccagttctggagttccatctcccaaatcctagctcggttgatatgagggcgcacgatctcgcctctaccactcccaatctcacgctcccgcctctctcctcccgttcccgggcgaggggcgaaatgtttttgtccgtgggtggagggcatccgtgaaggacgagctcctcaagtctgcagccgtcatggagaagctctctcaggtgctggaacccgatgagaccgacgaccatcacgccaaaatcctgcagccatcgccgcccaagaggacggccaacatgagccgccgcgagagtgccacgtcgtcgtgcagtaccgacgagaaggccatgatcgctgcaaagcgcaagctccgcgaagtgtatcaagaagcagaggacgcgaagcggcagctagcgcacaattaatcaaggtgatcgaggcgccgaagtagcacccgatcgtgtatgagagaaacagatcgggggcctcgacgaacacgtcgttgcgtcgtagagtctagacttctttcttcctccatgatctgatgatcatgcccatctctccgtaaattgatgtgcgtaattaactgattcttttgagttaaacatgctcgacctggattactcgtgtatttgtaaacaacaatcgatgtgatggtgccttcgccgtcgcggaaggaggaggaatatataactgattttttttagttgatagtttactatgcggtccacttttctattttagagagtcaattttacacaatctattggaaggatcacttctgttacttatcaaatttcatttaggattcccaaattcaaaattttgaagaatgaatttacaccttctattagtgatgctcttagcttcacttttttttttcttcccgcaaaagtaggtggtgaccaaatcattaccaccactactattttttataa

SEQ ID NO: 8056 - DNA, 16060 bp, Oryza sativa
aggaatggagggagtaataactagtagcatgtaattggaatatgtcatggatggacacaaactcgatgataaacattgagcgagacaaactggtcaatggtatatatttactctttattagttgaacttggttatcatggaatacaaattgagaactgatacacttacaatataaaacaaagcaagcagcaacaagccaacaacggtgctagatctgcttcggccccctgctacctgccggaccattgtgttacggtctgggagtaaccagaggtcccatcgatcaaatatgctggcctaggtgcaagagctggcatagtgcaagtagtgtcactattgagtaaaatcatgacatccgccattgtaggtcgatctacagggttttgctggacgcacaagatccaatattgacacatttcagcacctcggtctcactgtagtttcttcctaaggaatgatcaatcatctctgcaattgctccctcttcccagtgcctccgtacctagcaacattagtcacacatatgtgtttagtcagcagtaattacaataggcatgtattcctcaatgaattagtagggatgctcactatgctcaatatatcttcatcgttctgctcagacaaatatggcccgctattccttctccggcctgtcacgatctctatgacaagaatgccaaagctgaacacgtctgatttcgtagagtactgtccgcgcagcacgtactcaggaggcatgtaaccgctgcatcaaagaagaattgcattttagtttgttatctatatatgagcgaaaaataatgagtgttccttcgacttaattacaatgtcccggcgatacggcttgtgacttctcgagtctgatcctgcccaaagagcctagcaaggccaaagtccccaatcttggggttcatgtctgcgtctagtaaaatgttgctcgccttcatatcacggtggacgatcttcttttgggagtcctgatgaagatattgtagcccccgggcaatgccttctattatcttaaatcttaccgcccagtctagttttctcttttgctctgcatctaattaccaaaagaaaaaaattgttattgatggagtgaaaagacaaaatatgtaggttaaaaagggtaatgctaatagtaccaaaaagaaaggtgtctaggcttttattggacatgtactcatagatgagtaatctctccccctcgtcaaggcaaaaaccaacaagacgaacaagatttctgtgatgaagtttggcgacaagaactagctcgtttttcagctcttccagcccctggttggagcccttggccatcctcttcacagccacttcttgtccatgaagaattccctgaataatttaactacttggcttagtatcttactcctcctggatataaatatttgatatttaggataagtttcgatcaacttttgtattttggaccatttattttatattagtactagtaaatttataatatcacgagagtagtaattttaaggcaaatcaatatataccaatcctttaaactaattaatcatttaaggaattattgatgatacaaaatttgaaattttgaccaaatttggtcttaaatatttataggtgcgctttggaacccatgtgatacgttaaaccaagagttatggatagagatgtgtattttgtaattttatggactcagatgactttttaataagtttaacaaccagacattcatattttcttgctttttgtaacgtccattatgaaaaaaaaaaggttatagctaggctcaacttatttagttagactacacacatgcatatattttactatataacgcttatagcccaaaataattctaggcccgactagataaaaacgattttagacccgactcatctaaatggaatacaccctacactgtaacactatcatgttttacgttctcgcttcacgcaataagtttaaaccaatattatagtcatggatcagcttaaactcctaagttgaaactaagagcaagtgttataatagatgtgactactacttctaattttatttatgtcttttattggcaacatatccactatatcacatataatgttcaaatagtaatatctataatactctcacgttttacttggagtttgcgtggatgttgtcttttgatttagatttagggtggctgatcatttaatcctatttggcagcatatggaacatttctgatgtgctgttgctggcttgctgctgcgtgtgatctgccagctagctagctagcttgcctagcccaactgccgctgctcgtcctgggggtcaagaaggcccaaggtcaaccgggccaattgctctactactgctggaggcccaaggactaaggtctcgtcctgctttattattatttcctctaattattctgggacgtcacattttttttttatctaaaaccaagggctggagcagtagtgcaccaaacctctgcgatatacttcaagaagagaagtacaccacaatttgtgattaattaacaattgagcagtagtgcaatcgtacttctagccatctagaatttatatttttgaccatattctgggttcacaccatcaaatcacacaactttttctcaaagaaatcaacaatgatacaaaagttaaaaagttaagagtactcatgccataccttataaacggcaccgaatcccccctcaccaatcttattgctttcgtggaagttatccgttgccacttgcagtgatgccagagataacagggttgacttgacactttcaaagtcctcatttgtatcagctggcaagtttgcataattttgactaaactgttaatggatgctcgtggtataagaatgtttaacaagaatttatgcctaattgtgtgcagaggactcacttccggggtgacgctctgcttttgccaatcttctcttcttacgtgcattccagatacagagggaaattacagctatgatgattgcaactgacactatcggcaagataattactagaattttgcttcctgaattattcttacctgcgtgagctcgtcggccttgaccggcaaccgcaccatcggattaccggtgtagaaggggcccagctcggacctcaggtagcagcgcgggccggcgaccctcgcccccttcccgttgagcgggaacgtcttccaccactggcccacgaggccgtcgaggcagctccggcactgcgccggcgacaggtccggcgagcactgcccatggagtagatgttgctgaaccccgtgtcgttccccacccgctggcccgtggcgaacagcttcgtggagttctccaccgcgtaccgcacggtggcgttgaggagctcggtgaccgcgcggtcgtagccggcgacgtcggtgctggtgatgttggtgccgcttatgaggaggctcacctcgccggagttgttggtggcggcgaggaagtcgcccctgtcggagaactgggcgtagcattggttgtagacgaggatggcgtccttggtgcggttgcaggttggccccgcgtccctccagacgttggtgccgcagtcgaagcagtcggaggggttcatgtcgccgcggcagagcaggaggccgtagacggcgtccgggccgacgccgcggacgccggaggcgaagagggtgggggaggcggaggcgttcgcgcggagggtgctcgcgaggcgcaggaggttggactcgtaggtgctccccgccgtgtagttgccgccgctggtgccgcagacaggccatggctgggcggcggcgagcgggagcgcgaccgccgcgaagaggagaacggcatgggcgaccaaagagcgtcgcagcattttttgccgtagatgcagcagtttgggggcagtgggatggaatgaagctaagagcaagtttaatagtataagtttaatagtatagctaactactagctctaaatcatctatagccaatataatagccaattcatataataattgtttactacactattaatacataatcccaactggcatatacacattacgtcttggaatccgtgctgcagctggttacatatctatagtctgctgctcttttctcttttttttatctctttaaaatatgtttataactgatttatagtctattattgtgcctgctctaaatagtggagtagctcgaattaacacggtagctagcttcgggaatcgggctaaaaaaggatgcttcctccttcaaaattgtaagtatttttaatatgaacataaattttaaggaaataggtataaataattgaaggaaagattatggttgattgagaaaaaaattgttgaataaattaattgaagaatattaatgattagttgagaaaatatggtaggtaaaaaagtaactcattttaggataagatactgcggaagtagtacaagcctccttggcaagttggcaacatgcatgcaatgctgccatagcccgtaggtagcgtccgtttcattgtctgaatcgtctgaaagaggaaaaaggaggaataatgcaagttggtcgagagtattctcatggaaaccaccccaagccacgatccctggatcaacatgatagctactactagcatttagtcaagtgtaattatttgaacctctttcgattcaaaacaatcgtattaggccatgtacaaaggtaaataatgggggtgaattttgcctgacattgatgatgagtgaaataagaaaaacaagatttgtttctacgtaaagaaatgtgccttgcacacactacataatactccgtccgtattttaatgtatgacgctgttgactttttgataaacgtttgacctttcgtcttattcaaaaaatttatgtaattatcatttattttattgtgacttcatttatcatcaaatattttttaagtatgacataagtatttttatatttgcacaaaaaaaattgaataagacgaatggttaaacgttggttaaaaagtcaacgtcgtcatacattaaaataagaaataaggagggagtatatagtactccctcttatgtttaatatttaacgtcattaaattttaaaatatatgtgtaatattattttcgttgtgatttgttttttcactaaatgtacttttaagtatgactcgtatttttacatatttgcacaaaattattaaataacacgattacatgaatagttaaaggtacattcaaaagtcaactacgtcaaatattaaaagctgaagggagcatgatatttgtagctcctagttgttgcctattattaaatgatgtattaggctgtgtgtgtttcttatttttcgtaacctccactctcccgcaagcacgttttataaactgttaaacggtgtgtattttacaattttttttctataaaaaagttgttcaagtcgctttattttacatgtacaagggattaatgcccaaccctaagagctaaacatagccttatatatgctcaatctgtccttatcaaggctattgatcctatgggattagcagagtttacgcacgagaggaaccacgattgaggtctcttgacttcaggatactctagattcatggtatttgctataacattattcggttgtggtgtattgtcaagcacgctattgtttaaaaaaaaagagaccctattccaataccatcttccaatagagacatatataactttgaaaaaaagattgactattcgtatgaattgaattcaaacaaataatagctaatatttaaatttttttgcaaattcaaaagttgtcccaaattgtctaaatgacaattgcaaaaaaaaaaagataaaataaaatttataccaatattttctggatttaaataactgttttttatttccggtatttgggaaaatttttaatttgcataaaatgtttaaagtcagccaaaattttgaaatttaaagcttgcaagttgtccaaaggtaaaaccttttttaaaagattttatctctctatataaattaattatcggagtgtcttttgacagataaccgtataaccagagtatcttagggtaaagctgtaaaaagtaggttttatagagcaaatgcctcaaagtgtcatggagcaaatttttttattttatttacagtcctcgcaaattacttctataacttttttagtggtctattcattttgttaaacagtgtatatatcatggttatggataccacatacccaatagtaatcgactaaactcggcggggcccattatatacagtcttatatggaattattactcgtatatagaaggagttccagataagtaaggacaagtagagttctatatgaaaactatatggactactcaaattgtatccatattggtatttgtagttatgtttggacaatgggacatctatgggtataaatacaagaccccctaaagaagggggaggagacccacacaagccaagacaaagccagatattgacatcagagattagcctagacagatccaatctgtggcctgtgaagaccaacaagagggatctagtgcaatctctcatcgtgacgagtttatattcaaggaggaagactaccccgtcgacgactacgtgttggtgttcgtgccaccatatcgacgacggctagatagacaatcccaaatattgtacttgtgtgattctgataaatatagagtaactgtaacaccctgaaaattcgaccgacaaaatcgaaaccctaaaaatacggatctttaaaaactttttaaataaattgcatcatgccggttttattcgcctattttatttggatttgatttcggagttcattgatcgtgagtaaagaataatcaattaggaataaaccctaaaaataaattggcaaaataaataattgaaatataatttaaaataaagattaggcgagatagaaataaatagaatattaccgcgaccatattggtaataattaaatttaagtgcgatggaataagaattagccctaattaaaattcaaataaattatataaaaataaaatatgggtaatattaatccagggtgaatccattggttgaaataacacaaatattgagtaaacttaatttgtgcaaaaattaggatttatagaataaaatttatatagggaataggctaaattagggttaaataggagctagcactgttcattgcgcagtaggtgctcgacgaggtttcctagccatgccccctcctctgccgcgcgcgcctcgcgccccgagccgccgcgcgccgtcgccatcgccgctgccgcgccggcccgacgtcccgtcgcgcgcctgccgactcgcgccccgcgcccctgccccatgcccgtcgccctcgcgccccgcgcaccgatcgccgtcgcatcgccgcccttcgccctcgcgcctacacgccgccgcgcggccgtctcgtcgccgtcgcactcgcgccgctgccgggccacacgtcccgtcgcgccgagccccgtgccaccgcgcgcgtagcatcgttgctgccgcccgcccatcgcgtcgccgccccgagccccgcgccgtgcatcgccgcgcgtcgccgtcaccccgagccccgtgcacagccatcgtgtcgccattaagccggccaccccctctccttcttccccctctcccctataaatacccccaccccattcccctcttttctcctctcttcctctccactgcgccgccgccctcgtgtgccgccgcgccgcgccatgcgtgccccgccttgcgtcgccgttgccgccgccgtcgtcagtaagccgccgctcccccccctgtttggtcgctgttgccgctcgggtaggcagaaaaaccaaaagggaaggaagaagccgggagggagagaaaaagaaagaaactacaacagggtataagagagtaatgtataaagaaaagaagagagaaaaagaaaagggaaaattaattaaaaaattagagagagattaaggaggtttagaaaatttaaaataattagaatttaattgtagattattgttagccgtagaattgcaaagttttatataatcgtagattattttggagattcttaggagtaatcgattcgcgttcgacttttatttgagtttatttggattttatttgaattctaattgaattcaaatcatttcttcgtacgtaattttagagcccgagggagttgtggatccgagcaaggatcaagacccgcaagactacgagcaaggcaagtcatcactattctttgaacatgttgatcccaattgcgaaattattttgtttacaaataaaattgcatgcaatgatgaacatcccacttgtgattatgccatgccttgattattgtttacccttaaatatttgtaaccatgtttatgtatgagtccctagtcaattatgacaattgcttagaaatgctattctagaatcatgcatactcatatttatcaaatgctatatgcctgggcaattacctttgggaaggtaattgagatgcggcatatggagacatgagcgccacattgccatgatagtgatgacatgatttggtgaaaggaaaataaaatgaaacaactattttcaactggggcggatgtaggatttgggtggtgtctggaaaaggctagtgccgtccctggtcagttaaggaccgagccatgaggttaagcatgaaacgacccccgtacaaccacacttctcgtatgggtatagacctagcggagtagatagatgagcggaggcagtatccatgcatagtggtttcttgatatgtgaggcaggggctctacggtggggcagcctttggtaggaccgcgaggcgggtgcctacagtggtgtcgccatcggtaggactgccatgtgagaatctaaacataattataccttaatgcatgtgtgagtcttcctttcccgggtgcgccagaactcctctcactgctagaaatcgtattccgcctagagtgcatgaggatgtaaagtttatggagtgggtactgccaatgcgaggttatcaaaaagctttgccgtgacgcgtctcatgtgttgggacgaggctcatgtgttgggcagtcgcggagtgcggataaagtgtacatccactgcagtgtgagtaaaccaaatctattcgaatagccgtgctcgcggttattgagcaccgagacatgtattacacttggctagactctaaattcttaatttgtgtgggatggaatattgcatgatgatttttatgctgatggagccacttcctgagaggagggaaggtggtcgtcctcagaaaaccatgacgactcaatggcgggaagctatccttgggatcacaatggatggtggacagaaccgtcgttctttgatatgaacactggtactaaaaatttgatcagtcatgctaggtcttaggcttgtgaaaagaattacaaaacttactttgcgcaaaagaaccatagccatcccttgaataccccctatcatgtgcattgttgctgtggtggcttgctgagtacggttggtactcacccttgcaatatacaaacttaatcagaggtcgaagatgaagcttcggaggatccctacgcttactaccaagagggtgatgaagacgatggcgctcagtaggtcttagttatggtcgttgcctatggcaacggcgtgccgctgccttaactccgctgccttatctacttctgcttttggaatgtattccggaccattcggtcctatgttctaagactatgcctgcaagcctatgatgtaataatgcgcactagaccctcgtgtatgtgcacttggtatttcagctatgaactcgtgtgtaccagactacttgatccagggaaatggtactatttacacgattgattcctgttataaaaacgggggtccacagtaacaccggtgtcacgcccggaatttctatccaaaattccaaacgcttacatgtgtgtgaaccctcgtccaggagtcagccgaggcacacaataacaaattgataatagagtacaattattactctaattaataggcgaataaaatgtcattacagaggtagatagttcctctcaatcaataaagatctaagcagcggaaaaataagataaacggcgcagacggctccactccacaggcagcttgaccagggctacacctaatcctccacaccatcagcgtcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgtataggcccaaccattctgaacaaccatacccggctgtacagatctatctccaaaccaggaatatacaattccaaaccaggagctaaacaaattattaccagttatagcatcttttatcatgatgagaggtgtgagactaatcacgaaagacattgttagacccgcccataaccgcgggcacggctattcgaatagttttactctggctagaggtgtaccactgtacccacaagacacagccccacaacatgtcaccatgtgcctcaataccaccacggtacctcggaaaggagctgtgacaatacccctcgcacaacacaatccaccacagggcaccttttctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattgattaacctaatcacgattgaccatcgtgaactatcattaagccatcattaaataatagtgagtcataagttatcccaatagtgtgctaatgtttctaagcatggctaagcaatcatatctaatatctagctgaaccaatatatatatagcccaactagtcaagttataataacccaaggtatcaaggaataaagtaatcaagaacaaaagggctataacaaacaataggttaattccatccaatgacattcgaaaataaatgcaatagttgaatagaaatagtagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatctgagctaagatgaattagttatgaatttttaaagattaaatcggattaaaacacttatatggattttaattgaattatgacgccataatgaattacttttgaaaaggaaaaaggaattattgcgtcaacggctagggtttgcggtggaccgggcgcacggcggcggttcacgggaacgaacggccgagatcgatcttatccaaaacgaacggccgagatcaagcggtccacgaccggatcacgacgggcggccacgatgacgtcagcggtgacgtcacctccggcggcggctcggcggctcgggcgcgcatgctcgccggcgaacgacggcgcgaggacgcgaacggagggcaccagcacgtagaacgcgacgcggcgaactcaccgatgaccaaaacggcggtggaagatgaacggacgacggcggcgtcgaggaaaaggcggcggagtccttcggtttgacgacgacggcggtgctccggcggtcaacagcgacggcgaaggggcggacgaggacggcgacgcgacggcgaccacgatggcggtcttcccgagtgacggcgacgactggagcgacggcggcgcacggctggagcggcggcgacgacggcggcgctaggtcacacggcgctagggctcttccgacggcgagagacgaaggcgagggtggcgacgggtagcggcgggcttggggatccttttataggggcaaggaggcggcggcgaaggcccacggcgaccggcgacaagaaggaaagattagggttcggaggaaagggttcgatccgaatcaaactcgaatccacggatttccaaacgaaattagccgacgattccaaaagagaaaaggtagaggagatcccgaagatcatttcccctctattgatttcaccggagaaggaaagacgcggccgaatttggaaggagacggcggcacggcttggctaggttcgggcggcggccgacgcgaggaagacgacgaccccgacaggcgggccccacctgtcagcgacgggaacgcgcgcgcgcgggcgggcgctcggcttgggccgacctgggccgagagagagagaaggttttgggccgactttcggcccaaagccaaaagagacttttaaaatcctttttcaatttaaattattcatgaaatgcaatttcatttattaaaaatacttccttagctcaaataaatcccagaaaaatctaggaattatagaattaagcaaagtatttaatgaaattttatctagccccattttatattggaatttattaattaaaaattagatcttctcttctaggcttttaaaatcaattttaataattccaattaaacaacaatttatatatttaggatttttagggtgtgacaaccggctatgaccaacaagaatagggctattacctgtcagataaggggcccgaacctgtataaaaacccttgtctccatctcttttacctcaatttcgcatataccctggtaccgacgatctccatatataccatgcaaataccgtagtcgtcacctcaaacgtcgacagtggcacgcctggtagggagattttggtgcttcaatgtttcgacgagatggattctccgacaacctctggaagtgtttgtatatgcaatatttgtccgttgatcctattttcttatatcgccctatcttgaagtcaatcctattgtccatttgcgctattctgaatgcgtattaactaagtcgtgtaatcgggaattggtttcccaacttcacggctaggagctaggatttcgtcagctttagcttggtttgttataagatttaagctacctttgccgaaaaaccatttttccataaaaatagctagggctaggaagagtaccagactctaattgctgagggcagctttagcgagagtactcttttattgccatgtgcagattcaatttatttttaatttttaaattcatattatattatgttacccttgagcatttgcttctgggctatttgtatataacaatttgttctaggtattgatttcaggaaaatcatattttagggctttgtcacagattctacaactactcgactactcgagaacggttgaacgattactcgagaacagttggacaactactcgattactcgagaacagatggtggagtttgacaaggattatggaatgaagtgatggtgtatccaccgagatgaaaattcttgacttcaacccaaattctcgattacggcaagacagaaaatttagtagtatactccgtaccttctcagtcgtccgagaacggttaagcaagcacgacattgttattccaaggtcttcgatcgataagatcaactcgttcatttgcgttgatttcaggctcgtttctggcagttgtttagacttcaatttaaatacacttgtgcaccgttgatctttttcagagatgttgagtactccatgtcttctcgaatgttatcgagaacgaccaagtcagcatgacaatgtgaattcattttagttgaagttgggggctattgtcctggttatggacaccacatacccaatggtaatcgactaacctcggcaggacccatcatataccaagtcttatacagaatcatacctcgtatatagaaggagttccagataaggaaggacaagtagagttctatatggaaactacatggaccactcggattgtatccatattggtctctctagttctacttggacaaggggacatctatggatataaatacaagaccctctaggaggagaaggaggagaccaacacaagccaagacaagccagacgtcgacatcaaagattagcctagacagacccaatctagtgcctacagaggccaataagagagatctagtgcaatctctgatctcggcgagtttatattcgaggaggaagactaccacgtcgtcgaccacgtattggtgttcataccgccatgtcaacgacggctagatagacaatcccaaatattgtacttttgtgattctgatgaatatagagtaacaccagctacggccaataggagtagggctattacctgtcagataaggggcccgaacctgtataaaaaccttgtctccatttcttttacctcaatcccgtatatatcttgatatcgatgatctccacaccatgcaaatactattgtcgtgacctcaaacgtctgacagtatatacatcgattcatttcataggacaaattaaatataaagtacgcaataaagatatatttatgcttctatatttggattcttttcattttgcaatggaactcatttaattgtgcatagacagtagatgaagcacagtgcacctgatgtatacaccacgtgcgagcttcagctgcaggatacaacaaagttgtggcatatgtcatagtttttcaattcaaaggcctatatattatacatttatcttttagccaaaccttacttaaggtgtgaccaatcaatttatgagccacgcatctagccatgtttggcatgtgaaccaaacaattaggctgagtacgagttcgggaggcaaggttcccaaccctgtttcctagcacgaaaaataaagcaaatgagcgagattaattaagtattagtaaaaaaacttgaaaaatagattaatatgattttctaaattaatttttctatagaaaacttaaaaaaaacacattgtttagcagattaaaaacgtgtgtgcgatgagggatgtgggttggagaaggggaagaatatatagtctttgatggggcaagaaaaacaactagcgggatctgtgagtccatgtcgccaagttccagcgcacgaatctccgtaacaagagaccaagaccacataagagcaaggataatagtatagctcacttcttactattagctcattttaaaaccaacatatataatagattagctataacgttagctataattttattttcctctctctatctctcacttatacatttaatgcatttatcttggagattgtgttaagctagcttttacatgagagccaacccctttaatttttttctacctctcttctccacataaacttataagcttatagtagacttatagctcgctattattatacttgctctaaaaggctccgtcgcgaccgacgacggccgggggtgggcggacgaacgatcaacgcggcatcaactttggccacttggcggtcagctctctcgatcggtcatgatgagtggatcgagcaaggcacgccacagcacccgtcacgggggctgacatgacatatgcatatatgctcacctgtctatatgatcgacgatcgagatcagcacccgcgaaaacggtggtgttcgccacaaaccgtgggcggtagctcggcgggctcggccccagactccctggcaggcaggcaatataataccggataacggggtagaagagttctgtttattagtttgaaaaagtacaccgaaggtccctcaacttgttattgggataaaaaacgttctcgaaccacaaaaccagatatgcggggtcccttaactatacaaaatcggtcaaccgaggttctttggtggttttgaccccggtttggtttacatggcggctg

SEQ ID NO: 8057 - DNA, 1516 bp, Oryza sativa
cggcccgtcacaggtatcccctcacctgtgacgggccgaaaggaaaacccgtcagaggtataccagtgacgagttttgcttccaacccgtcactggtatcccctcacctgtgacggctttcatttctggcccgtcacaggtgagcggataccagtgacgggccgttgaatagaagcccgtcaaaggtatgagcaatacctttgacgggctttttttatctaacccgtttgaggtgtgttggatctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtaggggctgtaagaatgaacagatgatcgaagacaaggatgaagtgcatgctcatttgataatgaatggattcatgaagaaatatacctgctggaccaagcatgaagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaaaattgccagataccgttgtatgatggatgcaagtcgaagcacagcaagttgtcatgcgtgttggaactcatgaagcttaaggctagtaatggctggtcggacaagagttttacagaactccttgaactgttaaaggatctgttgccagaggggaacaatttacctcagacgacatatgaagcgaagcaagtattatgtccgttgggcctggaggtcaaaagaattcatgcatgtccgaacgactgcattttgtattacaaggaatacgctgacttggatgtctgccctatctgtggggcatcaagatacaaacgagcaaagagtgaaggtgaaagaagtaagtcaaagaggggaggcccagcaaaggtggtgtggtatctcccaattgcggagcgcatgaagagaatgtttgcgaacaaggaacaagctaagcttgtgcgctggcatgccaaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataacctt

SEQ ID NO: 8058 - DNA, 20141 bp, Oryza sativa
tgaatgaagaccgagccgattgacttatcaccggccgataaatataaccaaaaaggtattcctttctgtggaggaatcaaaactggaggggaactcaaatattccttaatattatccaaagccttctgttgttctgccccccaagtagattgctgatcggccttcaatctcaataatggtgtaaaaggttctaaccttccagacaaattagaaataaaccttcgaacaaaattaattttgccgatcatctcctgcaattctgtcttgtcctccggaggtttaatcatcttgatcacattgatacttctctgagttatttcaatccccctctcatgaacaagaaatcccaagaactggccagccgatacgccaaaagcacactttgtcggattcatcttcaagccatatttcctggtcctctcgaaaacctttcttaaatcggcaatgtggtcttctatttctttagacttaacaaccacatcatcaatgtagacttcaaccaaccagctgattaaatcatgatatatataattcatagctctttggtacgtagctccagcactctttaagccgaaagtcattacaacccactcaaacaagccgattgcactaggacacctgaaagccgtcttatggatatcttcttcagccataaagatttgattatatcccacatttccatccataaaacttaatatcttatatcctgaagcagcatcaaccaactgatcggccactggcattggatattcgtcctttggagtagctttattcaaatctctaaaatcaatgcacaccctctccttgccgttcttcttgataacaggaactatgctagaaacccattcggcatatcggcaacgacgaataaaactagcatcatataagcacttaatctcagccttgacaggttcgagcatgtcagctttgcatctcctaggaggttgttgatgtggcctaacccctggttcggtaggtagccgatgttcaacaatcgatcggctgagtccaggcatctcataatattgccaagcgaagcaatccctaaattctttcaagagctctatcagcttggttctaaactctgaagataaattctgactaataaatgtcggcctcggccgatcgcctggacctatatctatgtcttccaaatcatcggccgacataaaaccttgaccttgcttgtcatcgagatcatctactgtgtccttggtgtagacgtttgaaccctccacgatgccctcaaagtaatagcttgggttctccatcttcaattggctgtatatcagaatcggacacttttagaaaatctccatcccaaactttgccggataaacaatcaaggccgtccatctcccaaagagctaaattggcactagcaacattgactgacctgtcggctggcacgatttctatcttgtcgccttgccattggatcaagcattgatgcatggttgaaggaatacaacaattggcatgaacccaatcccttccaagcaacaaactgtaagaacccttcccatcgatgacaaaaaacgtagtaggaatagtcttaccgccgactgtcagctccacatttagaacacccttggtttctgatggattgccaccaaagtctttgagtaccatgtttgttttgatgagatcttcggcgtttctacccaacttcctgaacgtagcataaagcatcaaatttaatgcagctccaccatcgaccatcatcttagacatcggcttcccattaacatagtcatttatatacaatggtttaagatgccgattctctgcaccctcgggctttttaaagactgcttgttctggtgatagaatcaatttagcctattcttcttctgtttcctcaacatcggcttggtcgatcctaaattcggctggcaaggtaaaaaccatgttaaccgacgcaatcacaatgcctttccctttggccaatctctttgcttcatcggctacaggagcttgtttcttaacgcgccattcctgcttcggctttgttttctttagccgttgattgatctcttgctcgacctcctgcaagcgttctcagtttctcaatctttgaacccttctcttctgattctttgtaaatatgccaggaggacaccattgagtcttcctgttttcatcatcctccgggtcatgatcctgatttaccgggcccaatctttgatgaacaggaacccttgcatgcttcagtcgattgcccttaatatacgaccggcttgaactctctgcaacgttaccgcatccaggatagtcttcaatatatggcagcctcataccctcattccaacaaaatctaaagaactcacaaccccaatgaggatcgaaaccatcatcaccttcctcgtaatgcttctcctgttgtttattatacttcctttggtacttattgatgatcttagccgaattcatttgaaaaccccttgcacggcccccatcggctgtttggccagctgtatgaaccatatttacgggaaaaggattaccatcaaccttcatcggcttcttggaatcatcaaatttgattttgcctccttcgatagccgattggatctgctgcctaaagaccttgccatcattggtagtatgagatccagaattgtgccacttgcaataccttttcttgcctaattcctcagccgatggaatagtatgaccagcagggagctgaatttgcatttcccagagtaatagatcaaaaatcttgtcagccttggtaatatcaaaatcatacctctcttcttttccagaattcttcacccattggcatggcataacctttttgctccttacccactcggctgcagctatctcagaatcatcatcctcatcgtccgatccacacatataagaacagacatgattaaccttcctagaattcctcctagcttcagcaaacctctgctcgtgcaaagttaccttttgtgtaagatgcggtaagctttcaaagtcttcagacgagaatttctccctgatcggagcaatcataccctgaaaagccaaatcggctatctgggcatcagttaagctcaagctaatgaacttattcctcatctctctgaacctctgaatatattcatgcacgggctcgtcgtgtctttgcttgattgctgtcaaattgtacaacttcatctcatgtaccccactatagaaatagctatgaaactgcttctccagatcggcccagctgttaatcaacccatagggtaaagcagaaaaccaagtaaaagccgatccagccaaagacaaccggaacaacctaaccctcaaggcatccacagccgatgcttcaccacactgagctaaaaatcggctaatatgctcataagtcgatgtactatcttgccccgagaattttgaaaaatctggaactttgaaccggttagggagagggactctctcaaacccttcaggatacggttgtcagtataaatttccagtctcttttggtttaagcccgaactgttccctcatcacgtcagcaattacatcggcccacggtcgttgttgagctgctccttgcgattgttgctgcatgggctcgaattgactgtactgaggagcaaattgaggctgaattaatcccccttgctgatattggtcttgcggggaaggaggttgatattgataacttaaattgcccccctggtaattctgctagtttggctgaatatttcgtaccaagtgctcagggacaatctgaggtactaccgtatgatccagctgcacgtgatggaccaaatgctctggaacaacctgattcagagtatgttgcccagccgatggattcatcaagccttgctggtgaatcggttggatagtctgctgtcttgatggcgtctgctgaatcggatgtacaatctgctgccttggtggcgtttgttcaactgactgcacaacctgttgctgaattggttgtacgacctgttggattgggggtgtttgttgaatcggctgctgctggactagatcaacagtaggttgaagtggtagaaacatggtagcaacctgatcctgcgttagccgattcgcaacctgcccactatgctgtgggttctctctcatcaactgccgaggattaaccagctgacctggtgccgacattgacggagtagatggggaaatcgataccggcgccgtcggctaggctgatgatgcaatgggaggaaccgcttgaataggtggatgaatatcggtgaccaaaggccgataattcggaaaggtacctcctggcaaataaactgggcctgcagcctgatgtttagctattgaaccatcggctattgacttcatcatgtttgacaaggtattgactaataccccagattgattgatgaaagcattgtgcacagcatagtcaacccggtcttgaaaattattgaaaaattcctgtgacccactgccatcttgataaaaacttcctcctcgtggcccctgagggccatcaccttgaactccatgtactccttgagagtggtcaccctgattctcctgagccgatccatttgtagcaccttttgttgctcggttgagccgagccacctaaggcttgtttcatctccccatccttggaagaaccggtcccggggacatcagccactactcgcacctgatacttttgcaccactgttcccttgcgggtctgcatgaatgagttcaagaactggttccgtgcttgctgcatcattgcttcaaactccttctgatcaggtgtcaatttgtccagagtgatggtcatgacgttgccctcattaacctcagataggtctaattgctggatcttctctttaacagaacctgggctagccgaagacggcgatggtggcggcttctcggccatgaggaaaactgctttctgacttctaatcagtcccaatgggcgtgccaaaagcgtgttgacagaaaacacgaggcctgggagatctgcttaactccagtgcaggtccagaactcgccttcggatatgtgagcgtgccagttgatttgatcctacaatgaacaagaaacgaagacaaacaaaccgtaattaaatatataaatgatagccgatcggctgggtacagatgacaaatcatttattttatgccgatgtcatgtgtgcatcgatcggcagtcatgaataattaaggaagaactaaacctacttgatcggctgtagacattaacaatatataattcttatgtcgatatatacttaaatcaagtgattggttaaatcacttagatcgaaatataaatcaacaacaaaactatatacgttaatagcgtagtcgattaaatagatctagcatgtattggctaatactccgataccactttatattaagatattaaagcaaatagaatatatcagacagaagcataatatacttaaatgcaacaagatcttaacataaagggcagatttaacatgtcaatcaaacatataggataactatagttaaatcaggtaagatcggctaaaactccgatgctatactaatcggcaaccaggaagcaagctagagattgatattctaagcacgacttgatagatcaaactcaactgatgcagcattaagtatgaaaagaagaacaatatctagacaatcaagccgctggatgtttcatagagtggtaagtatcttgtacaatcctagctaacaccgctatttaacctaatcggctgccttctactaacagatgttagccgattgtaggttagatgactatattaccgaagaatatacaagatatatgataacttgacgaattacataaacaagattagagtatcatagagatggaagcactaatcccgagaacacaagcagccataacaagttttacctcttgttgaagattgaaaccgatgcagctcaacccgaaagcaagaactcgttgaaacaaaatgaaagtaaaagggtggcgatgcgccaaaattgtattgaatgtgtgtgttagattaattacatggagctaggggtctatttatacccgagtattacaagatatgtccataccggacacgactattatctctaacaaactctaagataccacaagtctttgcggcagacttttgcccacatttatctctaaggactttgcataaaatatcctaattaatagatacaattgccttttcaggactttatccatgcgtggcaatcatcttgaagcatatcaactccacccgctgatgtacaccgagtcgtattcttggaatcggttgtatcggctagccctgtctgactcgaactctgccgatcctgaccgtagccgatccagactctacccgattcttactctgttttcgcgacagcccttatcttcgattccgcttctgtcgaggagtgatcctctctagcgggagatcgtgggatccccctttcgtgagttcgaccgggggaaaaggcccgcctctgaaaatcacgtatccgcccactagactaccaggtagtgtgcacacaacaagattatacaggttcgggccgcaaaggagcgtaataccctactgctgtgtatgggatttaggcacaagttacaaaggtccctaagccctggagattgcccttacttcctttctcattgagctcaggttttttcccttggtcccccccttttcggtgggaaggtcctccttttatacctcaaggggaaaccacatgcaccgactctactattcttctctcgggtgggggggagcccacccttccttgaccggatcttgacccgtgccttcgcctggaagctaagccacggtttgtccttgagtggggttcagcgccgtcccttgcctaacacgggggacacccctgtcaatcccccattaatggatgaagaattgtggtggccgtcctctcatggggaggacctcgaatgacccttccgatgggacgggtcatacctacctccactctgccggaggtagatgtgacgtgggggcacatctgtccgtccagtcaaatgtgaccggtgacaggccggtcacagatcagatgtgaccgacgacgggatgtgtgagcgcaagcccccccatcgagagtggcgacagttccctgaggtacctggaactccagaccctcgctgtcatcgccatcgtcggcgggggccttcttcttagactcctctcgctgatcattggctggggtcgtgagggctttgccctcccgtcgactctgccgcttctcctcatcggcttttcgaaaccgctcggccaagttcttgaccgagcggcagtcggcaagactgtgccgataagtattgtgcaccgagcaccacttgtccgcggaccgacccttaccagaaggggcggtatagctcgtcttgccgtcggtggccctttccctgcgcggggcccgcgagggcccatcagccgcaaggacgtggccctcgtcatcagagcgggctggcttccgcttgccccttctgtcccgccgcttggagcggggggcagtctcgggggcggccgctgccgccgcaccggtgctgggggagttccaagcccacgcctcctccttctgagccaccttgtccgctagctcgaagagctcagcggtggtcttaggctccttggaggcgatcttctccagcttgcggttgtgccgcacgccgttccaaaatgcataaacgaccgcgtgggctgggatgcatggaataatgttgcggacctagcagaagcgctgtatgtatgagcggagggactcgtcgtacttttgctgcacagcgtgtaggtccgcctcctcccccagacgggggtatgtgccctggaagtttgtgataaactgctggcacaggtcctcccaggagtggatggagtcggggggctaggtcataagccatccacgcgcctgacccttaagagccatggggaaataattcgccatgacccggtcatcccctcccgccgccacaatgattgtggtatagatctggaggaactcggagggattgatgctgccattatatttctctgtgaggttgaggcaaaactttgggggccaccggacgttccggagactcgccacgaaggccttgtaaccagttccccctggggtggacgtgaggggcgggccgccgcgcgaggagaaacgcggcactccagacgaggaggcgccttctcccatgcgggtagcgcggcgctcgtctcgtcgacgctcaatgttgactcgagcgtcctgctccccgtataggctatcgtgacgcctccgactttccgaggcccctgacgacgttggggccgtagatcgccttgaggctgtggctatccgacgggccctcctccttgctgacgaggagagggtggtggaggtacgtgatgtacctgtggcggtggaacggccacttacggccaaccgccgctgggcagtggtgaccaagttggcgacgtcgtccaaccatcgttggacgggggcctccggctccacgttcaccggggggtgccgcaggagggctccccctgcctaaagcgcgccctggggcgagctgccgtcccggtaggtcaggcagcggcgcgctcggacgtgccatggcctccccccatccagaggcggggagagggccgagccacccgatcaggcgtgaacctccctccgcagggggtcggagaggggcggagtccgcgagccgcgtcggcggtgacgcgggttgcgactcccgctggcaccttcactcctggaaggagtaagggtctgcacctccacctcttcctctaaaacctccaccatgatcgttggggccggaggaaggcttggagcggaaggaaacgacttctcttcgaagcgcgcgaaatccccctacctggcgcgccagctgtcgaggaatgatcctctctagcgggagatcgtgggatccccctttcgtgagttcggccgggggaaaaggcccgcctctggaaatcacgtatccgtcccctagactaccagctaatgtgcacacaacaagattatacaggttcgtgctgctaaggagcgtaataccctactgctgtgtatgggatttaggctcaagttacaaaggtccctaagccccagagagtgcccttacttcctttctccttgagctcaggttttttctcttggtcccccccttttcggtgggcaaggtcctccttttatacctcaagggataccacatgcaccgactctactactcttctctcgggtggggggggcccaccctaccttgaccggatctcgacccgtgccttcgcctggaagctaagccacggattgtccttgagtggggttcagcgccgtcccttgcctgacacgggggacacccctgtcaatcccccattaatggatgaagaattgtggtggccatcctctcatggggaggacctcgaatgacccttccgatgggacgggtcatacctacctccactctgccggaggcagatgtgacgtgggggcacagctgtccgtccagtcatatgtgaccggtgacaggccggtcacagactagtcattcctgaccatcgcgcgccagttgggcatgccgcacgtctgcccctaccgcattgaatgcggcagggggcagttggggcgctgcgttcattaaaggaggttcggcttgggccccctccccgcttgctccccccgccagatggcggataggcgagggcccgaggggcacgacgtgacaccccgaggcctcggggcaaaacgggcgagggcccgaggggcacgacgtggcaccccgaggccccctggccgctcctgcgatccgcggggtacgggggtagggccatgctgtaggtcatgcgccaggatgggaaaggtaaattcccctcattccacatacccccgggcccacttcaccgatagcttcgatctaatctccttctccgatgctgatattaccaaatttggttcgttaacatatgtgccttgtatcaatgtatatttaaaaatgtgtcaatcaagctgaatataataagaagcaagatgatctctattattgtactgcaccaatgcatatcgtgtagagatccagtcaaaagtaatcattttttttaaatgaatagacacaaagacggtgctatttcattcattgaatatagcaaaaagaaaaattgcatcctctaagggctgcaaattaaggatctatctaaaccaattcggtttgaagaaaaacaaagaatttagattcctaatgattaactactacaagtgccattcggtttgtaggaatgaggtatagaaaaaccaaagaaatttttttgttttcctccaagttgtagagagaaaactagaaaaattttcatttaatttactctaaactcttgaaaaaatttcctatggattggtgtgtgcatacatttccactccttcacttttcctatttctgtgagtagaaacttctcataggattaggaaaagtggaggaatagaaaagcatgcatacttcaatccgtaagaatttttccatgaggtttatgtggatggaaagtttcctttcttctctctgcaacttgtagaaaaagaaaattttctttgattttctatatctacattcctacgaaccgaatgacattcataggatccttagaaatccaaatcctttgaaattcctcccaaacgaatacaccctaaaccaaacaatccctcagtataaaaggaagaaaaacatgtgactaaacatggttgaactcaagcaagcgcttcactacagcgcacatccacattcttgcgctcgtcgtggcctatctccttctcgaggttttgactcttgacactatagcctataatcccatgtgaatgcaaccatggtcagagttcctttgacatggtagttgtttcaatcttttttctctccatcccaaagtgatggtggcagctaatgtttcttggacatataacagccttccagtgcctcatcttcttctctacttcttaataatgataccctggtcagggttgtggaacctttagggtcaagggtattacgcaaccctcctgctacacaaagcagttcaagagggtcccgtaattctacagaaaatattggagacacaaagtttaggggtgagactctctttactattcaatcctccaatcaactgtacaaatgattagccccctcctctctttatatagtgcattccaatatatgaaaggttcgttgatgggcccattaagtgtatttgggccaggccttcatcggccaagcctaaagtttcttaacactcccccttgggcactcaccgcgtgatgtctatgcctcgttaaaactccataaaaacccagtgggaaaaattgcagaaagagtacatagcatacgcatgtatgtcacatagattgccttattaaaaaccttgataagaaactgcaagaaaacttatctaagggaaaaagagtacaatttacccaaattcttgtatcgattttcttaatcgtttttgggtacttgattctttagttcatgcttttgttaatagactggcagaattccccccttgaattttgcatctcttttaagtgtgaaccatcaaaactcgttgctcttatgttttcaaaagatagtccgagtgatgcttcaatggtcaaatcttgcatgatttttccataacttgtagagatcatacaatctattagtgttggtgtgacgcacatatcattatcttcttgataatgattttggggtttgggcaaagctcgaaccatgttacttgctagaaatggtgaactatatccaaggaacctatgtattctcacattctgatattctatggttcacttcttcatgtgttgtaggtttatgagccaaagaaacgtaggtttctacctattttatctcaaacttgttcggaaagagtgagctttctttctttatgcgatgatattaagatcatcaacttggtttgggacttttaatgcttgtatgcgagtgcccaatccaaaatttctttaaccattcattgtcaactacaggtcagctttgcgggttgatcttttagttgattttaaactccaggttgactgccaatgatttgctgtatgaagagaatatttcccatagcaggtctcattaccaattcctattggttgtatgtgacacttatgtgagtatccatcgatatatggggatatgcaattttcttatgcttctattctttgacatgggcatgatcctttcattttaccggcattggtgtgcactccaactgctggttttcttccttgataggaagatgtggtatacatgttctgaggttccataccatttgccagctctgaacaggctccccctcaaattctggggttacttttagtgactatgagcttgaaagttcctttcgtcccattttcaccatacgtctccagttactttagagatttaaggagccggagttcttgtcctatttattttttgaggcatctggacaagatgaggtatacctttgcattcttcggtatttcaccctcctccggtgcattacattcgggtaatgcaacttagtcatgctctccagatcacaaaagtgataggtagttatccaattcttatgtgtgctttccatactttcattcgctggttcttgattaaatgtgcatccatcctttctttgaccatttttcctgacatttatcattttaagggttatttctctccccctaaacgactgaaaataatccttcttattgtcaaggaatttaggataagttcgtacctctgttaaaaatttccattttttttcggtgggagcccttatggttgtgggacatgcacgtgtgtcgagtcaacactagtattcttttaagtggacaacacatttcgaatagtccggttattgatatttcgttgtctttggagctaagagtccattgaagtggcaggaatttcaataatggtgcggtggacatttttagtcctattcttgtggacgtccggtacttagtgcttttcttaatgtgctgatgccaacatgcatgatcttgcaggatcgatttggcaagagcgtagtgtcaattagacacaattgaagcttttcataagtgcagtatgtatcggatgatccattaatgggctaaatatgtatgtgaattcatgtggcatgcgcgaattcattccggtatacctttcaaggtatgtcgaaatttatgtggtggtcgatgtttgacatgcatccgatgttcgatggtatgtgcgaccagagtgaccacgggttatgcagccgatgcaactatggcgcatggtaggagttgcatggcgcgacctaatgtggcatgattcgtccagtcccccagtacagcaaggttgctagttggtgcatcgtacagcatttagtgcacggagctagtagcggccttagtgttcatcatgatgctgtatgatgcatgccaatgtctggtgcaagtctggcgcgaggcgctcaggcagtgcgcgtgacaaatatctcatcgtggcgatacgacagatgatgtgagattgtttgtgctatattcatttgcaagatactaaattctaagaaacactgactatgagatagcctattttagcctacatttcttagtgaggacattgatctcgcatgcttaggtgatgagtatgcttctctcatcttctagttcccacaagggaacttttctgcgagagtttgccattctcaagaaatttgaggtgtaatcgtttttctaccgaaaaacaatatcctttacaatcattgcatgcagttgtgaaggtagttcacgtctttgcatagattgaacttgtctcatgtctctcaatattacactttgtggtgcttttgttccacaatgttcctctttaccttaggctatgcatattgtctatgtgaataaagtaaaatatcactacttcaaggcaagaagtaaaactttatcatatagcaaaatgcaacataatattggaaataaagtctagccatgcaaggcgaatcacgaaataaatgttgtgctctcatagagcttacaaaaccattattcaaaaatgttcataatgcaacttagctcaaaataaaataggagcatcaaatactcaaatggaatcaaccagagtattgagctctgcaaagatctgctcctgggtgacggcctcttcatttgcttcgcctgctgcagctgtaggggcgtcaagtggagggagtagccgcagtgacggcctcacccatgtgtgcttctgcggacgccttgggcttcctgctggcctggtatgcatcgatgacgtgctggggctcctcgcaaatatggctccagtgaccccaattgccacagttgtagcatgtctagtcctgctggccatatgccttgtcattgcgaggtggcttggcttccttcttgcccttgcctccctgtgctccctgggcagctggagcttttccctctgacttctcagctaccttcttcccaccacgcttgcccctcttcctctggacaggcttgcggaccttgtaactgctagcattgacttcaaggccaacactcttgccaggcggttgggagacaaagttcttgcggagaacctcgtcatgagattcagacacctgcatgatgtcgatcatctcgtcatactccttgtatgacgcttgcctgtagttacaagcgctctgcacagtgctagggtggaaggtggagagtgtcttctcgatcttctccgtatccgtgacaaccttgtcgcagagggagaggttagtacagatctggtgcagcgtggagttgtactcggagacgctcttgaagtcggcgaacctcaggcgagcccagtcctgctctgcttggggcaggatggtgtacttcaacttctcgaaccgcttcttgagtatggtccaaagagtgagtgggctccgcaatcccatgtactcattcttgagcgtggcgcaaaggtggtgccgtaggaagtgcagcacccgatcgttctcatcaggggtaggcgctcggtcctgcggggtgcccatcccgatcgtctggcggagcttcttggctccaaggacgatctagacatcggatccccaggtcaggtagttctggccatgctaagctagttcggcgaactccttattcgtgatccctgacattttattgcaaaagtactacaataagatagttgcaactatttcatgctttttccaatatttatattcatagggaatgcgaataaaaagtgcaaaatattaaataaataaatactagagttcatattaaaatgcatacaaatattcatacaaaaagaaaaggtgcaaaagttgcatatattcatataaatactgaaaacgaaaaattaaaaatattcattaacagtaataaatgccttaataaatttaaattcaaattttataagacagaaaatgcttaaatatggaatataagcgacatttgtaaaattcaagggcctatttctaagttttacatgcggggaatggataaaaatgaacgtttccgaaattctacggtcctatgcgcaaaaggtttccacgctgggagttatgcgcgtaatttttagaaaatctaggagcctttctgcaaaatcgccaatctatttccttctttcttcttctttcctgcggggccatgcggggtgcggccggcggcggtgcgcggctgcgcgtggtggcgcgcgcggcagcggcggcgcatgcggcagcgccatgcggggcgcggccgacattgcggcgttgcggtgcgcgcgcgggcgctagaggcgctgtgcggtgggcgtggaatcgggcagcggcgctgtgcggggcgcggctgttggaagctcgcggcagccgcgcgcggcgtgcggcgacgccgggcggggcgcggccggcggcagctcgcggcaatgcgaacggctgctacgacggcgggcggcggtgccgtgcggggcacagccggcggcggctcacggcggtgcggcggcgtggtcggcgtcgcaacgtgatgccatgctgcgtcgtgtctccgatccgtgcttgcattggtgaggttcgtctctgccatgatggatgatgccgagaaaaccccaatcaactagatgccgacgactccacctcggcgacggcggttttcatcgggagttacaaaaacggaacgaggaacatgcaaagatttccttttttctaaattcaatctacaagatgcaaagaggattcacgaagcacttcaagagggtccagtagagcttcgtacccgataacgtattaagcaaccctcatgctacacgaagcagtccaagagggtcacgtaattctacagaaagtggagacataaagtttaggggtgagactctttattatttaatcctccaatcaactgtacaaatgagtagcaacgatggtcagagttcgtttgacatggtagttgtttcaatcttttttctctccatcccaaagtgatggtggcagctaatgtttcttggacatataacagccttccagtgcctcatcttcttctctacttcgtaataatgataccctagtcagggttgtggaacctttagggtcaggggtattacgcaaccctcctgctacacgaagcagtccaagagggtcccgtaattctacagaaaatagaaacacaaagtttaggggtgagactctctttactattcaatcctccaatcaactactctatttttatagtgcattccaatatatgaaaggttcggtgataggcccattaagtgtattttggccagaccctcatggtccaagcccaaagtttcttaacaaggggcacctttgccctgagtaattagtggtttgggccaagggaccagatcatggattgggccttattgctcaactaaaaatggatcatggtgctaatgaaattctatttttgcctatataagtcactcagcctactcaaccaggcgaaatgggcatttcaattttttttcctttccgtggaaaccaggcagaccgttctgtgtatggcgaccaacaggaggaatttcattttgcctctctcaagtatgccacgagttctattaattcatctccctcaaccacaaaagttggtgtagagactatcttaactattaaaaccaaatcaatttgccttcccatacggttttaatgttaagtgtctatacataggaatcgggaaaaaaaaatccagtgagacgttcaacagattcatcacacacttgctatgcacactcatatagtacaaatagttgatacctcacgctttactgcgagatatacgagtgaatgcatgctatacgttataatcaatcaataactcccctaaccgtaccctttttctccgcgtttttaattattttcgggctatctcgttgctttacacatcgctcctcctcctcccggctcctcgcacgtgcctgcgtgcggtcaccagtccaacaattttttgggcgctgtaggggcgtgcgcacgcgtcggtctcgacggcaggttggaaccggtttcattagtaggctattttgtaaaaaaagtctttgcgtttccacaaaatatcgtatacgtccttggactggttcacaacccgttgtgtttgttacgaaaaagccctcctatttcacaaaaatacaatgtgaaaaatagaaaattccgttttaggggtagcgctataaacataaaaaacaaaggggtttttccaaaaaacaaccacatataccccaaaccctaaccacgagttgttccccactccccacatcacggccgccgccccacccacgccctgcgcctcgtgctcggcgccggcgccggcgcgggactccccccacctccgtccgccctcccgcagtcgcctccctcgtcgtccgccctctacccgccgccaccgatgtcatccgtcctccccccgttctccgttgactctccttgcaggccgtgcgacggcgcggctcgtggcctcgtcttcggtgccgcagtagtcagatccggccctcccgcggctggatccagctccgctgccgccggatctggcggccggaggagacggcgcgacggaggaggatgaccgcgataggttcgtacgacgaagcggcggaggccgatgggtgtggcaccatcgtcgccttcatcgtccgccttccctgcgacaccacactcccccccttgttctccccccaccccacccaccgacaacgaggcttgtggcggcggcgcatccggctgtgcacgggcgctgtgccaccgccgcctgtcatctcaatcgggtgcttttttggcccgattgagatggcttccttgtgacggcccactaatttcaggtattttagaggccatcatagatgagaggatctgtactagtataagtatgtttgaataatgtgaaaatgatgtggagataatgatgtggcattgcttgcatattgagttctaaaaatacaacaaaattataaatgatatgtcatatttgcatgatatttgaaatactctagataataattactagtgtgtgtgatgatgtggtagcttgcatgtgattgaaaaatgtaattaatacttaagacttgtagcgagaatcacgtgaaaaaattatttgctcgagcactaatccttagacacatatgagttaatattggttgtgatatctctcctgttacttatatcagttatgaatgttcgtggggtaacatatgacggaataacctatgcactgtcaaatttgctttatattttactactggtgagactatttggtcaaaacgtagttaatatatttataaatttctagataaacgatgagtagccactgttaattatttagaaaaaaaaaagagaaagagagcatgactattctatgtgataattttttaatatcaaatatagtcctaatattttccaacatacgtctagtttattagagaacggatggatgtttgcttgtaataagtataaagattcgagaagagaagtacggtacgtagtatgtacagtacatatttatatgtacatgttagaattgtttttagttttttgcggtgaacagaagtaatacgtatgcatgaatgtttctctcgtacgtagcaattaggtgggacagtcccaatcgtaattaaatcgtaagtacatttttttgttcgtttttttctgcgagtagtaagtatgtatgtttacatacaactattcacggatattttttttattcaggaaggttagctgagatgtattttaaataaatctcatttagtgtccatcaacttaaataaaaatcaagaatttgattttttttcagagtttgtagtaaagtaactcgttaattacagtgccgtttgtagagtacttatgtatatacacgagagatttattttctcaatctagtgaatcactagtggagaaaccgtttgtagtcccggttcgtaaccccctttagtcctggttgtccaaccgggactacgaatccgggactaaagatagcgatctttagttccgggtgaaataaccgggactaaagatcgatctttagtctcggtcggtaacacgaaccgggactaaagttcggtcagatacgtggccggttgattcatctttagtctgtgtaccattttttttatttgcatagccctgtttgctgcatggttgattatatatatatatatatgtattctatatatatgtattgtatatatatatatatatcacaatacatatatatagaatacatatatatatatatatgtatctgtgtatgtgtatatgtataaatacatatattacacacatatttataatttaaagcacttaacattttatgtgtatatatgttaccaaaatatatattaacactaaagtaaatgtacgtacatatataaatatatatatataaatgcatgtatagtacaatttatttgctcgctagctatagctacgacttcgacgccagcgttacgtcagaagaggaaggaccgacgttatggattgtcgatccgtcgtagtagaattcaccatcgggaataaggtcttcttcgttgatgaaccccatcagttgttcttgaacagccgtgataaaatccttgtatgggagatttttcctcatgtgaatacgctatcattcgaaaaataatgacatatcaatatatgaaattaatatacaacttaacaaatcgatacgcaatgaaatcttgaatggtttatgtatacatacatcgagctctcgtgtggtgtatatttggtttgataggcagtgggcaatactcgcatacgtagtatccgcataagt

SEQ ID NO: 8059 - DNA, 4254 bp, Oryza sativa
aagctataattaattaattattacccgagatcagcataatagcaacaaagtcccgcgactttggaatagatggcattatattacctgtctatcagttggaagaccttgtcaaaaaccttctcctctttattcattgagtcgtatacagtgactctgcatgcgtccaagtcaaaaaagaactggacccagtggaatatggaatatgcgtgagatgagataaatatcagaatgtacatgttatatgtatgggaatgaaatttgttcgaacgacaataaaaactcactctgtgttgtacggcaatagtatgaacgtcttgaaatgctgttgcgttaggagatggacgagattgtcctctgtgtctttctcgtacttgtcgagcatttcggtgttgattttccgagggtcaatgaacccagtatcgtaaaccccccgccgtcaggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtccagatgataccgatcgaagacatccttgaaatggatccttagaacatcttctccttccaagaagtcggggtttctgatcctcgctccgaacatctctctacccttggcgctcatttccatgtaccgttcatggaatttgtacatttgtgttggtagggactgcagctgctcaggcctgacaagcggtttaccgagttcaaacttgtatgccacttccgccttcgggattggtgcgcctccaaccaactgagcaacagttagaccggtgtccgaaatgaaatacgttatgccaaagtcttcgccggtcgccaacggctcgaccacttggtttggttgttctccaagctgaggaactggtttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaagccggaggagatggtgcacgagacgccgcttgtcgcccagggaggatgatgtaccgcttgcgctatagtataatggcgtgccttgtgtctcgtagatgcgtctcaccatctcctcctaggtagtccaactcgaggtcctcgtacacggcttccaccagctcaacttcgaccctcgagtatcctgctggaatcggcctgcagtggtaagtccctgaaatgtccgttgggatggccattcccgacgccaccttcacgtgatgagaggttatctattagtaatcaacctaagcagcaacttgcggaacgtacaagtcaaaaatcatatattacatcgaggataccttgattgataagttcttgaagggaatatgcagctcacatggtgtccgttgcgtgatctcatcaacggggcaggtggtttcatcatgggtttgcatggcgtccatgctatgtgatcctacctgccccgttgaggcgcagctgctacgattacctgattggctgaccattggaggaggtatgtacggctagggatcatgtgaccgatgtgctgccatgcgttcatccaccttccgggccacctaatcttgcatgctgagctcgtagctcgataccctgtactcaagatctgcaatcttcgcctcggtatctctcttgctcctcatccgactcctgtacgtgtggatgtcctccttgaatcaaatcttccagggaatcacgccttttactcgtgttcgtcttggatgctcgggaatctgtagggcgagtgacagctcgtccttctctctgtcgggtcggaacgtgcactgagaagaggcttccactatgtccgttagtcgactggcagcctcacgtatctgatcgctgaagaccagggagccatcaactgggttaagcgttccaccgtgagcatagtaccagaacttcgatcgatccggccatttagcggtggccggttcgatacccctctcaatcattcttgcctccatctcctcccacttcagtattgcgacgctatagccacctaaccccaagtggtgatggtacttcttcttggcagcgttttccttgtttttgaccatcatcgcttgcccttgttgccctgtcttgtcagcaacgaactcgtcctaatgatcccttagctttgggaatacgtcgaagttcggtgttagtaccttcaggatgtatttcttgtacagatgtcccttgaagctcttgaactgttctgccattttcttaagagtccactgtttcactatgttctccgtacccgcagggagcgtgaacgtctcgagcattgtggtccacagcttctctttctctgattccgggacaaagctgtcattatccccgcgtgcccttgttctgcgctagtacaccttcctgacaggcacgttatccctcacaacccaaccgctgtgtcgtacaaaattcttggctacttctgccgggacactaggtcggccgtctgcgtccacctcagttatgatgtgccgaccctctatcttcttcgcagcacctcgttgtccgcgtgccctcttctgtccagtggagggatgacttccactagccgcctcctcgttcccctccgcatccctctccacgttgccctcctcgttcccctccgcatccctctccacgttcccctcctcgttcccctctgcatccctctccacgttcccctccttgttcaagtactggttggatcctcgttcccctcttcttcgttccagtactggctgcttccctctgcgattgtatcgtacagtatctatttctcatcacgatcagccatctgttcatagaagaaatatttgctaagcgtaatattaaaactctactaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacactcacatatgctaagtctaattaagttccgtatattaaacatctaataatcttatattaaatctctaacaatctctaacactcacatatgctaagtctaattaagtttcgtatattaaacctctaataatcttatattaaatctctaactatctctaacactcaaatatgctaagtctaataatctaataatcactaacactcacatatgctaactctaataatctaataatcttatattagaaatctaacaatcttatattatatctctaacaatcacatctttacatcacttgcctgcacgaattccttcgagggctagctaccacttcggcttgagggacgacgacgatgacgtcttctctgcaacatgcaaaaaaaatgtattagtctaaacgcaaaggaacatataatgtatttcacgttttcaagtatatataatcatatatatatatatatatatatatatatatatatatatgctaagttcaacaatagtttaattatctcgttcgtacacgtttcgctcgcgttcgttcgcgttcgttcacgttcgttcgcgtttcgttcacgttcgttcgtgttcgttcacgtttcgttcatgttcgttcacgtttcgttcgcgtttcaatcacgttcgtttacgtcgttcgcattcgttcacgtttcgttcgcgttcgttcgcgttcgttcaagttcgtttgcgttcgttcgcgttcgttcacgtttcattcacgttcccctccacatccctctccacgttcccctcctcgttcacgttcgggcggctgtgcgg

SEQ ID NO: 8060 - DNA, 11336 bp, Oryza sativa
gggatgccctaggcagtggcggcgaaggagaagccgatcggaggaaaaacttttaagtgtcggtggagcatacgagggcgcatagggagtatatatacccctagatctttagtcccggttggtcagagcaaccggcagtaaagaaccgggagtcaagatatctttactcccggttgttctcaccaacctggactaaagatatttttccgctatttccaaattctttttaatcccggttagggttaagaaccgggactaaagataatagcactcaatattgaatttagttgcctatgtatttctaaaatagtaaataatgcattaaaattatttaaagtcaaaaaattaatgacaaaaccttcaaaaaattattgttgtctatagtaaattaagtggataatatataataagcacgtgaatgatttaaaattgttaaaaattctaataatcatatataactaacatatgcatgatattaaattgttaaaaattctaattaacctatgtaaataccacatgcatgatttaaaattaataaaaattctaataatcatatataattagcatatgcatgatattaaattgttaaaaattctaattaacatatgtaaatcccacatgcatgatttaaaacttttaaaaattctaataattatatatacctagcatatgcatgatttaaatttgttaataatcatatataactagcatattcaataaatccaaaatagtttacaacaattacggcaatacatcggcggtgacggttgtccgcacgtactttctcctcactattgttccttccttgtgatcgctatgtgagtaaagggtgtcttcatttgataggaggatgctagggtcaatcgtcaccgtgaaagggggttgcccatcaaactgatcgtaatcctcgtcagttttgtcctctactccgacgatttttcttttgcctgggagaaccacgtggcgcttcggctcgtcaggccctttgaccttctttcctttgctagacatgtccttcacgtaaaaaacatgcgttacatcattggcaaggacaaaaggttcgtccgagtatccaaccttgttaaggtcaacatttgtcatcccactgtcatcaatcgttacgcctccaccagtcaacctaacccattggcaccggaacagagggaccttgagaggtccatagtcaagttcccatatctcctcgatggcaccgtaatacgtaccagttgtaccatcgtgtcccatggcatcgatacgaacaacactattctggttcgtgcttttcatgtcttcggctcttgtgtagaatgtgtacccattgatctcatatccctggaatgtcgcgatcgagctagatgaacccctcgccaggaaggccagttgctggttaatcgtctcgttatccatgagatgttgtcgcagccatccggggaaagtatcaatgtgatgccgtgtaatccatgcatcggacttatcgatgtttctcgagcgaactagagccaagtgctcctcgatgtaaggagccaccaatgaagattgttgtaaaaccgtgaaatgggctttacggaataaattgttgtctaccgtcattattgctttccttccgagagtcccctttccccgtagtctcccttcatggcgtgattcaggtaccccaattgggcgaaggtcttcaataaattctacgcagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctctttgactaagtgcaggagcagatgcatcattatattgaaaaatgaaggtggaaatatcaactcaaagctgacaagacattgcaccacatcattctgaagggcttctaacctatccggatcgatgaccctctgcgaaattgcgttcatgaaagaacatagctttgttattgttgcccggacattgtctgggaggataccccttattataactggtagcagttgtgtcatcaacacgtgacagtcatgagactttaggttagtgaacttcttctccttcgtgcttattattcgctttatattcgtggagtatacagatggtaccttgatgctctcaaagcattgaaacaaactttccttctctgccttgctaagagtgtagctggctggactcaagtaatggctgcctttctcctttggttccgggtgaaggtcgccgcgttgttccatatgcttcagatcattacgtgcttccagtgtatcttttgactttccatctacacctaggaagccaaaaaggtttacgcaaaggttcttagtaaggtgcatcacgtcgattgtgtggcggacgtccaagaattcccaatagggtaacacccaaaatattgagttttttttccacatcgccgcatgaccatcttcgcactctataggctggctgccaggcccctttccaaacactactttaagatctttcaccatagcaaacactgttttcccgctgtgatgtttaggcttcgtacggtggtccgtcttatgttcaaagtgcttgcctttcttccatactgggtggtttgcagcaagaaatcgacgataacccatgtacataaccttcctacagtgcttaagatacgtactttctgtttcatccatacagtgagtgcaagccttgtaccccttgtttgactgcccggataagatgctaagtgcaggccaatcgttgatggttacgaacagcagcgctcgtaggttaaactcctcctgtttgtcctcgtcccacatgaggacaccttccttcttccacaacagtttaagatcttcgaccagtggtcttaggaacacatcgatgtcgttaccaggttgcttggggccttgaataataatcggcatcattatgtacttcctcttcatacatagcctaggggggaggctgtagatacacatcgtaacaggccaagtgctatggccgctgctcatctctccaaaacgattcatgccatccgtacttaaaccaaaccgtatgtttcgtgcgtcttttccaaagtctttaaattttctgtcgatgtttcgccactgcgaaccatctacggggtgtctcagcatcccgtcctgttgacgttcttcagcgtgccaacgcatcattctagcattccccttgttcctgaacaaacgccttagccgtggtattatagggaaataccacatcaccttagcaggaattctcttcttcgttagctgcccgtcaacctcacctggatcatctcgtctaatcttgtattgtagtgctttacaaacagggcatgcttctaggttctcgtactcctcaccgcgatataggatacaatcatttggacatgcgtgaatcttctaaacttccagtcctagagggcagactatcttcttagcctcgtacgttgtatcgggcaatttgtttccctccggaagaatgttcttgacaagtttcaataaatcgccaaatgccttgtcactaacaccattttttgccttccattgcaagaactccagagtggtatccaactttttgtgcccctgctcgcaacctgggtataacgatgttctgtggtcctctaatatcttgtccaatttatgggcccccttttcactttcgcagtcctccttggcatcctgcaacatctgaccaagatcatccgcaacatcgttataatcagcatctctatcctcctcgcccgtttgatttccttcaaatccagcgtactgagcaaagtctggaatattgtcgtcttccacttcatcttcttccatttcaagcccttgctctccgtgggatgtccaacaattatagcttggcatgaatcccgactcaaacaagtgaaaatgaatagtcctgaatgcagaatactccttctgattcttacacttattgcatggacaacaaataaaacccttctgcttgttagcttcggccactctcaaaaaataatgcatgccgtcaataaactctttggaccgccggtcagcgtacatccattgccgatccatctacatgaaataaaaaaaaatcgtacacaaataatcattcgtacaataatgatagtcatacaataatgataaaataatcacaaactctttcaacagtcatacaataatgacataccattattcatacaaaaattataaaatattccgttaaataattcttatttattatttttgaagttttaaattcttttaattttcaatttagtttgttttcttttatttaagattaactttcactatattttcctactcaactattttataaaaccttctttagcaaataaacaaaatttctatatattctttcttttcccacacaaattttctctctcatcaacttacaacaaaattttggagacaaaaaagtgtgcaaaacatagctccaaatgtaatatgacaaaaaaacattggaggatgaagttgctaaccttttaggcacctccgattcgtatataatcaccaaagtaaattcactataatttttggcatgacctcccctcttttttgaagaaattttgaagcttgctcaggctggaggaggaagaagacatatataaaggggtgggactttagtcccggttggtgttaccaaccggtactaaagatcagcgggatctttagtcctggttggtaataccaaacgggactaaagttacgatctttagtcccggttggtagatccccggggggcctgacaagccctaacagcatttaaaccaggactaaagataccaaccgggactaaagatcaaatatgcccgttaccctttttaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgtataagtacgttttatttgttcatctttttccatgagtagttgtacgtacgtgtattgtatacgtacaactactcgcgatagaaattccgtttctgttcgtttttctcacggcaacaagtccgtttctgttcatttttttccgtgagtagtacgtacgtatatgtattctgctcattttttccgtgaagtactacgtacgctacgtactacatagtactactcacgggagcaattcagttttctaaaattcaagggaggttagctggatgtattttaaataaatctaatctaataatttaaaatataaaagattcactaattaaattaaaatcaaggattgtatgtttttttatagatttgtaaggtttctctaatttattagagtaccgtgtgatggcatatgagcatttgtaagagtgtcacatgttggtttatgagtgtttttaaaaaatttaatggacttttagtattagattatatagatatacgatattattttcagatgagcttatagctagtatttagctagatattattttcagatgagctatagctagtatttagctgatctactattaaacttgctattacgtgtattcctctttttcattcaagccatttttttaatagacacaagcaaataaattttaaattaaaaaaacaattacctgttaacagttaatatcgatttgaaaagacaagagcatcttgctattcaagagaggcctaaacaggttttctaaaatgtaaattttaggatttatatcaaaatcaggcctctaacagattcccagccaaggtcctaaaatttacccacacctaaaagcagtgccaatctcgcccagaacttgggaacatgtacgccctcccaatgacactcgattatcgcgccacttttttacctgtccatgctaatttctttctattggcaccattttttcttctgcctgcttccttttttccccttctctcgtcatcattttctttctcacgctagctcgcacacgccgccgtcacttcgccacttaggatttccactgggtcgcctccaatcctccgtccgtgccgtttcattcgccatctcccgcgccgccttcattccatccatagtgccagcgaccgtccatctggtgcaccggcggccctcgtattggtgggcagcggcccttcatcaagtgcgccgaaaacccctcctaacgtgagggtcgtctaggatattaacctgcagactgatgacacagccgtgtagaggatcagctaggccttctgtttttcccacattagaggcaaatctgtcgtcaatacaaccttctgtttttccacattataggaaaaatcttgtatcaatataaccgtggccggcgagggattctcttacggcggcatagaggtaagatagcactttaaaagggctaactccggcatgtatggttctatatatacatgatccgtaatgcttgtcctaacttattctcagatcgagctagagcctagacatagagaaagtatgagcattgtggtgagcaagtcggcgccggtggtcgtccggccaacgctgccgccggtgaagacttccggcagcaagatcgttctgtcgcctatggacaagcttagtgccatgacgccaaccacagtgctgcttgcgttcgaccatcccatcatccataaccatgagggcatccgatcatcctgcattcagatgcaggccacggcggaatacatcaagagaggtctcgctcaagcacttgtccactactatcctttcgccggccgcatttcctgcgacgacgacggcggcgatttttacatcgactgcaccggcgaggagctcggagcgacgttcgcgtgtcatcgacaaccagcccactgacgccgagacggcggtggtgcagcagctcgccttcaactgcacgcccgacgacgaccacctacctcactgtctgctgtgggtgcaggtcaccacgctgtcctgcggaggcttcgtcgtcggggtgacatggaaccatgccgtggctgatggtttcggcatagcacagttcatacaagccgtcggcgagctcgcccgtggcctgccatcggcgccgtccgtcaccccagtcaggttagatgaccaaaacaacgccgtttctcccttcaccatggccttcatgcagttagcagacaggcacaaggtaccagaccttaccttcaacaacgtgaccgtcccgtcgaggttgatggaccacatcatccgaggacgaacgaccaacgtcaccgtgttcgaggcggtcgccgccgtgctttggcagtgccgaacccgggcggtgatgacaaatccagaggcccccgccgtgctgctcttcgcggtgaatgcgcgaaagtatctcggagccaaggatgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcctggcgaaacatcggattcgaggatgttgatttcggcagcggcaagacggcgagggtgatgacctacccgcagagggaggtgttctccaagaaaatgcccatctgcttcatgctcaagaacacaccacaaggggctagggtgatttcaggctgtgttaaagctcaccatgccgacgccttccatcaagaaatagccaagctcaacgccaccacctaattaactctgcgagctacctacagtattatataacacatgactctcagatcataataagtaaataaatccatcaaacaaactatatatgcctggtgttatcatgtaccctctcaatttgtgccatttatctataattagatttatcattatatcgttcacgcataaacaattcatgagcctatcctatctgtataataacaagccaggtgctcccttcattttttaatgtattatgccattgaattttttaaatacgcaagaccatttgtcttattaaaaaaataatctaatattcatttgtttttattgagatttgattcatcatcaaatattttttaagcatgatttaaatatttttatatttgcataaaaattttgaataagacaaatggtcaaactttgataaaaagttaactgtgtcagacattaaaatacggaggtagtaatctctattattgtacttcatcaattcgtcatgaagagatctactccctccgttcatattatatgtcgtttgatttttttttctagtcaaactaataaagtttgaccaaacttatagaaaaatttagcaatatctgaaatatcaaattagttttattaaatataacatggaatatatttcgataatatgtttattttatgtcgaaattactactatgtttttatctaaggtaggccaagcttaaaagtttaactagaaaaaaattaaacgacttgtattatgaaacagagagagcagtaaagtaattcttttttaaaaaaataaatcatcacaagacagttcctatttcgttgaatgtagcagcaaattccaaaaacattccgtcaggagagcggagaaaccatgtgctctgttagccctgacaaccatccttgccacctcagttggcgcccctcgccgctgttgcatcgaatacaggaaccaagccaactagagagaatgaatggttggaacacacttttagtggaaataaaagtaacacttaaacttgacaaagtttaaatgcaccgatcacacggctggattgatgtcagtctgaccgcagtactccggccgttctgaccaccgccttgagccggttggaccacctccctatcgccggtatgaccgcctgctagttagaccatacaatgaactccagtcaaaccgtcgggatctagaaaaacacgtatcgatgaaactcttgaaagtagatctactttattgcatcaatatgtgtttacaaagtgcatctaaagctagcattcctctctcaactctttaactaggattgaagcgtcgaagaaaaccctaacttttctctcccaaaaagtcgatttcttctagcctcaacccctcatgtatttatacccacaacctgcttcttgtcactgtattactgcaccaagtctgctgcgccccaatgcagtaatgcttgaagtgtttctcccaggatgcaccctggccgtgtttcagcaaacttttggatatcttaccacaaacaaactgaaccccccctgaaccagatgatgttcacactggtggagaaatcgtttgtagtcccagttcgtaacccccctttagtcccggttgtccaaccgggactacgaatctgggactaaagatagcgatctttagtcccgggtaaaataaccgggactaaagatcgatctttagtcccggttggtaacacgaaccgggactaaagatctatgtaccattttttttatttgcatggccctgtttgctgcatggttgattatatatatatatatatatattacaatacattatatatgcattgtaatatatatattatgcatgtatatagaatacatatatatatatatatgcgtatgtatatatatgtataaatacatatattacacacatatttataatttaaagcacttaacattttatgtacatatatgttaccaaaatatatattaacactaaagtaaatgtacatacatatataaatatatatatacatgcatgtatagtacaattcatttgctcgctagctatagctacgacttcgacgcctgcgttacatcagaagaggaaggaccgacgttatgaattgtcgatccatcgtagtagaattcatcatcgtgattaaggacttcttcgttaatgaaccccatcagttgttcttgaacagccgtgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtatggtgtatatttggtttgataggcagtgggcatactcgcatacgtagtagccgcataagttagttccattgtcctgctttgcacactacatgagaaacgatgagagatttaatatactctttatattaactgtaacaagagattcaattcaatataattttggatcatgcatgtactcactggaaaatgaaacctccgtccaagtttttctttccaagtcccgcggaccaattgacggaaccgatcccaagccctacatgtgcagttgcaagctatgattaactaaatattacccgagatcaacataatagcaacagagtcccgcgactttggaatagatggcattatattacatatctatcagttggaagagcttgtcaaaaaccttctcctctttattcattgagtcgtacacagtgactctgcatgcgtccaagtcgaaaaagaacaggacccagtggaatctagaatatgcgtgatatgagataaatatcagaatgtacatgttatatgtatgggaacgaaatttgttcgaacaacaataaaaactcactctgtgttgtacgtcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccgtcgggccctttcaatctccattctacaataatgaaaggaaattattattgcttacacatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttgt

SEQ ID NO: 8061 - DNA, 3374 bp, Oryza sativa
tttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttgactgcaactgtacggcggctccttgtttttggtggtgtcaactttgtccttcttcgttgcccttgtgctggcaggaggtggagcttggcgagaccgtgtcttgggaggtgcaggcggacacggtggaggtggaggcggaggaggcggaggagccggaggagatggtgcaggaggaggcggaggaggcggaggagccggaggagatggtgcaggaggtggtggcggaggagctggaggagatggtgcaggaggagacggtggagccggaggagatggtgcacgagacgccgcttgtcgcccagggaggatgatgtaccgtttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttcacggcggtgggggcgcggtccggcgccgtgggccggcccggcagtgtgggggcgcggcggcggtgtggcggcagcggcgttgtctcgcgggggcggcgtctcccagcagtgggggcgcgg

SEQ ID NO: 8062 - DNA, 6379 bp, Oryza sativa
ccccggatctttactcccggttcttctcaccaaccgggagtaaagatatttttccgctatttccaaattcttttttaaacccggttaggattaagaaccgggactaaagttaatagcactgaatattgaatttcgttgcatatgtgtttctaaaatagtaaataatgcattaaaaattctaattaacatatgtaaatcccacatgcatgtcgtgaccgagaaaattgccttttcccgaacgctagtgtattaatcccagtcccaggaaaagccggggtacaccacacaaacatgatacaaaaggcacatctttattatatcgataatatttacattattacaaaggcacttcaggcctgacaaacaaaaataaacagcagcggactagcgggcctacggctccatcttcacaggcgctcaactggggtataagccaggactccacctaggacttcttctccaaagcttcttttactgaagggaggaaagatagagcaagaatgagtacaaccacagtactcagcaagtcacaccgggagatgcatgattaatgcaagggagtacaaggggtaataatataggggttaagtttggcagtaaacagcatttaaaagtcacttagttgcccaaagctattttataaatacgatcctagagctacatagtattattaatcaaggccgtggacccacacgaacctgccttaacccaaggcctacgatgattcagaccgaactggcaacccgacctgggtcccaactcgtcccaagccaacccaggccaacctttccacattttagttgttaagaaaattttaagaattaaaccactaacttgggtacattgctaggcttgcccatatccaagggcacggctattcgaatagatttactctgatcagaggtgtacatctttacccacaagacacatctttactccgcattccatggccttggaacccgtcgtaaacatgtgacataacccttcacccatcctagccgtgaataaaagtaccgacccaaccctgcctacggtcgatatcccgggacaggcaggccaggattgagcccctagcaacaggatctagaccgggtgcgccacacgcataggggtgagaccacccgcgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgtttaggactagactgagcaccgatttaagccttacccattagacatgtggttagtacggtagtgctttgcaacagagacccgagcttaatccttatattggccggggtgctacttcccataactggcatgcacccaaaccccaccggaaaacatgttttaggggttttgaaagaggaagagaggggtatgtccaattccaccataagccaaccattccatagtatccaagtgatatgagaattcccaaagtctaaagttataaaaccacctaatgttgcctaattaatcagcgaagaatctacctaaattcatactagtggaaccatgaatagagtacccactagttggggttttgttttcctagggtgaacaaggtgataataaacaatagcaataataataaggtcataacaaaggattaataggaagtgctaaataaaacagtgataacgcgggaatttaaataaagcggtaatgcagtaatttaaatcaaaataattttataaactgggattcaatatgctcaagggagatgcgacttgccttgctcagagagaatggccttccgaaccttcggcgacgaccgcaaaccacgcttcgagaacctccggaacgacagaagctacgcgaagcacacaagcaaagctacaagcctataaaaaagcaataacaatacataaaaagaaagcacacggttctttaggttataacaaacattaggagacttgaacgggtcgattcggagttcgtatgatcaagatatgatcatccgaagtttaatgctgttacatggagatttacggattattgtgattaggttttgcaattataaaatatgtataagcgctagcctggaaaagacaggaaggctgcgccgttgacatacggactccacatgtcaacctaagggaccacggtggaccgggtacacagagacggtccacgggtcgacagaagcagatcccgtgtgtcaaccgaggcgagtggccgacaaacggactccactagacaccacacgggctgcacacttggaaaccacgcggctaccgagcggacacactatcacggtcaccacacgcacaagcgaacgactaccgacaccggtacacgggtaccggggtcgacaaccgcacaacgggcacggggcgacacaaaaagaatgaggacggggcagcgaaggagagatccttaccaccacgcgacgaggcgagggaacgacaacgacgaacgggcgcggcggagacggccgggaacgacggagacgaaaggcgaggggacgacttcggcggtgatccttggacgaaggcgagacgcggccggcgtaacgcttggcgacgcggaggcgaggacgaagacgatgacggggctgcggcacttgacggagcgaggacgacgaacgagaacggcttgacggagggacgaacgccacgacgaccgggaacgacgggaggactacgacgacgatgaccggggctggcaaggaggcgacgtgggcagccggcagcggctgcacggagacgaggacggagtggaacacgccgctgtgatgccgacgacggaggcggtgccgcgagacgacgagtcggcgaggaggaatgaccgaccggaggagtcgtcgacgaggacgaacggagatgacgataacgaacaccggcggggttcagatggaggggaggcgaggccgagggcaaccttgacgctgtgatgccggaggtggtggttgcgcggccgacggcgcacgggtggaggaagggccgactggggaaattccggcaaggcggatggagaggccggcgcggcacggcggtgttccggcgaaaccgagggcaggccggggtggagggtgacgccgcaatgtcgacgaaggatacggcgacgtcggccgacgctcgggcgcggcgatcggggcgactgaaggcggtacagtggcggcaacgccactgttttgctggcgaggacgcgtctccaggggtctccgcgcgaaacggagggcaggccgggggagaggaggctgctgtgacgacggggaaggcaacggcacagccggccggcgcgctgacgcggcggcagggcggctggaggcggccggcgcgggggaaagagaagggcgaccgcggggaggggtgatacgaccacggtgaggctcgggatgaggctaaaacgatagaatggaggatggggattccattttatagcggagggaagcgagccgagcacgggaggagcggggaaaggcggcggaaaaggcgcccggcggccatggaaggcggccatgaatggcgcagccgttccggtcaaaatagtgcacgatcaaaggggagattaggggaaatagggagaggaaggaaaggggattaattccccccaattaattttggaatccaacgcttaaatcgcgcagatttgagggaggaacgaactagggttttcacgggagagagagaggagctgtgcgggaggaggacgacgaccgggcgggtgggacccacgtggccaggcgcgcggtcagcgcacgcatgtgcgcggcacgggcgggagggcgccgctcggcttgtgcccggaggcggcccacgaggagaggagggagaggcagcccgggagggagagggaggaggagggagctgggccgaggggaaggagggagggcggcccaagagagagagggaaggaaaaagagagggaggaagagaggactttggccgcgggccgagagagagagaggactttgggccagacttggcccaaaggaggaaggaggattatttttaggtttttctttttattaaactttgatcatagttgttgttgcttaataaatattttcggtgctctgaaaatttaagtaaaatttgagtgctctttttagaccaaggagaatttaacgaaaattctccgggccacattcgaaattttcttgtacgcattttaatgtttgccaatttctttttgaattttaattaattctattattccttttagaaaatgatttttatttcaggatgaatttatcaggacgtgacaatgcatgatttaaaacttttaaaaattctaataatcatatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttataaaaattctaataatagtatataattagcatatgcatgatattaaattgttaaaaattgtaattaacatatgtaaatcccacatgcatgatttaaaacttttaaaaattctaataatcgtatataattagcatatgcatgatattaaattgttaaaaattgtaattaatcatatataactagcatattcaatacatccaaaatagtttacaacaattacggcaatagatcggcggtgacggttgtccgcacgtactttctcctcactattgttccttccttgtgatcgctacgtgagtaaggggtatcttcgtttgataggaggatgctagggtcaaccgtcaccgtgaaagggggttgcccatcaaactgatcgtaatcctcgtcagtcttgtcgtctactccaacgattttttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtgatcccactgtcatcaatcgttacgcctacaccagtcaacctaacccattgccaccgaaacagagggaccttgagaggtccatagtcaagttcccatatctcctcgatggcaccgtaatacgtgctagttgtaccatcgtgtcccatggcatcgatacgaacatcactgttctggttcgtgcttttcatgtcttgggctcttgtgtagaatgtgcacccattgatctcatatccctagaatgtcgcgatcgagccagatggacccctcgccaggaaggccagttgctggttaatcgtctcgttacccatgagatgttgtcgcagccatgcggggaaagtatcaatgtgatgccgtgtaatccatgcatcggacttaccaatgtttctggcacgaactagagccaagtgctcctcgatgtaaggagctaccaatgaaaatgtgtcattatattgaaaaatgaaggtggaaatatcaactcaaacctgacaagacattgcaacacatcattctgaagggcttctaacctatccggatcgatgaccttctgcgaaattgcgttcatgaaagaacatagctttgttattgttgcccggacattgtctaggaagccaagaaggtttacgcaaaggttcttagtgaggtgcatcacgtcgattgcgtggcggacgtccaagaattcccaatagggtaactcccaaaatatggagttttttttccacatcgccgcatgaccatcttcgcactctataggctggctgccaggcccctttccaaacactactttaagatctttcaccatagcaaacactgttttcccgctgtgatgtttaggcttcatacggtggtccgtcttatgttcaaagtgcttgcctttcttccatactgggtggtttgcagcaagaaatcgacgatgacccatgtacacaatcttcctacagtgtttaagatccgtactttctgtttcatccatacagtgagtgcaagccttgtaccctttgtttgactgcccggataggttgctaagtgcaggccaatcgttgatggttacgaacacagcgctagtaggttaaattcctcctgtttgtcttcgtcccacacggggacaccttccttcttccacatagtttaagatcttcgaccagtggtcttaggaacacatcgatgtcgttac

SEQ ID NO: 8063 - DNA, 1132 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatcctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgc

SEQ ID NO: 8064 - DNA, 560 bp, Oryza sativa
gggagtaaagatatttttccgctattaccaaagtctttttttaaacccggttaggattaaaaaccgggactaaagttaatagcactgaaattggatttcgttgcatatgtgttactaaaatagtaaatatgcatttaaaattccaattaacatatgtaaatcccacatgcatgtcgtgaccgaaaaattgccttttgccgaacgctagtgtattaatcccagtccgaggaaagccggggttcaccacacaaacctgatacaaaaggcacatctttattatatcgataatatttacattattacgaaggcacttcatgcctgaccaacaaaaatagacagcagcggactagcgggcctacggctccatcttgacaggcgctcaactggggtataagccaggactcgacctagacttcttctctgaagcttcttttactgaagggaggaaagatagagcaagaatgagtacaaccacagtactcagcaagtcacaccgggagatgcatgattaatgccagggagtacatggggtaataatataggggttaagtttggcagta

SEQ ID NO: 8065 - DNA, 10957 bp, Oryza sativa
  unsure (1)..(10957): unsure at all n locations
cgacctcgtcgtcgtcgttgtcgtcgctctcgtcttcaaaaatacgactatcctccccctgaacctgtgacagtgtacctgtaatattggctctagtacctgggctagcctcatcaaaagaaacttcgcaagtctcaacaattttgttagtctccaaaataagtacacgatagccacgagtatgtgcggggtaaccaagaaacaatccatcggtagaacgtgcctcaaacttatccaaatttccagatttcaagacaaagcacttgcaaccaaaaacacgcaaatgtgaaactttgggttgatgtccaaatcgaagttcataagaaatttttccaagttttgatatcaagaaaacccgatttgaaatataacaagcaatgttaatcgcctcagctcaaaattttctaggagttttatattcatccaacatcgttctagccatctcaaccaaaacacagtttttcctttcaacaacaccgttttgttgaggaacacgaggagaagaaaattcatgttcaagacctctttcattgcaaaattgttcaaaagaagcatttttaaactcacgaccattatcacttcgaattattttcaaagaaccaggaaattcaagctccaatcgaagaaacaaaccacgaaagtgttgaaaagcttcgtctttagtttccataatgaaaacccaagaatatcgagaaaaatcgtcaacaataaccaacacataccacttttctccaacagattgcactctagctggaccaacagtgtccatatgtaatagctgtcccggtgcatccgttatcacagaaacaataggagcatgtgaagtagaaaccatcttagcatgacgacacggtgtacaaaccaaatcaagatctttcttacgtttaggcaaaccatgaacaagatccaaaccacttaacctagtgagatgatgaaaaccaacatgtccaagtctacgatgccaaaacatcacatctttatcaaacttagcaaccaaacatgttttcacaggtgaaacaggattttcaaaatcagctttaaacactcttccatagcgagaaatattcaacacagaatcaccacaagaatcaaaaactttacttccagttttctcaaagtgaaccacaaaattttcatcgacaatttgtgaaactgaaagcaaattgtactttaagtcctcaaccaaagctatattcttcaattcaaatttttcatttaccttaaccaaacctatagcgagaacggcacttgtagcagcatcaccaaagataatcgattcagtcttagatgccttctttagggaggagaaccaatttttatcactggtcatgtgtcgcgaacaaccggaatccacgatccacacgttctccttccttgccaccaaagcctacacacaagcagaagtcgaagcctcagtactggggttagatgataataaaaatttaggaatccagtactgagacacacgaccagaagatccaataggcatatatacacgtgcaaaatcaattttagaatttacaaaaaaattcctccgaggccggtctgaccgagggtgtgcagccggtctgaccgggggccggtttgaccgaggcatcaccgccggtctgaccggtggtcggtctgaccgaggctgttcagccggtcagaccggtcgctggtccgaccgcgggacccactgcggtctgaccagtttcctcgaggaaaaaccagatttttgccactttgattttgcaaaagcaatctctctctccattttctgtttatgagctaatctgaaacaaaaaccaacaatatgtccatctttgccacaaaaagaacaagtatatttttcacgatgattagacacattggtagcactagtagatttagcaacatgagcaacaataggagattttgcatgcacaacattggattttgaagaagatgcattcatagtagacatgataccagcagatttaaacacagttttgttagtataaggtttaaccaaaatctcaccacttctagcaccaacacctaacacaacaggaggatgtctagaattatgaacataaggattaaaacctaaacctcggttatgtgtgctaacctttgattgatccaaaatcatgttgagattctttttaccatcagaaaatcctagcaaagaatttttcaaataagaaacctccttttccaaattagcacaattttcacaatctatcataacacttttgcttttacgacatttagggcaagaaagcacttcattgtttttcacgacgtcttccataaactcaacacgacctaaagcatcttttagtttcatcttgttcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatatcattcattaaaacctcgcaatttgaacaatgatcatcattaggaataagagattttaatctatcaatttcagatttaagagattcaatgataaattcctgttttctatacatcttctcacacttcttattttttgcactcaaaatattaatagcttcctcaaaagcactcacctcactatcttcatactctgtgtcagattcaccacgcgccatgaagcaaacataggagatgttctttcccttgtcatcatctccactttcaccatctacatcacttagtggctcgaaggcggcgcaaacttgttgaaaagccttcctgagattgtccagcttcctcccttgggatgaacacttcgacttgttgttgggcttgtagttgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaactaatgccaaatcctcctcctcgatttgttcgagttgatcatcggatgtggcattaaaaacagcaagaaaagaagacttagatgaagaagcatcaacatccaaagaggaaaccaaagcactcgacttagaatcaacttttcgagaaagaacattcatctcatgtgttttcaattttgtataaagtgaatccaaagtcaaagtagacatgttaatagattcctgaatagatgtaactttcatctcccaaatagacatgccaacaccattgaaaaagtggcgagaaatctcagattgtagataattagcatcataagaagaatcaacagatctaagatcactcaaaattttattaaaccgagaaagatagtcatccaaagcttctccaggtttcatctcaaatttaatatactcctttttgaaaagatcacgacgaagttctttaatattatttgttccttgaagaaaattactcaaagcagtccaaatctcatgagcagtttgaagatgagcaacacgatcataatccgaacgagaaataccactcaaaagaatattgcgagctttgcagttttgttcaaaaccgttttttttagcagcagtattaatagcttaaggaatcacataaggatgagaatcttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaataaaacaagactctgataccacttgtaggatcgaatcacaagaactaagccaaccagaggggggtgaatggttggtatacccaaaaaccgaaaacttttagcggaaataaatgttaccctcgaattctacggagatcggtctgaccgaagttgtcatgccggtctgaccggtatagatcaatcggtctgaccgccgaagctacttgtcgcgcctgtcgccgccgccagtctgaccgccgtgcttccgtcggtctgatcgccgcttgccgccggtctgaccgccagtagatcgccggttagaccgccaaaaccgggtaaacacaaattgaataactcttaaagtagatgacgactttattgattttctttgtgtttacaaagtgcaccaacagcactccttacaaaaattttgactaaactcgaaaccctaactcaaaactcaactcaattgctctctaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatcttcatcaaccacgtgcatcaactctagcctaagtatcccgcatgatctctgaccaccacggacgttgccttatccccaagccgactcccggtccatctccgcaaatactctcccgagacatcgagtcacctacacatggaacaaacaaagaaaccatattccgagaccaagctatctccaacttgactcattagtagcaaacaacagtattacatacgtatagtatccatctagaagtcataatcatgaaataatcacggatatgcaaacaaacaacccgaaaccgaaaccaacacagtatcggacggtcagaccgtgggctagccggtctgaccgcgcgcattccgctggtccgaccggctaccagatctcggtctgaccggtcacatgaaataacaaatcctgcgatcacctgtgaaatccaatcatctccaaaaccacttcgtgaataaattccaaataacaaaaccaataatctccgatgcccaattgttcatcacagaataatcatcaaaaacacatttgattttacaattaaggctagaaatctatctatctattactccctcaatctacatatagtttttttagattattcctaaatgatctacatatttgtgtttattcattaagtctattcgttatttgtgcattggagtaaatggacattaatgtatgcatccatgcacacaaatatttataacccacatgcgatatcttgatttgctattggctaggaaatagtgggtatggtgcatgcatcgactttgttgctagagtaaatatagtatgagagttattagtttttcttagtcttggtgtacctatgaaatatgtatatcaatttggaatggagggagtatatactaaaagtccattaaacttcctacaaacgctctcaagcctggcacttctacaaatgctcctagaccgccacataccaatgtctaatctcaccgtcgattttcacttaaatcggtggatccaaataatttagactattagattagattagatgtattttatttaaaggaaacgaataccatactgttgggcggaaaaagaacggaaaacataagtactccgtaaataagtacgtacgactaaaaaacaatcaagcttacataatgttgatagaagaaaaaagacctacgcacagacttgcttaaaaaaaatagagccaaaaacaacgcaagtacttagtaccattgaagaaatataaaaaacaacaaagccaaaaaaaaatatacatacgtaataccattaaaaaaacgatgatctttagatataattttctattatttaaatataaaatataacactatataaatttaagcaaatattaccgttggtttttcacttttccaattttagcatgaactaaacacacccgaaaaagacataccagaatcttagcaagttgattgaaaggcacggcaagtgggactgcctagacatccgtttacttctgcagtaacatgcagttttacgggcaccaacacatacataatttgttcaagaaaaaagcatacataatcatacgcactgcagtaacatgtagtacattttcttattgcaataccacactattaacacataggatgaggcacactatgacagcaacacactatatatactgtacatgcagtaacatgtagtacttctttaggcagtcggcacgacggcggcagcggcggtggcgacgtcgacggggtgtaccgtgcgagccctcttccctgcctcccaccactgggcggcggccttccagccagcgcagcaaacaagagtaactgcagcgagaagtacgacgatgaccacaatgaaacctgaaaaattcattatttagtaattccaaaagaaaaaaaatatatgaagaactaggacttgaacctatgacctcctagctgaggaaaacaaattttctcgtggctaatgatttagtacagatgatcttcttggaactttgatcggttaagactcatcgccattattacgggtttttattctaaatactaaggataaatataaagaagagataaaatccaaccaatctaaaaaaatagatactccatccgtttcatattacaagtactagtaaattttttttaagttcgactaaatttgtagaaaaacataggccttgtttagttggggaaatttttaggtttggttatcacattggatatacggacacccatttgaagtattaaacgtagtctaataataaaacaaattacagattctactaggaaactgcgagacgatttattaatcctaattaatccatcattagcaaatgtttactatagcaccacattgtcaaatcatgaagcaatttggcttaaaagattcgtctcacaatttacacgtaatatgtgtaattggatttttttttcctacatttaatactctatgcatgtgtccaaacgttcagtgtgaccacgtgaaaatttttgttctgggaactaaacagggccatactagtattttcaacacaaactaacatgaaaatatattcaatgttagatttaatgatataatttcatattttagatgttgttaaaatttttataattttgatcaaacttaacgattcaaacgtcttatgatataaaacggagggagtactaacattacaaacatgctccagctcaccaccgataatcgtcatcagtagtaagtactaacaaacattcaaaagaatcaggggcggatctagagtgtaacaagcggggcccttggcccccactcaattttgcagcgagcgggggcaaatgcccccttgacactttttacttcctgttaacggccaaatctggtaaggtgtgaactaggttcaatactaggatcgaggcggattcgatgaagagatcgattcgaagaacagagtatacatcggctgcgaaggtatcggctggagtgtacatcggctgggacggatcagacagagggtagccgatacagccgatagaggtaatgcagccgatgatgatgaagacggtttcaaggctgtttctagaatcgatcaaagtacttcacagggattgccatggtggagataaagctctcttatgtaatttccttagagatatgtttgggcaaaagtctgccgcaaagacttatggtatcttagagtttgttagagataagtatcgtgtccggcaaggacatatcttgtatctcgggtataaatatgacccgaagccatgtaatcaaataacacacgttcaatacaatctcggcgcgtcgccacccttttactttcgttttgtttcgacgagttcttactttcggattgagctgcatcggttttgatcttcaactagagataaaacttgttatggcggcttgcgttctcgggattagtgcttccatctttatgatactctaatattgtttatgtaattcgtcaagttatcatatattatatataatctttgacaatatcgttgtctaaccttaaatcgactaacatctattgttagaaggtagccgattaggttaaatatcgatgttgacttagattatatagggtatctaccatcctatgaaacaaccaccggcttgattgtctagatattgttatcctcttcacacttatagctgcatcagttgagtttgaccttataagtcgtgattagaatcttaatctctagtctgcttttgattgctgattagggcagtatcggggttttagccgatcttatctgatttaactaatttatatcttatatgcttgattggcatgttaaatccgccctttatgttaagatcttgttgtgtttaggtatattaacctttttgtttgatatatcctacttgctttaatatcttaatatagagtggtattggagtaattagccgatacatgctagatctatctgatcggctatgctataaatgtctataatctcattgttaatatatatttcgatctaagtgatttatactatctcggcatggcgaccgatctatcccaatcacttgatttaagtatatatcgatgtaaggattatatattgttaatatctacaaccgatcgaatagatttagttctttcttgattattcatgactgtcgatcgattgaaatatgacatcggctcaaagataaatgatacgtcatcggcgacctaccgatcggctatcgtttatggatttaactgctatcttcttgtctttatttcttgttgatagcaggatcaaatcaactggcatgctcacgaacctaaaagtaagatttttggacctgcactgaagctaagcagatcttccagggctcgtgtttttcgcatcaacacttccttagtctacctaagcggtagatccttatcccccacttatgctattttctgcatccgccattgaaaagaatcagtcgacgggtagacacggcacattattttacaccattagattagatatattttattttaaaaaaactaataccttattaatctatgtacgtatacaggtgattaaataactgttggctaaaaaatacaaaaaagatacataattagtccataagaaggtacgaccaatagaaagaaatgaagcttatctactgtccagcggaagaaaaaaaatatgagcacggacttactataaaaacaatacaaccaaaaaagtacatatcattagaaaatgatcgacggtattttgaaatagtattttatactatttaaagataaacatattactctacaactttacgtaaatatactttgttaaactagatttatattataaatacgagatatccaatcaattatctttaaatgttctattttaacttacgaggctaatatatataataactaatgctatgattattttttatttcgcatcatattttagggtgtcaaatatcacttacgaatatacaacactaatttaaatctaaatatgtaaaaatggaaacaaagcaatttagttgttttattttacaccattatattagatttattatttaaaaataaaacatttctcctatatacggacacatgagaaatatataattgtcaaccagaaaagtactccataggtacatatgattgaaaaaaataataatgcttacgtatcgtttgccggaagaatagaaaacgtacttatgataaagccaacaaaatcgatagtccttaaaatagaactttctaataaaatataataatattcaaatttacgcaaatataaatataaaatatcctttgaatgctttttaagcattctatctaattattttaaaactatatatatccattttttttatcccattgtattcctttaaataaataaactattaatgtctataaccctaaatacaacacaatatatggagctgatatgtaataattaatgttatgataataatttcgcatcatattttaattaaaaaaacacttgacgaatatacaacactaatttaaatgtacatatatattctccaaattactaaaggtgaatgtgattagataggtgttgaaagcaaaccaaacattgaactaacatacactttgtctcggttacatataaatgtttctattattttgggataaaatttaactccttagatttatgtgacggagggagtataagtaatataagtctatctttattagatgaagtagtatcattagctatatttttaatagaaaatatctttcattaatatataataaaattaaaatgttacttaaagtcatctatagcatacaaaataaaaaatgttatataaagtttggaaactccacaaatttttttaaaaataatcgctcatatatcgtacagatagatatgaaccacctccatcatttgtgacatattttttttttctaataaatttgaggatatacggtttcaactaatatgcccaatccagttattaatggacccatgtttaaaatagagtcaaaaataaacattcgtaataaaaattcaaacaacattaaacaaacatgcacgcgcgtatgcgcgggctagcttcctagttaactataatgagacaaacccataaatcaattcaaattgtaaaaactttatttagaggaacctgctagcactttattcaactaactgggaccttaaacactctgacgaaacagagaaccaggtcgaagtaacttcgttagcacaacattccttcgctaaaaaatgagctgccaaattggctgaccgatggatccaaatgaccctaaaatcatgaaacaaacctagtcgatgcttcaactcttggattattaccccatacatcgatctattggcgttctcaccagtcaccattttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8066 - DNA, 732 bp, Oryza sativa
aatactccttctgattcttacacttatttgttggacaacaaataaaacccttctgcttgttagcttcggccactctcaaaaaataatgcacgccgtcaataaactctttggaccgctggtcagcgtacatccattgccgatccatctacatgaaatgaaaaaaaaatcgtacacaaataatcattcgtacaataatgacagtcatacaataatgataaaataatcacaaactctttcaacagtcatacaataatgacatatcattattcatacaaaaattataaaatattccaccaaataattcttatttattatttttaagttttaaattcttttaatttttaatttagtttgttttcttttatttaagattaactttcgctatattttcctactcaactattttataaaaccttatttagcaaataaacaaaatttcaatatattctttcttttcccacacaaattttctctctcatcaacttacaacaaaattttggagataaaaaagtgtgcaaaacatagctccaaatgtaatatgaccaaaaaaaacattggaggatgaagttgctaaccttttaggcacctccgatttgtatataatcatcaaagtaaattcactataaattttggcatgacctcccctctttttgaagaaattttgaagtttgctctcgggctggaggaggaagaaggcatatataaagaggggggaactttagtcccggttgg

SEQ ID NO: 8067 - DNA, 34215 bp, Oryza sativa
ccgggactaaagttacaccaacctggactaaagatcccgggggggcctgacaagccctgacagcatttgaaccgggactaaagatcaaatatgcccgttaccctttttaacctttagtcccggtttttgttgcaaccgggactattgtggaaatagcccgaccgacgaaagatggtttctccaccagtgtcaagtcgtatcctgattctatggatcaagcaaattgcaacataataaactggaaggtgagaggtttaaatgctgcagctagaagggattgtgttagagaaatgatgttcaagttgtatcctgattctatggatcaagcaatttgcaacatatttaactggaaagagaggattaaatggtgcagctagaagggattgtgttagagaatttgttgagcaactaaaggcaactataagatcccaagtgctctttatttttttctatatggtaagcgccacgtaaataccatgtaaaataaaaactaagtcaacttatcatgtgtgtgtcacgtaggactaaatcatcattcagaccgcccaagaactctatttagacaaatttttatatttaagagatcctatgtaacctgtagagtggatttttttttccttgcagtcatgtgctattttctttctactccttttctttgctgatatagtggttacacatttgacttataaagataattacataaagtctttgcacatggtagttctttaccatatgccttgttttcaacccaactttatcattcgccttccttgactagaccaagcctcctcagtgaacacaatcccgattcttgttgttgatcagaattgaacttcaatgttaatggataaaacatctgtatcgataatattttttttaaacaaatcaaattttcattgacccggctttaatagaaagcccaaaagacagacagagtcttatacaaacaaagaaacaacaaagaaaacagaaacataacggtagccaacagcgctggaactcatcaaaagcaccatccatcctagcgaagatatcacaccctagagatagatctcaaaacgcgtaacaaagaagccaagagcaaattttcacagctaaactactgcagggaggcaacacgacttcaattggttcagtttgcccatcaacagctcacactaccctttcatgattgcttgatcttcttcccttagcagaatacaccaccgctgaataaaagacagacttataagtgaccttcaaaggggacttgaccaaaatatctgaaaaaacccagtcagtcctatttaaccagagcacccaacacactagcaaaaagcatcacccaaacccaagataatactccctccgtattttaatgtacgacgccgttaacttttcgaacaatgtttgaccattcgttttattaaaaaattttatgtaaatataaaaatatttatgtcatgcttaaaaaacatttgatgatgaatcaagtcacattaaaataaataataatcacataaattttttgaataagacgaatggtcaaacgttggacaaaaagtcaatggcgtcatacattaaaatatggaggtagtagtttttttttcacaaactgatcagctatatataaaacaacactcgcacaaatgaggcgtcataaatactgtcaatttttcattgtgtaatttactgaccatgtatgcatggcctcacataacaaactagctgggtggcccgcgcaattctgcggctagtacctaaacaaaatcatatatttttttactatgatttttcttaaaatttattaaatagctatctcattgtcttagactttgaaagaccaaattttatcatcctcgtgtttctaattatatagtttttaaaagtcacaccagttgctaccccttatgccatcttcttctttatttgcttgctcgatctactactattttctatccattcttcttgtaacctttatagtttttagagtttattgtcacgttgggtttcgtttttataatttctagatgtcccgtcaaacgttaccattatattcctttacggcccatccactgtctcttttctttattgtcattgagattttaaaaatcgaacataattatcgtttgggttcattttttattttctagaagccccgccaaaccgtcaacggttttgccattatactcctctacggctcgcccgctgcctcccttctttattgtcattgagattttaaaatcgaacatgattatcattggttttttttttactttttagaagttccgaaccattaaaaattggactagtagtttcattttttataatttttagaagtcccatcaaatgatgccactatgcccctctatagcccgttcgctgcctactctttattgtcattatgattttaaaaatcgaacataaccatcgttggaatttattttttattttctagaagtccagttaaccgtcggcggctctgtaactatactcttatacaccccgcccgctgcttctcctttttattgtcattgagattttaaaaatcgaatatgattatcaatgggttttttttttttactttctagaagtcctggcaaccgccttactcgtttgcttcacggcctgcctgacgtccctccttttaatcatcattaggattcgatttggtgttttattaacagtttttatatgtcgtatcaaccgctaccactctactcctttatagtcctgttacttaatttatctcgtcatgtgttttaaatggtcttttctttcaatagtctttatttttatcataaattttagttatttataaattgtattccgaattgaaatcttatttttatttttctaatttcagaattgtttttgaaaaaaattagttaatatcgtattgtgttcttattgtttttattttttattttcaattttagttatttcaaaattgtattcctacttgaactcttttttatttttttctaattttggatattattttattttttattctaaattttaattaaactcgtattgggttttcatatggattattctttcaatattgcttatttttaattccgaatttcagctaattttaaattgtattcctacttaaactcttcttttatttttcttttgctaatttcggatttatttttatttttattctgaattttaattaatctcgtattggtttcttacatggactcttcttttaatatttcttatttttagtttcgaatttaagctaattttaaattgtatttctacttgaactattcttttattttcttttgttaatttcggatttatttttattcttattccaaattttaattaatttcgtattgggttcttttaatattccttatttttaattccgaatttcagctaattttaaattgtacctctaattggactctcctttcctttttaattttggattttattttatttttatttcgaattttgattaatcttgtattggattcttatatggaaacttctttcaatattgcttattcttaattccgaatttcagctatttttaaattgtacttctatttggtctctcctttttctttttctttctttcttttcctccgattaatgtgggaatttctagcccccacagtgaatgtggtgcctcctttcaaggctgttttaataatataatagatacatagatagatggatagatagatactccctccatactcataaataaagttgtttaggacatcgatacggtctccaaaacacaacttgacttcgtatttctataaaagtattcattgaaaagtgatatatgtatacttttatgaaaatatttttcaagacaaatctattcatataacttttacattttcaaactcaacaactcgagagttattcatgatttatatttccaaggtttaacttaaacattgtcctaaacaactttctttacgagtataacatgccgtcttccatgtactattaattaatgccaaaaccttaggcaggctgctagacaacgtctacggataagagatctatattattctcaccatgcaaattcacaatgtgcgtataataaaccaattaggaaaagcaatgaagcacgtacggagactatagaaaccaattaggaaaaggaaggaagcattgtgtaaccgtcgaatcagcttactagttgtcacacatgcatgaaggacaggaagagttgtgtgcactcataagcattagtacaccgaacaagtcatcagcaaataatatcgaatataataatatatggcagcgcatccaaataatcttatcaagtattactccaattaaagatggcagttaatatatatggaatttttttagattggaccatagcaatcttttctgaacagagataattaaatcttgcaaggacacaaccgacacctccccagctgatttccaagatctaaactgttacgccaaccggtcgatgtgatgtgacaattgatcaatggactacgtgtagcgttcgattgaaaaagtggtcgcggagcccctcctgcgtgttagatttcacgttgtcaacaaacgaacataaacacgcacgaacacattacacaagggaacgtgaaagtggaggggctataaaccgtacactgctgccttctctctcttaaaagtctttctttttctctcaacccctctactgtgtttatatccataataagatagtcatataaggatacatacatgcatatttggtataaggttacttcatccttaaaaaaactgaagaatagaaggaggaggcggtaccgtgatcctcacgatcacggcgactacctcatggtcgctacaaatccgactccttcgggagatcggtttcataataaaaaccctttttacttccagttgggaaccccctttagtcccgggtttctaaccgggagtagcaatccgggactaaagatgtgcatctttagtcccggttgaaataacggggactaaagatgaatctttagtcccggttggtaataccaaccgcgactaaagatagagtatctttagtcccggttgttaccaaccggaactaaagaggatagccaggttttttttccttttttattttctcccaaatctaggggggaaggatatccttttttattttctcccgaatatgcgtggtatgcatatcccaaatcgaagtaagatcccaagtccacatcacaaattttaaagttctaaaaaattatatcagaaatcctaaaaataattacacacaaatcaaattacatcacaagtttctacaaaattcatcacaaatacatcacaagttcacatcacacacaaatcaaattcatcacatgatcctgcaataaatcataaattcttaaaaaaaaggagccagccggccgctgccgcctagcctccacgccggccggccggccaccaccgcgccacccgcccgctgccgcgccgccgcgccgcctcccctccacgccggccggcccccgacgccgcgccgcctcccctcagcaccggccggtccccgcgccgccacggcggccctccgcgttgctgcccaccatcgcgccggcttcccctccgcgccggccgctggccgccgcaccgccacgctggctgccacccggccttctctcgctccgatccaagcggctggcctctctcgctccgatccaagcgagctaaggaagaagaactaaggaagaaggaagaagaaaggataaagatatggagttagagaggaaaaaagagatagagaaagagttcgttgtgtggatgggaaaagaggataagtaatagggattatatagtacgtgttgatttttattcccggttagtaacaccaaccgggaataaagtaagataccaaccgggactaaagatcctagccgcctgacacggtctgacatatagacaaccccaaccgggaataaatatcatctagtcctgttatgcttataaaccgggactattgtggatttgagtcgaccgactaaagatggtttctccatcagtgatactgggatcccgatcgacggtgtttgccccgaagcttcgcattgatgtttagcgagaaatcgcgttctggatgccgatggatcggttcgcatggataacaggaggtctcgcatacacctgatttcgtgtccggcgtcgggcaagccattaagaccagttccagtgtctggcgacgggctcgtgttggagttgccccaaccatatgaatgaggcatccacctgtgagcagcttgacagtgtgcattatccttagttggtaggaaaaccggaagtaatactgcatttgttatctcttaccctatctgtctcaaagaaagaccattcctagcaatgaatctgacacactaggattgtgttttctttgggatggagtagtatgcttttaagtaaagctgggcgtgatgcgttttctctaaaagaaaaatactgcacttgttattaaaaagagaatgttaaaacacaagtaagggtgcaagcctcctccatgcgtatctcttaacgaatgcttttaatttttaaacataaatacacatcgtaattttgcaaccttggttttgttttatttttcagaaaataataagcttaatattggttttgactgacaatataaagttattgatgatatagtggaacaataaataaaacgtgaagtgggacatggaatcaaacatgtaaaccgtttattgcacctttaatttggaacaaacacaatcatggtacgtacaattacattggtcaaccaattggccaattattaagctggatgcgcgtgatcataatagatccttgatcacacatccaaattgaacacatgtacattcttttttccatcctcttctccttgattaattaagctggactactaatatttctcacaaatgcaagcgcgcttaattaactatgcacaaataaatctctctcattttgctaataataacaacaataataatcgacacatacgtaattaattatgtttgacatgatgacgttggttacttcaattttaaactaaccaacgtcatacatgaagtgataattaattgacccttctgcagttggtccggacctcacccagggaagggtcagtgacaggggagaggttgcccatgttgatcatggactgcgcgaagctgcggaagaaggcggcctggctggtggcgaagcggtcgacgatgggcgccgtcgtcccggtcgcctccggcgccgacttgagctcctggtccgactggaggaagccgcggttgacctcgatgttggtgtagtagtggttgtcgaaggtgtccggcgtcgtcgggtccaggtcgttgagcgccgccggcggcccgttgggcgggcaccgctgcgacaggaagctccggtaggcggcgtccatggtggggtccggcctccccgtgttgctgaagttgtacagcctgtccgtcacgaactggcactgcaccctcccgaacgtgtgcccacctgcatttcgcattattgtcgtcgtcgtcagctccggcgggcatgacggcagaactgaaattgagttcgccggagaagtgataccagtacctgaaagggccaccaaggccaggtccgggaaggttaaggccggcaaccttttgccggagaacggtaaggttgtcggtgggggccggcaggttaagggacccattgaagtcggaggtcttgccgtcagccgccccagcagcactccccacccgggcccacctgactgtgaccgacaaaaagagatcgatccatgtcgtccaaaaataataacttgtacgctcaattcaattattcatcgatgagttgcacttgtgaaccctatatgctatatatcttaaatatgatgttttgtagtgcatgcagcatgcatggtgcacacgacaagattggtttcagtacaacagtgtcgatcgatcgtcgtcttgtgtgtgtgacacacacacacatatatatatatatatatatgtatatatgtatatatgtatatatatatatatatatatgtatatatgtatatatatttatatatatatatatactagaaaaaatacccgtgcgttgcaacgggtgaaggttattttaaatttattatttttatatggtttagttaagatgaaatttaccgtggaaattcgcttggatatatatatatttagaaaatcatgagctgtagttaagagtccgttcgtcttaagttagtatacgagttttttttaagagatttcttatacagctcattatgtatcgccaaaagtgaacgaacttaaaaccaactcaactacaaatatgtatttccacaagcgatccttctgtatttctaatagcaaatggacttaaaaaccgactcaaatatgggtatatatttccacaagcgaacgaacttaaaaccgactcatacacagatgacgtatcaaagtagcggcaaaaacatcttcaatttttataatagtagatagatatatatatatatatatatatatttatatatatatatatatgtatgtatatgttgatgctgatactttgtcctgtcgtaatgttgtccatatatattatacacaaactgtacatgtatatatagtagctagctctacatgtcttcctttccttggataattaagtgtggctttgttgttagcatgtgtaatagtttacagataaggttggcgtgagccgtaaaatgtaattaagattatccaatgatatgatgaaatatatatacggcggcatacatatgcatgcatgcaagcaccgacgacgggcctgtcaaatcactgttgaatgaaaaggtggtacgactgctagacagcactccaatttgtttcttcattatggttactagacctgtctatagagttacttcctccgtctcaaaatataagggattttgtgtaaatataacacatcctagtttagtactataaatctggatagagaatgtctagattcttagtattaggatatatcatattcatccaaaatcctttatattttgagttggaggaaggatagatgcatcttgcaagcacttaattaattcgagagacacgtacaaactaccaataatcatcgatcggcccaaccatatcacacactgtattgtgcaaccatgccgcatattatgatgatattcccacgtagctaatatgattggataccatcgaatccatacaattaagcatgcatgttaatcacgtacttctgtctgtaacgagctactattacgtcctgtgctgtagttagtagtttttattgggctcaagaaatatgtgaagatatctaaattttacgttaaaacttctactacctcaagatgttatctacccgagatactaagtttcatactagaaaattataaggtaactctcaatacttttataatgatgataaaattaccatggtaataataaatgaagttaatgaaaattaccagctcgacggagatctcggcggcgagggcgaggatgtcggcgcaggagacaacgccggggcaggcgtcctcgagcgcggccttgacgtcgtctacgacggggaatcccctcgcggagttgttgttgggcggcgacgtcttctccgacggcatcccggggacgctgtccagcagcagcgacgcgtcgcacccctgcacgaagcagtcgtggaaatggagccggatcaggctcgcgaagatccgggcgtcgctccggtgcgcatcgatcagcacccgccgcacgatgtcgtacgcgtcggggcacgtgcagtcgtagtactcctcgcacagctgcgccaccgccgcgccgccgccggcgaccagcgccaccgccgccgccaccaccaccaccgccagagaggaagaagaagaagaagaagccgccattgctagctagctagctgctacacgactactcctatacggtcgtgtcgtgtgtgttccacgagctaacacacagcgcctctcctgatttatagctgcccaagtgtactgtgtgttgccgatccattatttgatcatttagctaggcagctggggcagctagctagccaaactaattactccctcctattcgaaatgtttgacaccgttaactttttagcatatgtttgaccattcgtcttattcaaaaacttttgtgaaatatgtaaaattatatgcctacataaaaatatatttaacaatgaatcaaatgatagaaaaagaattaataattacttaaattttttgaataagacgaacggtcaaacatgtactaaaaagttaatggcgtcaaacatttcgaaacggagggagtattacatttactctcatcgtttttacttatttattgttacgcatcaagttgctgttcgtatttttgtgcatcgttatcggttgacatggtagaatatgtgaaggataagtatatgtaatccaaatggcttggcaataatgctagtctacagagttgtcaaacttggtctcctctagactgagacctgactatgaccagatgactacttgtgcagatacttgcaaataatacgacatgtattattcgtgtgttgggtagtgtacctactggttttttccttaatttgcttttctttaattttaagaaactaataatatatggatatatgttaatctatagctagtggtacgtgttgtttatcttatctcctctagacaaggagcagtccaattctttgcaacgaacatatcacaaccacatgcatttactaatatgtttttgggagtgaacatgataatatatatgtttaagataaaacttattacatcatgcatagtatttatggataataccttttggcccaatctcacagctataggtttagctttgcttggacaggacaatatgcaagaggcagaaaacgtcactgtcatgtcttgcaaaggccaagtaaagcttcgtttcttttctaatcattccacggcggctatacattaatttatagctttgcatgcatgcgtacatgttagctagctatgatcgatcacacgtgaaataatggagttaattaatcaaagggccatcgtttgttcatattataggtacgtaccgttgtgttttaatttgtacatatatttctcgtaccgtatgatactagtacaaataaatgtctgctaaaaatctctatattttttcccctggtccgggaaagttatcaagaaatgctactagtaaatcattacaatcacgtacaaaacaagtttctatctgaatcagtagaattgatcatatcactactacgaaacacgttttttcctaacggccaaaatacttcttttgcaggtcagcgcgcaccccgccccgcctgctaccaaagccatgtaaaaaattaatccacgatcttcatagacatgccattatcgctcgttaaaatcgattttcatagacggccaggttaagtcaaccgactgggaaaatgattttcaatgaaaaaaaaaggggaaaagattatcccccacatcccattgctctccgcatgccgcaccaattttcatagatcaaacaacaaataaagcaaaacaggaagaccaattcatcataattgaaaatcaagttgctccataaaattttgtattcacaaatccaacctaaattcacaagcaaaaaagggaagcagcctatgtggagctgatgtaacagatgcaggaatctcatggtcacaagccatgcatcacccccatcggatccacttccttcaccactgctggtggatcataagctcccaatcactaccggcaccatatccatctcctccaccaccatccacatctcccctttgctgccgctgccatgtggaaccccgtttttataacaggaatcaatcgtgtaaacagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacatttcaaaaacagaagtaggtaaggcagcggagttaaggcagcggcacgccattgccacaggcaacgaccgtaactaagacctactgagcgccatcgtcttcatctccctcctggtagtaggcatagggatcctccgaagcttcatctcccacttctgattaattttatatttgcaagggtgagtaccaaccgtactcagcaagccaccacagcaatgatgcacacgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgggtcgttatggttttctgaggacgtccatattcccgcctctcaagaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgtgaggagttctggcgctcccaggaaagagaagtctcacacatattaaattatggtttaagttaagttctctctcatacactcatggcagtcctaccaatggcgacaccgatgtagggcacgcctctcggccctacctcaacggctgtcccatcgtagcgcacctgcctcactcaggggtgaaccatctatgcagggatactgcctccgctcgactatctaatccgctaggtctatacccattcgagaagtacggttgtacgggggtcgtttcatgcttaacttcatggctcggtccttaattgaccagggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaggtaattgcccaatcatatagcatttgataaatatgagtatgcatgattctagaatggcatttctaagcaattgtcataattgactagggactcatacgtaatcatggttacaaggattttaagggtaaacaataatcgaggcatggcataatcacaagtatgatgttcatcattgcatgcaattttatttgtaaacaaaacaatttcgcaattgggatcaacatgttcaaggaatggtgatgacttgccttgctaaaggtcttgcgggtcttggccttcacccggatccgcggctccctcggtttctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgatttcttattgaaattaccaagaataatccataatttatattaaattttgcaattctacgactataattaatctataattaaattctaattattttaaattttctaaacttccctaatctccctctaatctcctatttatttccttttcctttttctccctttcctttttttttctttcctttctttttcttttctttttctctttttctctcttttccttttcttttctttctctcctccctcccggcttctttctctcttcctcggcttctccctttctctctctctctcggctccctgctacctggggcggcgacggcgaccgagcaaggggaggaggcggcggcttaccaacggcggtggcggcgacggcggcgcgacgacgtcgcacggcgcacggtgcggcggcacgaaggcggcggtgcggcggcgcgagggcggcgcgacggcgacggcggcgcaagacggcgacgcacggcgcggcggctccggggcgacggcgcggcggcttcgaaggtggcggcgcggcggcacgacaacggcggcgcggggcacgaggcggcgacgggacgcgcggcgaccggacgttgacggcggcggcgacagcggcggcgcgcggctcggggcgggacgcgacgggcggcgacgcgacggtagcgcggcgcgacggcgacggggcgagatgactggcgagcggcgatgggacgggcggacggctcggggcgcgaggcagcgcggtacggggcgcgtcgcggggcgacggggcggcgcgcggcgcagggcgcaaggccggctagggcggcgcagcagcgatggcgacggcgacaggcggcgatggcgacgtcggcgcggcggcaggcgacggcgcgacgggacggtgacggcgacggcgcggtagcggcggtgcggggctcagggaatggccgggcgcgtggcagagaagggtctagggctagggaccaaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaataaatttgaggtgctaccaaaatacttttcttatagcgtatcacattctaagacaagtttcacttactttggttaaatatataggagtatactatatatacatgaaaaactaggcacgcttgcccaatggatgcaaatacatacattttgaacgttcaacgacatgggaccagtgctttaactagatagtgctataattaataaaaccgggcaaccggccacaagctggtgaggaagaataaacgatctggatagcttaatttaattttaaatcataattcttttttatcaaattgttattcttcatccatcctagcttcatgcagtgtaacgaatatatgatccttgtcttcacgtacctcttaattaaagctaagttgtgagctgttatgttacctctctagtcaatattgttatgttacctctctggtcaatatattactccattcgttttaggttataagatgttttgactttggtcattaagtttgactaagtttatagacacatataataatatttatgttaccaaattagttttactaaattaataattaaatatatttttataataaatttatctttggtcgaaaatattattatttttttctataaacctagttaaacgtaaagctgtttaacttaaacctgaaacggaggtggtatataggagtatgtgtgtacgtactgtacgcgtgcaatgtatttttgctatgaacgtagtacaatataggagtatattatgtggctgctatatatacacattgcagtgagcatactctggccacatcatcagccaattaattgttcatcacaaattaagtgatcatggatgcacattagcccacaaattaagacaaagatcgctactgttgtcttgaaagtggcttctacgtaccaagcttggatttgtacatataatgcaggcagacatagctaacaaggccaactggcatatagatggttggcagatagctctttcccgttcatgatatatatcgaccgttttcgttaaacaactaattggctgcattattcgaggtttctatatattatgctagatatatatgtgcacaaatgtacgtgtgtatatatatgttcacacatgtcaataaagcagaaaaataagaatatactccctctattttcatgttataaaacgttttgattttggttaaagttaaattactcaaaggctgtgttcgttttagcctcttcttaacccatctccatcattttccacgcgcacgctttttaaactgctgcatagtgcgttttttgcaaaaagtttctatacaaagttgcttaaaaaaattaaattaatccattttcgaaaaaaaagcaaatacttaattgatcacgtgttaatggactgctctgttttccgtgcggaggaaataagttcccaaccgcctgaaacgaacacaacataagtttaactaactctatagaaaaaagtagtaatatttataacaccagcatagtttcattaaatctataattgaataattttttataatatattagtcttgggttaaaaatattactacttttttctacaaaattagtcaaacttagagtagtttaactttgactaaagtcaaaacgtcttataacctgaaacggagtgagtactatacttttcgtatatagtcacagatttttttatatggtttatttatcaagtgtatatatatgatacttgttttctatttttcatgtgactgtttttattcttatcaatcactttttttcaacaattaatagaatattaggattcgacaacttgcatatctattaagtttcaacaaccagaaaaataaaaaaaagtgaatataattttgagtttgtactgaaaacttgcatcgtttttatataaagcaattttaagctagatttacattttgcaggtttagttgagtgataaacgagaaaaaaaaacatcgtgttgtgcaaatttagatgactgaaaaaaaagaaataaaatagataactgataaataactaatatggaaatttttattttttaaaagtatatatgtttgtatggtagctagccagcatatgcatacgtatacacacacgtgtgtgtacgcgatacacaaggtgcttcgcaaaggtgtttagagggcttttagctgcttcatttttttccagaatcaaaagttttctccaaacaatcttgcttcaggtccagattctagaaaattgtagaatgaaaaaaataaactaaaagcaagaagctgaaaaatctagctttttccgattctcataagccggttaccaaccagctaattctgagaattttaaactcctcaaacagctcctcaaactggctgattcttagaattctcagaattaattcgatgattgtaggttgttggtcagcagcgtcagattttaatcggttgttcgtatgacacattcgatcgcttgtcacatttctagacggtacgcgttgagcactggtagcctggtacagcgctagtatacataaatgtgcctcgatttcgctatctatcgagaaataattaattacacccccgatcaatatgcctgcctccactagttcttaatacatacccatatcatctttacggaaaatcgaactataactaattatgatttttttggataatatataactataagtaatgatagtgaaattgataccctaaaggaacttaattaatttgttgccctatcgatcggtacagaaaaaaaatcctaataatggtgaaatgggtaccaaaaggtactttgttgtccctgtcggtaaaccatacttaagtaacattacctctacgattccttgaaattttcgttatcgactaccaccgaaaagaataattagctgtaaatatatatgagcactcatgttagttaaatctaggatttattaatttgaacctaggtggagtggtttccttaaaaaaaaatctaattagctgagttacattcacttcgcagcaatataatggtcgattggtcgtacggtcgtgtgcttccatttgatttatgattgattaacgtacgtacccttcaaagtgagtggtccagtatgtgttgatctagccttattattggactcattatttttcctagatgccattgtataccttgaggttcatggacggtccttaaacactagcacgtgttatcttgttcttaaactttcaaatacaaattcagatctttaattaatccatcacaagtccaaaagtgtcatgttttctactccttccgtccctaaatataaggaattttagttggatgtgacaaatcatagtacaacgaaactaggatagcttgtctagattcgttgaaatatgatgtgtcacacctaaccaaaatcccttatatttagggacggatggattatcttttatgctactgccttttgtgacttagctacattaattttagttacttccttcatttcatattacaagaatttttagcattgcccatatttatatagatgttaatgaatctatatagcaaggctataaagtcttgcaatatgaaatagagggagtactacgtacgcaccatatgtttggagcactggccggcgggatctagttctcgacaaattcctaaggaaagaaaaaaatcagcattaatttttattaatgttttagatcacatatgttttaattatatttctccaaatttgccccatttattcactcggccagacataaattggtacacatgtgtgtaatagttgagtctaaagcattaccaacagatcgaatatataatccgctctcaaaaatttgttattgggtttttaaattgaaaattggaagtgaaaaaactcatctgagaaaacctaaatttaataaaaactaaaagtgagcccttgttattttttgcggtttttgcaggaaaaaagtgagcccttctattaaattaccaactaaaatctttgtttttccaccgtccccgcgcggaaaaagatcactcctccagccagcccacacgtgggaaagaaaaaaaagcttgcaggaaaaagaaattgggaacaggagtggtgtcgatccacctcaaatgaagagagcgatgaatgcggtgatagggttgccaaaacattactccctccatctcagaatataaagagttttagagttgacactgttattaagaaagtaggtcgaagtgaatggtggaggattgtgattggataagtaatggaggtaggtggaaaaagtaaatggtggagggttgtgattggttggaaagataatgttgggacaaatcttaagagttaaaagttgtaatatttttgaacggaaggaaggagtagtatcagcataggacatctgttagaggttttcttttaccaaaatccaaaaaagtcaagatcggggatgaaataagggtattgatgatgctataagctagcagtgttaattacttttttttaccaaataatgatgaactccaacccagctttcataaacgtttcaggcccttctaaggtctagctaggtacccaccgtgccatatcatgtcaccattcaagaagtcaagtgcatattttatttagcaattttactgtacttcaggaggtaccacgaggaaccattttttctatggacgtaactacatagctagtggtagctggtttgtctaccactctatctataagagacaccattcacctatacttcaaatacaattttctcttaaactactcatccgatctacgatccgattacaccgttgtgtttgtaacaattaaatcttacaacaagatctcacatcattatattttgaaaaaaatcacaaattacttttatgatatgtctaaattacttttagatttcactaagttacttcttagatatataaaagtaaattcagtaaagcctaaaaataatttacatatattatagaagtaacttagaacaaaacgaatgtaactttggcatgtcatttgaagtaaatccggtatagagataaaaacattactctatctagaaattaaattaatcagcacaaattatggaattaactaaaaacaataataaaagcaatcacctcagagcattatgaatatataggaagtattttaatcaaatctaaaaataaattatatatatgataatttgttcaatgaaaaaagacattaattaaagttactttcttttttgttataagttacttctatataatatatgtaaattacttttaagctttactaaatttacttttatatgtctaagaagtaacttagtgaaatctaaaagtaatttagacatatcataaaagtaatttgtgatttttcatcaaaatataatcatgtgagatcttgttgtaaagatttaattattacaaacgcaacggtataatcggattgtaaatcggatgagtaatttaagagaaaattttatttgaaacatagatgataggaatatttcccatacttacttaatggactagtactataataaagtaagattcttccatcaacacatatctagattctggataggcgtcgctagttatgactaaatcgagagtgctctcgaattagattttgtgtttttcaattataaatttggtacctcatagtatctagatactaacaggtaccaaattttacactaattttttaatacctcatggtatctactcaaggaccatagaattgctctttttttacagctataaattaagaaaagcaatagtacttactcaacgaattcgaaggataccaaaactacaacactactttaaaaaatgtctatagatgcaggtttaggaaccgcctgatctgacggaggagacggtgtgagcgccgcagccgcagccttccatcccgccgcctcccctgtggctggatttggaggaggggagggcgcggatgccgccggcctccactgccgtctccaccgggccaccgttgcctcctcggccggaccgccgccgaggtccgctacctctcccctgtaacaccccaggtaaccacgtacctagagtgccacaccaaaatatattcaaaaccattaactttcaaaattattagaaatttcagcagagtctcccctataaatacggacatccacgataggcagttataagataaatcaataacgaaataattcatactttccaaaccatcctagttccataaattccacataaaaatacgaaccagaactttaattgacctttacaagttctacgcaaaacttatactaagcagaatcataatctaaaacaaaatttcaatagtacaataaaatgtgtaatccaagggagctacttcttgcccatgcatgctgatctcaatgtgtacctaaaagcaaataaacacgagtgagtacggaaatactcaacaagtatattatggaactagaagacacgcatacacatcatgcgtaataaagcctgaacataaaactttcttttttggaaaagagtcacatttcaaacaccaagttaaaggcagtcgtagttcccattccaggcaaacatgaattaaaatagtagtttccatctcggacaagtgtgaatacatccgagcattttgccggcaaagccgagtaagcgtgattagcgcttacccacaggaatatgagtaaaaaccatatagcacatccatgactcacatggaacataaataattgaaactagaacaaagaaccaaattaaaaccatattgcacatccatggtaagcatggaacttgaactatttaaccaaaacctgaatctggaatattgaaacaagaataacgtcgtaaacataagataaagcttgaaatctaaatagcattaacaataatctgaacatatgcaatcccatatcacacaaaaatatattgaaaataaatagatagagcaaacactcagagaatcacacaagtagttcgtcatgcactcgccttttaacctcgacggcaacccgacgaaaccccttccacaccagatctctccacacccgtggagtaaaactacgcataaaccaatatattgaactaataatagttataagagatatttactaaaatcgaaaccacatataaactatttaccgatttatattaaacaacctatagcagttccattactgttttatgcgtaactctcataccgtctaacggaatctggcaaataatacaacttcgatcatctaaaaaaaattttctgcaactttcatgttgggagaaaaatcagattaagtctttgtaaatcccagattaagaaaaatgaattgttgtcccggtttttggacccggtcagcagtactgtttctattgtttctcctaaaccgtttatcggaatcgagcgaaaccagcgacgttaaaaagatatagacgatgactacaaactttatttaggacaactaacctgaatcccgatagtttaacaccagatttgaaaatactattgtcagcctataatcagcaagtaagaaaatactcaaccaacgatttaatcgattcccacgtgaaaattgtattttttttggactaataggagttaaccttgcagaggagaaaatcaaatttgaggtcaatctgtgaaaacccagaaaatccccaacttttgcctctcttccctttttccttcttttctcctcctgctttccctgctttctgaaactcctcctctctgttcgttgtagaagcacagcagtagaccagcagcagcaacagcagcaacagcgaggaacgttagcagaaacagccacaacatggaaacatattagatcggtggcagcagcagcagcagcaaggattggcggcagcactcaccaaggaggagtcgagcaagaggaaacaattagtggcgcagaggcagggttggggactggcgctagggctagctgccacgatccctggtttctttttttttcttcttttttttttacaagttggttaaatagagagcctaatgaagatcaaacgacgtacattaattcaacctctaggaccttgttcggacttcgattactctaaacttatactctattttgcactactcggcgagctctacgcatccacggttcctaatcgcctatttgaacaacggtttaaaattttaacttttgcgcgtttgttctaatatttcccgaaatacactaattcgatactcggggtatcaccacccccccccccccccgggcggatctggcagaggggagagcgcggtcgctgccgagattggtgagagagacggagatattagatatggacaggaggatggataagatcgagagatggatatggcggctcgctggctcggctcagtataggtagcattttttttaaaaaaaaccgacacctataatagattataggtgccagttttttctttaaaaccggcgtctattgcttaatggtgccggttttatgtgtttttagtctgcggatgaggggaaagaactatatatgacagttttaactgttccaacacctatagtgtcaatctctatgagcttttttaagtagtgcaactacatatgttgatagaggaatgtacagtgaactctagaccggtaagagaatcgatcttgaccatccatcctttctcatttagatccatttgttccaaatataaacatttctaaagtttttcattgagattaaggtgaagggataaattaaattaaacagaaaagggttttgattggttgagatatgatgatgaaatatatagttgcagaagttgctatatttagagataaactatatatgctagctagaagttgttatatgtatatttttttattacggagggagtatctataacattgccacccaattactgttagattatcagttttataatagaattcctaaattaatggttaaaatcatttttactgtgaattaatggtgacaataccggtagtattctactattagtcaagaccatggtaggttagaggaattgaaggcatgcttcactacgccagaccaagtcatctctgacgggcccaaaccctaacctttaacgggtttggtcttggtcagtgattagtggtcacttatgacaaaatcacctgtgatgggtgaaacacccgtcatagataactcatctctgaccggtatataagtcatctctgacgggttaaaacttgtcacccgtcacagatgtgtcatcagtgacgtgtcgtaactacctgaccgtcactgatgactaatctctgacgggttgtaacttacgacccgtcactgatgacaaagcaagaaatacaatttttgaattttaaacgcaacaaaaaaacctcaaaaaaatattttgaattttactagccatcctatacatggttacacatcactacccacaaattcacaatttttcacgcaatataacttgcatgctaaactatacatggttacacatcactacctacaaattcacaatttttcacgcaaatataacttgcatgctaaacgtgagattcaaactcaagacctcaacctccatagagagctcccttaccaactcacctactcaacacatattgactactcacccaatgttattattttgtctatgcttgtctgaatcatttaacatatatttaacaccctaaatgacttcaaatgaaagtattatcaactaaatagttatagatctcattgtgttttataacttttacatagaaaatatcttcatccgatgttgtttgaagaattcaaaatttcatttttcaaaatagatttcactttataacatgtattttgaacatgtaaactttgtcaaatgaaaatattttcaattataatgttgtagatctggttgagttctataactttgatatggggcatgtatccatccatgtcatttgaaaaatactcaaaaaaaaatttttaaacgtaagatctcatcacttgtaatgcatgttcggcgatgtaaacgatctctaatagaaatattgttagttataaagttgtggatatcattgagagctacaacttttatataggacatgtctcaatccgaggtgttttgtaaaatttaaaaatttgaattttcactcatcactgacgggtcataactaccacccgtcagagataacgttatatgtgacgtgtgttagttaaagacccgtcagagatgagtggtctcttttgtgatggttcataatactacacctgtcacagatggcatatcatccgtgacaagccatggttttctatgacgggttacaagtgtaagccatcacagatgacttcacatctgtgacaggtcctccatagtagccatatattgaagaggatatttttttggcccatcagagatgactcatctttgacgagttgcgttggcctgttacagataacccgtcactgaagcccggatttttagtagtgcttgtagctagacacccatttttaacatgcatgcatgtattatcccattatagctggccatattttcccacacaagaactttttgttggattttgtcggctataaaaattatatctgccaaacttcatgcttccaagatagactttacaaaatgattgatcgaagcaaacgccatgcaaaaatttcgtcaaattaaaacaaattaaacagaatacaaataccatgcgtttgaattattagagcacatcgtcaacattgcaatcattaaatattcaaaatagagcatatatatagaatcttctttggaaggcaacattgtagacacctctctttcactcggcgacctatagttgaacgagtctgcacatgtaaacgtaggaacatgtatgttgacacgtacgattaaatatttggccaacaatctctttcatggaactagtgttaattagtgcaccctgcattaatgacatgtgtatgtatatactaaatctatccatgtgcgtgcgtggtgcacgacagcacacacagccacaaaccaagtataatgataaaattagataataaatcgcgtacttagttctccattaaatttatatctctaattaagcacgtacttagttgccctttaaatttagtttcccacaggaagacggacacacacaagtgccaaaaggtagcttaggattgtgatgcacatccaaccatattaaggctaatagctagcatacttgtgtttcgatggagacaatcttgaaaagactagtaactgtttccctccgttataaatatgtatgctcacaaaatgaacacattaattagcccattaaaattaagttgagagaagtaatcatttaagcatatacttcctccatctcaaaatacaaggcacaaccattttttttctatacaagacgtgcatgcatgcatacattaactattacttcttggttttttaaatttgggttattttaatttctctaccattaagtcacccaatcacattgtttgcatgtatggatgtggttcaattgatgaggtgattaaattctttcttagtttttgtgtcacgagtggctgagccttatattttgggatgaagtaagtaaatacttttagtgcatagtacttccgcttcaatcaacacacgttgtagattgcatttgcaattaacacgactctgattaaggtgagtagaagtgatattttaggatcgaacaacaataactaagcctatcaaagagggtgaatggtagctacactaaaaaaaatttttagtagaattaaaatttaccccaatcgatagagatcggtctgaccggcttgattgccccggtctaaccgttagtccatcttggagaatagcgtctgtcgggccggcgaggatggcgggattccttaccgttgtctgagcccttgtggtggcgccgtggcaacaaagtggtgacgcggggaaaagcggcggtttcaccggctaggagaggagggggaaggcgtgcgacggccggtgatgggcacggtggcccggccatggtggcgcggcgcctggtagcggcgttgccgctttgccccccggggaaaagggagatggagccgggctcgggaggaggagtgttagacttctccttccgctagcctgggagaggaggaaagaaaaaaaaattgggctgttagggaggcaaagtggactttttccagagagggtgaatttggtcgaggaggctgagtttaggggaggtaaacatagttttatagagtaaaacatatttcacaaaggaacaatctttttaaaataagcttttcgagaataaatgaattttaggtttttaacaaggacatggcactggaataggaagaaaatttcgaattggcaaatccagcatgatgcaaatttttcgcaaagtttttggggatgagtttttgagttctcggattttatttgcgaatttttcaggatgttacagttaggtactcctaccaatgttgaacgttttgctagcacagtactactagcagtactcaaatgatttggttgtcaatattctgcaaacacaacagatgaaactgtagagatagttgcaatcttcagatcatcctgcagcatgatatgatatacagtatatgacccacccaatttaaggcacatacattcagttctttttttccaatggatcacatctttgttgacgatcagttcacaaactagtcacaatcacatcgttattacttctgcttcttcaagcattcatgtaacatcaaaacataacacacatcgtctcaatcgccttgtgaaaagtacaagaaatttactatcttttcaacacactgaagctcagttaattaacaaccctgcagttcttgcgaatctggccgtcgtcaccggtgagtgggctgatgttgcccatcttcaccatggatctgccaaaatcccagaagaacttgtgggcatctgcgctgtaagtctccaccagctccttggtgttggcgatgccgtcgtcgctggagaagaggccctggtcggaggacaggaggcctttctgattgaggaggttctggtagtagcggttgtcgaaaacgtaggcggaggtgatgtccagcacggtggtctcgttgccgtctccaccggcacagaggctctggaggttggcggccatggtggcgtccagcgtcgggtcggctgagcttgaggtggtcgacaaccggttgctgaacagcgtgcaccgggctcgtccgatcgtgtgccctcctattgatgatcaatgagtttcagatttccagatcatttaaaagtttatgaaatcttgaaatgtgcaacagatcattttataattgatcaaatattatctctgacggtttccaagtttttactgtagacagtatgaaaattcggaactgacagagagcatatgttccctgaaacatgggctgccactgtacagtttcaggaagtactacagtgtaggaagaggttatcttagcatataaaccagattctgaaccattcgtgcaccatgagatggattgatcactagtgtgctacctgataggacgacaacatcggttgtgtcgaggccgacatcattgaacttctgtatgatcgatttgatgggttcgaacggtgaagggaggccgttgtcagctcctgattgatttgcgacaagaccatcccttctaccgagaagaacgtcatagtaagggcctccactctgaacaaatgatgaaattttagcatacttgagattttcaaacaaagatgtacagtatcagaaagtgaaacaacaaggacaatgggtagacgtagactgaacatacaaatagtactccatagccagctgcaagggctacaatgtcggcgcaggaaacaacttcagggcagatgttctcgagatcttcctttatcgcgtcaatgacttcgaaccctctgacagagttcttgttgggaagtgcaaatttctcgccgtcgtcaccgtccagaaggatggaaccgtcacacccctgaaatgcacaacaaattttcagtaattgtgacacaactagtcaatttaatatgtatgtagaacattcagataaagttcagagatgtgtgaaaagggtagttaatgtatacattgacaaagcagtcatggaaatggagccttaggagggaggcacccatcctcatctcagtcctcatggcagcataaacatgctgctggacaacggtgtacacatcaggacatatgtagtcgtagaaatcgtcggataactggcatctcgcaccccgagtattaaggcacagtacaagaacagagcatacaagcatgaacctgtagctgtaagagtactccatctctcacagaagttactgccctgctcttgtgctggttgcacagtccatgttttcttgccatgttcttataggcggttaaagcgatagatcgatgaattatactatttccgataggcgaagtcggcatgatagtgggcggctgcgcatgcactggtctgatgctgctaactagttttctatccagatattccactttctgaaaatggctactggagcctggttctcctttctgctctgcaatggtgaagtcactaactagtgtaatggagctgcacttagcatccttgcttcctagtgctaaccagctttttgtatcaaatccaaagtggtagtgggtgttccaaccagctgagaaggaattttaacgtatcgatcgcagtttcgtgtttgatttgggtattgcagatgtctgaagcatgataagataagtggattgttcacttgttcagttaagtagtggcaacggtggcatgtttgcaatgtggggaaattcatctggcctatcaaaagattcagatgaggcttaaagtgcattggtgctgcatacgagttgtctctgcattaccaattgagtccagtgcaatgatgtaatcatgcattaattcatgcagataaagcttcttcagagtcaaactgattttttttagataatggattaaactggcctctacacccagaaaaggatgtacacagcccaaatgccatcctaatcaataagcactacagcgaatgactgattgattcaaatccatgaccgagcagaaactcaaatttatctcctttgctgaaaggtacaggttttcttgtacacgctcgtactgaaaaataaaagtagcaaacaatagatcaactctttcacttgtttacaatagaaccaaactgaactaacaattttgtcttcaaatctttacataatggaagaatctattactcttcaaattaatggcatcctaatcgaaaagcattacagagaaatgattgatcgagagtcatgtgagataagaaattcggatgcacgttggtttagtttcttttctttatttacatgttatctgtcttgcaattttgccggttttgctacagtcaacgtggtcgccatttgagctgtaattctttactcccagtgaattcacagagctcttgatttctattccaaaaataacaatgagaaaacataaattttcccgtgtacagaaactaaagaacacatgagctgattacaatttacagattcacaattcgatcagcaattctcaattaattgattgaatccttgtacttgtatcgctttgcgcagcagatgaacacgacgaggttgatcgagctgaggccggcgacgagccagaagaagcggtcgaggtggccgtcgtcgatgtcgtcggcgatccaccccggcgagccgcccctcgcggtggcatgggacacgacggtgacgacgacggagctgaggtagctgccgagcgagcacgtcatgtggccgagcgccgagcagaggctcctcatggagtccggcgcctggttgtagaagaactccagctgcccgatgtgggccaacaccgcgctggcgccgagcagcacgtattgcggcacctgccacgcgatgctcacctcgccggcggccgccagtcgcctgccctcgacggtcgccgcggcggccatggcggcgacggatagcgccatgccggcgccgatgcgctgcagctcggtcagccccctctcgctgccggtgagccgccgcgccgcgggcaccaccgcggcgtcgtagagcggcacgaggacgagcatggcagcggcgtagacggagttgagcgacgccgccgggacggcgaacgcgaccccgaggcggcggcgcatggcgcggccctgcaccgggaagagcggctgctggacgagcaccatgcagtagacgatcccggtggcccacaccggcagcatccgcacgatcgccttcagctcctccacctgcgtcaccgtgcacagcctccacggctgcgccgccgccgacgacggcaccgccaccgccaccgccgccttgtccaagaaactgaactggtcggtgtgcgccatcctccgcccctcctctgccggaccatcgtagaggacgaagccgtcgtgaggcagcacgacgttcctcttcctgacggcggcgacgacgacctggcaagctcggaccacctggctgccacgaggctggtggtacctgtacatggcggagccgaggaggaagctggccatggcgaggacggtgcagagggccgggacgccgaagccgaggagccagccgaagttgtcctgcagccacaccacggcggagccggagacgagggcgccgacgtacatggcgaagtagaaccagttgaagtaggagctcttcttgggcctctccatggcgtcgccgccgtcgaactggtcggcgccgaatggccccacgcaggacttgatgcagccggcgccgatggccatgaggtacagccccagggagaagacggccggctgggtgctccggctgatgaccgccggcgacgcccccgacagcgccatcgttcccatcccctgcaatcagtgcatcgatgatcgatcacaagagaagatttcaaattcgtttgaaatttgtcagaaatcattggtcaatctctttttgttgccgtaacaaaaaattgtttaatccattgccggttatcaaaatgcctagtaagttgctacagtattatcgaaatcggtagtgggtttttttattctactctggatagcatagttattatagacttactttggttatagaatctatatgtcatttctattcaatacttcgacttatttttattgtagtatctatgtgatttctattcgatacttcagatatccaccattatattatgagggagatgaatcccataacttcaatttgagcttaacttttagaactcatctttgtgaaacattttcataattaatattttagaatgaacaattagcattgcaaatcatttatttgatgaaaattagtgtggacgttggtataagtgcatgtcactagtgtaggccatgttgcggtatttgtgccctgaaacgattgttttgtctgattgtgtggaggtgatttgagatcaaaccttaattgatggcaagaaccgggactacgctgcaggaggacccgaggcttagcatggtctacatgtcatgtaacaagatcgtactagagtcaggattcttgaggtcaacatcagtcataggtaggattattggaagtaaacttaggaagcaatggaggtcgtgatgagattggataaggtgtcacatggtgaatggacaccgtgcgagaagtctttgtaaatggcttttgcatgtcgtgcggtgtaagtgcatgtggttgcggagaatgttggaagaaagaagggcatccagttgcatggcagctacagtaaatggagtactgtagctaaatatacatactctctctaatattataagttgtttgacttttttctagtcaaattttgttatgttttaccaagtttatataaaaatttaataacatataaaatatcaaattagtttcattaaatttaaccttgaatatattttgataatatgtttgttttgtattgaaaatactactatatttttcaataaatttggtcaggaaaaatttctatcaacttataatataaaacggagagagtacgtaatgtggatggatggcatggtacattttttgggagagcaaattaagatgtgaactattgtcattgttaaagaaagttgtgtgaaatcaacaagaatgattaaatcaagcttacgatgatgtagatggagaagaaggcgaggatggtgcggtatcggccgaggcaggagtcggcgacgatggcaccggcgaggggagcgatgtagcaggtgccctgccacatgctgaagttcctggctgcttctgcatttccctgccgcaattgcgtcgtcaggaatgtcaccaggctgtactgcaccccgaagaacgccaactgccccaagcattccgtccctgatgaattcatatttcacaacaaaccgaatttcaatatgcaacttattacatgaacctgcagatcgatgcaactggtataagacaggttgaaatgggaatagaagataaggaaaattggtgaaaaccatgtagcatctgtaagaattcagaacatggagaaactgaacaggcagcatggccggatccgtactaccaatttcaagaaactaagtgagctaaatggtatatttcaaaatgccattttttttattttaatagcacaagtatcatttttttttcatgtaaggtgttgtatgtttaccaagaacgaaagcacatg

SEQ ID NO: 8068 - DNA, 16849 bp, Oryza sativa
taccctgcagcaactgaacaattgttacctacgtgccactctgtaaattcttcatgtctgttcatccctagctgtcactatatagtagcatccatatcagtaaatttatatatatatatatttcaagaatttttctacaacaaaataaaataaactgttggggcacaaacatatcttctttctttgttttttttttgacaggagagaaaagcactgaactcaacgtaaccatgaacacaactttgtgacagtttggacttgggatccattctccttggaaaaaaaaaggataagtagggccgtttttaattcatacaaaaattactatgccctaccattttttttaaaaaaagaggaaatgtggtagcttcaattgaagccaaataatgtggtaccagtttcttcaccgtagtattaatatttgacttcattattgatctaactttacctacccaaaatttgtcactaccaaaaatttctggtagggctttaaaaccaaaatggcccgtcataattacttcaacatattcctcattttttgatgtgtattattccttttcacgagcataggtaaatttgtagcataccaataatattctttttagagtatttattttttattacacggtgacatatagggaagaaaacggtcagaaaatagcctcaaccatttcaataactttttttctttctgtacaacatagtcaaaaacagtaaaaattagaaatgagaacggtatctagaatatcaaaaaaatcagaaacgaacgaggacagggataaatcccaaacctcactgaattactgttgggagcacagatatatgtgtataatatttatggacaccttgattgacacgtgactttgccgtcattctactatttctttacattttcttcctcaagaactgtaaaagctgaactcaaatactctgaattacaatttgaattgtgcaggtagatttattttttcgtaaacgtgggaaaagaaaggaattaaccacatttctttggcacaaagaaatttatgttaagtgaaaagtcatctgaatattttttggaaataaaataggaaaagtgaaataaaaagaacagtgtagaaagagaagttgttcattagaaagcagaagcaggcagtcacctcattgttaagccctgcttcatctgccaaagcacccggtttgtttgtgtccatgtgtcttatcaagtgctgtatgaatgttgtctgtaaatgcacaatgcaacacaagcacacatgatgcatccatatatatactcaataatatataagcaagagaccataaaaaaaacaatgctattaagtctataaccaagagtaatgactctttccaaaaataaacaagaatgatgttgtacaggaggttacagcttcgaaggatcatgctaatgatcctcatgattgatcacctgaggacctgaaacacacgagatcgaattattgggttatttatgatactattagacttgttcacctcataattttttttctgatggaattgttcacctcatcattgatcacatagttaattaagctacacgtattgagatattcttgatcgagcttgttacaaccttgcagttttaagtagtgttcgaactgaattatgcaatatccttatcccaatcaagattttccttccccatggagaaaagtagcaaaaaatattgcagaaaacttcttgttgctgatgacataaacatatatgcaattgcaaaggctttcatctagaagatttaaccaacttgaggatatgtctgtctcaaaatgtgttgtgttgcagcactcgatattttggagacgacgaccctgtgataaagttaaacacaggttgtttcatcgtgttgcacttggcataatatcttgaacacatgcatacagcaagtaatgtttagttattgagtaattttattgtactttaggtattatgagataccaaaattttacacgaaattcagtgcctttcattacttttttttctcgaacgcgcaaaaggattgcacgtcaatatattagaagaaaagaatgtttgttacacgacgcaatgagtcagaccgacttatgccaagaaaggggagaaaaaaaagactaaaataaagaagagacgaaagactactgtgacagctacacacaactccaaatagctgggagggggcagagccactaccttcccaatagaaccccaaaattagtgataccagctaaagatcaaaggtggccctcagagaggatagactcaaggacctccgagaccgatgacaatgcagagtcaaaaactctagagttccgctctttccacagttgccaagagactaggaggaccatagaatcgaaactggcccggagatgccccggcaagccaaccctagaagaaggccaccaatcttggagacagctacctcggggaggagagagggtagtccaaccaagaggcgacagcacacggagccaaacttgccgagcgaagatgcaatcgaggaggatgtggttcgctgtctcaagctcttgaccacagaaggggctggccgaatgactatccaagccacgctttaggaggaggtcggccgtccagcagcgccgctgaaatgcaaaccagaggaagaacttgcatttagcagggcccttcgcgtgccagagaagatcggcacaggcaaaggagtgctggccaaaaaagaaggcctggtacgctgaacgcgcagagtagcgctggtcgctcgtccaacaccaaacaagacggtctctgacacccggcgagagctgaattcgaagcgcagcatcccaaataagaagaactgggagatgacagggacagtgagggccccgcggatgtccgaaacccaggagttgttcgccaggccagaagcaaccgtgcgcgaacggaggcgctgtggcacagcgaagaggaggtcaggagccaaggaggccactgagcggcctccatcaatccaatggtcagtctagaagagcatagattcaccattccccggcatgaagaaggtggacgcctcgaacatgtcggagacagactgctcgaccggggccttcaagccatcccaatagagatgcccggaacgctaaagccaaagccagcgaacgcgcagggcgaaccctgccaacctgaggttaggaattcctaacccaccgaaggccttaggacgacagacattcgtccaggacacctggcactgtcccccatgaaccgcatctgtacccgtccacaagaagacgcgtcgcttcttgtcaatagccttaacaacccaggcaggaaggccgattgccatagacacatggactggtatggaggagagaacagactggaccagcacagagccaccagcaagagtggtgagacgccccttcgaaggtggtaggcgatgagcgaccctgtccaccagtggctgaagagccgcctttggcaacttgcgaacggacagcggaatgccgaggtaggtgcaaggaaaatcagaaatcgagcaggggaagcaagagtgaaccagctccaggtcctcatccgagcagcggatcggagtaatcgagcatttggcaaaattggtgcgcagcccggatgccgcaccaaagaccgagagaatgccctggatgaactcgagatcctgccgaaccggggagaggaagaggaccaagtcatcagcgtagagggaggcgcggtgtctcaaagcgcgatcattaagcggatcatgaaatttgtcttatagttgtttcatctagtaagatcaaatcaaagaaactagcacaatgtttcttaatcatgttattcagaaacaatgagaaatattgaagggcattggaaaaatgttatttagtactcctttgaattgaaggggttctttgtttggattgaacggtttttggaggataattggatgattccatttcctatagaatttgccactattgattcatttggaattaatgaaggaatggggcatagaaaaagtggaggaaatctatctttgccatcgattccatagaaaattcataggaattttatatccattgggacctcttttattgatttcctttgagaagcccaggacaaatcaatgtttgcacctccaaatgaacatagtttagacacatcttgaacatataaaatatatattatgcacagttagcaggaattgataagtattaattgtttgttcggccagattatgttggactaattggggtaattaagtagaacaagtggattatgttatagcactgttttcatgggtaaatatattctcccgcatcaattagctaagatgatatctcttttagataatgagctaattaagaggatctgaccggaaaaaaaaacagttgaattaaaaactctaagcctagttgttccgtgtataaatatatgcatgaactggtcatttgagtatcatatatatagagcacgatttaattaatcacgttaaatatcgggtcgtgttttttatgcgtgttgtcttctaattttgtcacattaagcagctgggctatcattattctattttttctttcctttttccacaaaatgaggaaaaggatgaaatatacaatccattgatcaagcaaggacgcatttgcaaacgaccatgcctacaatctacaaagatcatataaagccagaaggtttcatcgtgtttatctatcttgcacatgtgaatccaaaatttggaataattcagaatgcagaatatggagataccctcataatagatgttgaaatatcttttcgcatgatttactctttcaattccgtccacttttactaacctagctagacttattctaatttcagataatcaaactttatacagtttgccaataattatatgtatagtagtatttagtacctacaagctataccaaattaataatagatcatatatctgattcacacaaactatatatactgaatttatcgtactctaagatacatattgcaaatcagaaatcacccatctgagcagttctttacatttttctcttttccaaaatatctttgcatattccaaagggtcatgaatttagtgcaaaacccaaaagaaccatctagtttgaaaataataagatataaacactgatacgtttgttttgcctttacggtagtctttgttggtagtagaagccaacctagacattcatcttctctaatctaatggattgtatatatttataacgggaaggctaaatggctgtcgaatgatttttgatagctaaatcattcatgttttaatatattcagaaccgttgtttcatatgttgtagtaaaatattacatgaggtgatttgattgtgtttcagtcttttaaaagattgaaacattttcgatctacttggtaaaacaacgctcgattggcttcgaaatttgcatgatggaagcctaaaaaatcatgcgaatcccatataaactttttctcgatgtactcggatttgtttcatgttttaatatatttagaaccatagtttcatatgttatgttgtagcaaaaagtttcatggggtgatttgattgtgttccagctttttaaaaagattgaaacattttcaatctacttggtgaaacattttcgctctacttgatgaaacactgcatgatggaagcctaaaaaatcatgtgaatcccatatagacagctatttataacgcacattacaattacaagaactaaatggggtttatgcagatttttgctaaccatagatgaaggtttaggaataggtcatcatttgtgcctgtaggctggtgtaggctggtgtttcagttagttctcttgttttccatcaaattgcgttgtgcaattcacaatcgttttaatgcaaacttcgtaataatttggttgtaacttattcagagcaaagactggaatggttcttccattatctaaaatgtagaattcataaatcaacaattaggatcacttttactagtgataataagcaaaggtacatgaaattggttttttagaatattacagaaattagaaaatggcaaagtatttattgttgtcctgctgttaattaaaaaaccgacgtttaaacatctaaaaaaacctccgatgaggtttacacatatcacaaatagcacatttataattgattcaaccctacactacataggcacttccaaggcaattttattactaggactaattaattaattagctgaaaacacacatacacaaaaagaaataaaaagtcaagtggtaggcagcttgcgtttgtaggtggcagcgcagcagacgaaggcgatgaggttgatgagctgcaacgccgccatcaaccagaagaatcgatcgagatgtccctcgttcagattctccgggatccatccgccatggccgccgccgccgccggtgacggagctgatgatggtgagcatggcggagaggaggtagctcccgggggtgaccatgatgagcgagcacgcctggcacaagctcctcatggcgtcggggctctgctcgtacgcgaactcgatgtacccaacgacgccgaacaccttcgccaccccgacgagcacgtactgcggcgcctgccacaggatgctcaccgccggagcatccgcctccacgctgcggaggcgcgccgtctcaacggccgcggcggcggcgagcgcgagaacggcgaagaccattccgacgccgatgcggtgcagctcggagaggccgcgcttgacgccggtgagcctgctcaccgccggcatgaggaccctgtcgtatgtcggcgcgaggacgaggatgcagacgcaggtgaaggtcgtcagcgacgccggtggcaaggcgaaggcggcggcgacgtggttgtccatggcgcctccctgctcgacgaacagcgggaagcaggcctcggcggtgttgaagattactccggtgaggaagatggggagcatcctcgcaaagatcttgagctcctccacctgcgtcaccgtgcacagcttccatggacgactagctgatgcttcatcggatgcagtgatagtggcagctcggtcaaagaacctaattgcaacaattagtgataaaaattcatcaaatttgatcttgtgttttcagttcactgaacaactcaatataggtacggtgaagattaataagtgatcaccatctgtaattttgtaagctgaaagtatgacttttagcaggattctacatttcggatttaaatttccagtttccatgctattgcattctaagatttagaaaattttgtcgaaattttgttaaacgacacctgccgttagcccgttacggcagatgatgcataatgaattgagatcagaaattgatcagaattggcagaatttagtttacctgagtccatcagtgtgcatcagcttcctgctgccaacaatggcagactccttccctggcatctcatagagcagagagctgtcacttggcacgtccacgtggaccttgcgaaacgccgccacgacaacctggcagatcctagtaagcgcgctaccgccgggtttctggtacctgtaaaacctcatactcgcaaggaatccgacaacgccgatgaccgagaacagtgtagggatcccaaaacccagtccccaaccacagttatcctgaacccacactataaccgtgctcgcgacgaagaacccgccattgacagcgaagtagtaccagttgtagaagagctccttctgcgccttctctgaaacgtcggtgtcgtcgaactgatcggctccgaatgtcggcacacatggccatatgccacccaagcccagagctgtcatgtagaggccaagagaggacaatgcctcctgaggaaaggttgccattgatctgtgcatgtttggtggaaccactgctgaaagtgtgagtagaaccattccctgaaaatgtacagtacataacacaaatgttcagacaacttaactgatattcagacaactttgctcgtattcagaaaaatatgaaaatgttgtgatctcttacaaaggtaaaggtggtcagggagacgacgattgtgcggtgccttccccaataggagtctgcgaggaacgcgccgagtattgtggtgaggtagcagttaccctgccaagcagcgatgttgctagcagcagtgacattgctctgtccctgtaccttggtcaggtagctcaccaggttggtccctactgcgtagtacgccaatgcgccgcaaaattcgccacctacatacaccgtgccaagaacatgttcttcactagttcaaaatgaacactgaaatgtgattgatgaacactgagatgttgggcagtgtgtgttattcaacctagaatagagtagcatgccttccatttcccagtgtgtgttttagatgctggattgcctttgacatcaactgatccattgcctgtgtatggaccttcctcctgcaaccaagcacaagcatttgattactcctacatttgattgttaggacacctcatcagatgagcaaaagagatcatagaatgaaaagaagttgcaatggtgaatttctccaggcaaatcaaggaaatcaaagaaaatgttagcaaccggctggcagccaaactccccgtccatccactgccgctgctcctcatttgccatgctctgctcgatcgccggcgacgaagcggacagtaagttttaaggagctcccacgatagcattaacaagaagcacttgccatgtcatttggcacggaaattcgtatcgttagaatataaaaagcaaactgcttgtgcgacacgatcgacagttgcagcctttgcagcagagattaaggttgattaagtacacttaataggtcgcgtgaaggttattgaagtgtaatgagtcatcgtactcaactttcagcacgccgactttcagggatcctagcaacttttgtgtcgaagtagttggacggcccgcgcaattgcgcggctagcatcaatgtaaaattatatatttttacacatgattttatttaaaattattatccccgtgactctaataattttatagtttttaaaagctatggcagtcgctaccccttacttctttggcacatttttatttgcttacccgatttaccactacttctattaatcctttttagaactttaaaaattaggccatatagtttttagagttcagtgtcttgttgggtttcgttttcataatttttagaagtatcgtcaaacatcgccaatttactattctatggcccgtctgctgacacctctctttattgtcattgggattttaaaaatcgaacacaaatattgtttgtgttcttttttactttctataagtttcaccaaatcgttagtagcttcgccactatacttctctatatcctacccgctactttccctccttattgtcattgagattttaaaaatcgagcatgattatcaattggttttatttttactcttcataagtaccgccaaccgtcgtgaccatgttgcttaacggcacacccatcgtcatttctcttaatcattattggggttctatttggggttttgtttataggttttagatatcccatcaaccgccagcactctactcctttacaagcctattgcttctcccctctttattgtcatttgttatcgttctgttctagatggactgttttttttaaacaaaattgcatatttttcattccgataatttttatttataaattatattcctacttaaactcttataattatttttctatttttgaaatatattttatttgttattttgaactttaattcatctcgccatgtgttccagattgccgcttatttcaatagtcattacgtttttattaaaacttctagttatttataaattatattctaattgagctcttatttttctttttctatcttttgaatttatttttattttatattttaattaatctcgtattgtgttctatatatactatttttaatattttttaatttttattttcaatttcaattgtttcaaaattttattcctacttgaactatctttttaatttttatttttctaattttgaattttatttgattttttattttgaattttatttaatatggtattggttttttatatggactattctttcaatatttacttatttttaatttcgaattttagttattttcaaattgtattcctacatgaactcttctctttttttctaacttcagatttaattttatttttattccgaattataatttatctcgtattgggttcttatatggattcttctttcaatattccttatttttaatttcgaatttcagtttatttttaaattgtattcctattggactcttctttttgttttctaatttcgaattttgttttatttttattccgaattttaattaatctcgtattgggttcttatatggactcttctttcactattccttatttttaattccgaatttcagctatttttaaattgtatttctacttggaatctctttttctttttctccgattaatgtgggaatttttagcccccactgcgaacgtggtgtctcttttcaaatatgttttaataatataatagatagagagatatatagatggcataaatactggctttggatctaggcagatcacattagctttcttcagtgttgtgtttcctgggctcttctgaagtcaaatcgttagtacaaatcgatatttattgattcctaattttcaaaattattaaattgacagaaagtaacgaagacttttaactctgaggtagggtttgttattccagttcaaaattttagtaatttcagaccccaccggcaaacttaaatatcccccaaaaatttcagattttttcaaatatttatgaatttgatcaaaagttattcattaaaaatacatgttaaaatttcaaataattgcgtgcaaagaaataccaaaactcctaagtagattgttttttttcgttagccttaaaacgataaattctatatttaactttcaacgtaatgtagttaatatctataatactaatgaaagagtaaagtgcacaagcgatgcaactcacatgttggcagttagtggaagctagtaatacttaagtggcaaaccgatggttgcaagggccatggaacaacaaacgtgaacttggtatcttccatggctctcttcgtccttagttcagacctcaactgattttctattcatgtatcccgcccaaggttcacaattctgacgaaaaccggtcgaattccataaaatttcgaagcttcgacaaggctcgaaagtaaaagccgtatgagatttcgatgagtttcatcgaaattcaaatttgaattgataaaaaaggaaaaaaacaaataaaatcttataaatagtatgatattcatagaacctattgggatataaatttttaaaaaaattgatttattccgtgtatttactgaaatttacactgggaaagaaaagaataacgaattaaaaaaaggaaaaaaaattcagtttacctcttttctagttaacgattgaaatttcgatgatttcgctcggaatttcaccaaagccgactggttttcatgagcttatcggtaaattcaagaaatttgtattcaaattttggtttataaaatttgttcggaatctaccgactttccaccggattttgcgaaaactgtcgttccgctagggatgggtcatgatttcatttggcccgtccaaataaggcctgagttacattgaacgatttggagcaataggttgttctggcccaacaaaaatataggaatactatcaattattggcatgtaataaaagacatgccaatacagtgcagtagtctatataaatgtgttcttcaaaaaattattataaactttgaaaatgccaacaaatatgtttttttatacataaaggagttttgtttattccggaatgccagcatatatcgatagcacatataagctcgcagctttaattctgcgtctgctccaaatttttcttagcatgaatcagtacataccataaataatttgaaactttctgtataaacgtgtgagttataatattctgaaatacaaacataaaaaatcagaatataagccaaaaacaaggttttaaaataatgttccggaccatcacatcgatcctaggaaagtaggaatgagttataaaaacgaacggctgcccttgcccttcccaaaagtacaaaaccatcctttcattctcttgtttttttgttaaaaacaactagatctgccaagaaaaaggaaatcaaagaaaaatctcaccaacaaagttcaactttctcatatgaaatataaatcaatgcatgcaactgaggaggtatgtttaaccatccgtctcaattctcaaacaaacaaacgattttttttaccctcgcccagaagaaaagtagaaaactaagatgaaagcagagacatgcatgaaaggttagcaatggttacctgcagagaaggtgtgccattgaggagaggaagaagaggtagtttggcgtcagtaatggagccttccattgtgccgaccctgctgtggctattttcctcttgtccaacaactctgcctcacaagcttacagtcctgagaatcgtggatatatataagcaattctcattgtaaaggtaagattaattagaggagcaaataatggaagcacctgaagaagaagaagaagaagcctcaaaagaaggacatgaaagaacgagggccatgccttttgtcattcttttgctgtataattaaagcgagtagggcaatgactgactagagccttccatgtcagtgtctccttaaaaatgtggaggcttggtactgtttggtgatcagaaatctgtgaccagagaggaaacagatcaataaagatgtggttggtaaatatttattctatggaaatcatagatgatgtgctatttgttatttttaatttttagatgaactagtctttcgaaaatttttagatgaactataaaaacttgtggtcccctatatggatggatactcatacagtacatattgtaacgaaatatttatatatttataaggtgttgtgtgcttccaattaaacaaggtagttgccaaaatatttatgaattagtactatcaatgtatgtcctggattggaccaatatggccgtgtttagttcgtgtaccaaattttttttaagtatatgaatacacatttgaagtattaaacgtagattaataagaaaataaattacagatttcgcctgtaaaccgcgagacgaatttattaagcctaattaacctgtcattagtaaatgtttactgtagcattacagtgtcaaattatggtgtaattaggctcaaaagattcgtctcacgatttacatgcaaactgtgcaattggttttttttatattcacatttaatgctccatatatgtgttcaaatttttaatgtgatggaaaagttagcagtttgaagaaaaaatttgaatctgaacacggcaatctcaagttgttccaagattagccatacgatccgtaagctattgaatattgagtcttcgagtcattataataatatagtagtactccattagaatccccgcacccatccgttcagaaattattaatgcgatcaataattgtacggaaccaaatcttaataagtcacaattaatgggcttaatgacctttttgttggccccatgcccagacactttcaggatgcttaattaaacaacactgctctacttgtgttctgattggttaagctatgtttgataaagtgataaaaatcttttatacgtgtgttattagtattttagaagttaacgtaggatcgaatcacaagaaatcctaatcatcagagggtgaaaagttagtatacccaaaaaccgaaaacttttacggaaataaaagttaccatcgaattcgacggagatcggtctgaccggagttgtcctgccggtctgaccgctcagatgccgtcggtctgaccggttgaggtatagatcaaccggtctgaccgccgaagctgctcgccgcgcctgtctccgccgccggtctgaccgccgtgcttccgtcggtctgaccgccgcttgccgccggtctgaccgccggtagatcgccggttagaccgccgaaacccggtaaacacaaatcgaagaactcttaaagtagatgacgactttattgattctctctctgtttacaaagtgcaccaacagcactccttacaaaaaatttcgactaaactcgaaaccctaactcaaaactcaactcaattgctctcaaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatctccatcaaccacgtgcatcaactctagcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacagtattacatacgtatagtatccatctagaagtcataatcatgaaataatcacggatatcgaaacaaacaacccgaaaccgaaactgacacagtatcggacggtcagaccgcgggctggccggtctgaccgcgcgcataccgccggtccgactggctaccagagcctggtctgaccggtcacatgaaataacaaatcctatgatcacctgtgaaatccaatcatctccaaaaccacttcgtgaataaattccaaataacaaaaccaataatctccgatgcccaattgttcatcacagaataataatcaaaaacacctttgattttacaatctcccccttgatgaacacattgtcaaacccataaaaaatgttttggtttttggaaaaaaaataaaaacaaaggtggtaaaagcacacttcgtacaaacgtacacatcgtgctcgaaaatccaaaagaaaacttctccccctttttaaacatgctcttctcaacaactcttcaaaaattcaccttgcttctccaaaaataactctctaaaaattcaccttgcttctccaaaaatccaaaaaatttcacattacttctcccccttttgacaatgatttcatcaagcataggaattatattcattaatgttcaagagcttagcatacatatagcatatcatgtcatgtgttgcaataaaaagaagatgaacccatctataatataagaagcatgcattaaagtataaccatgaaccaaagattttacaattaagcttgaatcaacaaccaaaattcatgatttcatacaatttataatgcaacatcttaacaagcacataggttgaagaataaacactaaatacatatacctattgcatttatcactctttctcaaataaactttagcacaaaataaccaagagaatttttgaaccttttcttttcttgagcgtttttgctcatatttttctcttttattccgggtacgtccctgtcgtcaagactgtttccagggattcagcacccattattttgctcacatcgaatacgtccttgtcgtcaagactctttccaaggattcggtattcattttttttcatattttgtactctctttttcacaataagcaattaaagctatttgaggaataacaattcaataaagcatatatatagagcctttataaatcaaaccatatgctagcatcaacattgcatatttgcttaattcaagtatagaatttaagtgtcatgcatcatctcccttaaaaacaaaatctaaatctcatgaaaaaactagaatacatacaaactatactagagacaaataaatcttcaaagtattgctagcatgcacaagaaaataccatatgcataaacaaagctcccttttctcaattttcattgtcatattattgcttgataaaaccatgaggtacaaactccccctcaaaccgtgccaaaaggatgaattatgcccaattcaccacgaagaaaagcaaagcgattagaatccaaaggtttagtgaaaatattagcaatttgcaactttgtgtccaaaaactgcaattcaacatctcccttctcaacatgatccctcaaaaagtgaaaacgaatatcattgtgctttgtgcgtgagtgttgaacaagattcttagcaatattgatagcactagtattatcacaaaagagaggtactttctcaaaagtaagaccataatatttcaaagtagataaaagccaaagaatttgtgaacaacaactagcagcagcaacatattcagattcagcagttgattgagcaacactagattgtttcctagaagaccatgcaatcaatgatttaccaagaaaatgacatgttccactagtacttttcctatcaattctacaacctcgaaaatcagcatcagaatatccacttaagcatatagaagatgaagtagaataccaaattccaaactcaagtgtatgattcaaatacctcattattcgcttgaccgcttgacgatgtgaagcacgaggagaagcttgaaagcgtacacacaaacacacagcaaattgtatgcctggcctagaagcagttaaatacaacaaagatccaatcatacttctatattccttttgatcaacagcttcaccatcttcatcagaatccaacacaactgtagaaccaattggtgttgaaattggcttgcaattctccatctt

SEQ ID NO: 8069 - DNA, 3662 bp, Oryza sativa
ataaaaagaatttaccaatatgcttcattttatcttaaatcaatccacatgatcaaaattgatcaaacttcctgtagagtgctttttaagtaaccatatatcacatctacggaaaaaaattaggtggttccattatttttacccattatatttatctaaaaaatcaccgattaaatttatcagttaagtagttacatacgtactaaaaattgtactacgtacatatgtacttacgcacaccaagccccacatctttcttttttcccctttctcacttaaattagatggaaaaccaaactaataattcaatgagcacgtgtgtcattaagcatctaagataagaaataatactaaatgagcaaccatcaataaatgataggtaagtagaggttaccatcaagctacagcaaataatacttgactacaaatagattgcaagtaagactaataacgttccaacaatcctaagatgacacgtaatgctttaataaataacacaaaatctaagaataaaagcaaaacaccttgccatcaatttacacttaaactggtggagcaattatattcaaccattatattagatctatctaagtaatcccttgctcctaaaaacaattaatccctccctatatacgtacatacacaagagatgtaaaaaaagagagtgtatctaccatttgccctgtatggtaggtttttttcagcgttagctcctagcgatgttatcaaggaagccatgtcatcctggcaccacttgacaccaccccgtcaattttcatgaatgtatttttttactaacgactatgtaaaaaccagttgggtgctcatataaacgcctatgcataaccatcttatgaatacacatacaaacattatctcctacaagaggaaaatatttgtaaaaaaaaccaagaaaaattatatagatccgagagactactatatattcaccatgaaaaacatacatatgtgcgtgcgtacgtacgtacatacatacatgcttacgatcgaaaatagcacgtggaaccacattatatccctttataattatgccaatatcatcttaataatgtcaataactagcataaacaattttgacaatataaattattctttcgtatattacccatgaaaatgcagaagtgattagatgcataataaaagaaaaaacaaaacacatattagctcgtatgtttgtgaaggatgatgataataaagtgatatttgtttaaatataatagacattatcatatagtatatcaaagtttatggtctattttacggaataaatattttttttattctaggtaatgattcttatagtgaatatggtgagatatcttttagtattctttttataaacagtaagtgaattgcgcgggcttccttgatgcgcgggcttccttcctagtttatgtaaaaaaaataaacaatgaaaattcaattaaaaaggaaaaattccatactttaatttcaacttattttgttaaaattatttccgaaacaaaataatatgtatacccgcgcgaatgtgcgggctaccttcctacttatactataaattttgttaataaatttccaatacacactctatatataagagaattagcaacttttgttttatatttccaatacacactactagtttctgttaaaacaacaataaaacgagaaagaatcatatatatacccaccagcattgtttttttttactgccaacttttattctagcaaaatctgttagaaatgtcttgaaaaaaatgatcattatcacccccataaatcctagcattattattgtgcatattagcctcaaattcgataagtacttgatcgttctacagcgcaacagttgatgtaaggccaaggtgaaagtcagattacgctgctgatcgagatcacctacatggtgatgatgatatgcatttcttgattaaaggatatagctttatttcatcaagtgaaaggtatagtaatatatagctagctatgtgtaaatgtttcctaatcagtctgttgatgagaacgacatgcgaaagctagctagcagcctaggtagtacaatgaaaatcatataccggctactgcaaatcgcctgcatttcaccgtggttcgttggggcctaggccctagaggccggtgattcagaaccgataagctaacaatagacgatcgacatacgaaagcgcttatattactccgtacctgaaaacttctccacgctgtttgacaattcgcgtgcacagtttccgttttacatatcgttgaaaccccctctcacgcccggcgccgcccgcccggccggcagcgccagctgaggcgtagacttcacctggaaaaaaaaattcccgtggagtcgtggacggacgacgacgcgcgccgccgtaaaccccgacctgccgccccggccacgtacgacgcgcgcaagcgaccgtgcaggtaacgccaaaatacaatcaacccagagccggtggatttttgccgtcgctcgcgtacgacgcgtgggccggctgcgcgcggcgaggaggatcgatcgaagactccacggccgtatggcgaccgcgtcaaataacgaactgtcacgtaacaggcggtaccgtaccatcgcgaggccggccgcagcgccgactgagactccgacggcttccgtgtcaaattcgggtgcgccccacaacgccgagctccccatgatttctcccgcatccgcacggcggcgccccacatttttcccgtgcgtcgccgcgtgccaggggaaaaagcccggaacgacttatcagatactccctccatctacttttaataataatatttcatcttgacacacagaccaagaataagtaattctacttatcatttatttaaacatgctactagtcattcctcgtaaacaagcgattcaataatatttacatttctcaaagcccatgtagctaatcatgtgtggaagaatggagagtcacgcattaaattcgagaaaatcattaagatggtaggttgttggattgaaatatgactatcaaaaataaaattttcagatttagaaatatgactatcaaaaatagatagagggagtaataactcaaccactcaactgagagctgacctgaccagtgcggtgcggcagtgcctagtagtacgtagtaccatcacttcttctacgtctcacgagcttatacaagtactctgcgttatatgtgtgtgtgtgtgtgtgtgtatatatatatatatatatatatatatatatatatatatatatatatatatatatgtgtgtgtgtatgtatgtatatatatatggcccatgccgatgtggaacacagtcaatacaggaattaacatatcccgtgttcaaagccaacgtatgcgtaacgttgtcagtatatgcacagtccaacggaagaccggtaatagtacaaatacgtgacgggccaggctaggctagctagctaagctgctggaaactgactgggtctacgctggggtctcctctaaaaaaaaaattacggttcacagatatcgcattcacatcccagagccggcccgggcctggccgtgactttgtttgaaaaggccaatgagaagaaagcgaaacaaaacaagcgatgaaatttaagtgttagatgaaaaacaatctgaggatatgaacaaacacgtagaaaaga

SEQ ID NO: 8070 - DNA, 3196 bp, Oryza sativa
atatagaatatcaagcaaaaacctaatatattcaaatacaacaatatcttggcataaagggtagatttaacatatcagtgaagcaaatagagataattatagttaaatcagatacgatcggctgaaactccgatgctattctaatcgacaactgggtggcaggctagagatcaatattctaagcacgactcaatagatcaaactcaattgatacagcattaagtatgaaaagaagaattatatctagacaatcaagccgctagaagattcatagaatggtagatatcttatataatctagatcaatgtcgacatctaacccaatcggttgccgtctgttaatagatgttagccgattgtgggttagatggcgatgttgctagagattatataagatatatgataactcggcgaattatataaacgagattagagtgtcatgaagatggaagcactaatccctaagaacataattcgtcacgacaagttttacctcttgttgaagatcggaaccgatgcagctcaacccgaaagcaagaactcgtcgaaataaaactaaagcaaaaggtggcgatgcgccggaattgtattgaatgtgtgtattgaatcttttttacatagggctcggggtccatttattcccgagaaatacaagatatgtccatattggacacgactcttatctctaacaaactctaaaatatcacaagtctttgcggtagacttttgcccaaacatatctctaaggaagttacataaaatatcctaattaatagatacaattgccttctcaggactctatctatgcgtggcaatcatcttgaagcacatcaactcgaacccaatgttgcacacgggtcgtattgtcgaaatcggctatatcagcttatctagttcaactcaatctcagccgatcctagccatagccaatcaggactccagccgattcctgctctgttccagaactcgatctccgcctccaactcttctttgatcaaatcccctttcctgatacacatgctaccaaatttggttgttaacacttacttagcaatctttttaattgatcaaatatacatatcttatataacacttctctgtaatatgtgagactctaatatattttaaagaaaagacctagtcaatatgaatcttaaaataacaatttattaggaaaaaatatagcttttaatcatattattataagaaagactactgattttgaattgccaccttagaggctcatacatgcaggttgtggtaaaacccatggagctactttgaaggataacaatttactgaattcattgatttgttattgacctttgtctcttggattgtttaatatgacttttatgaagagaaatacaaaaattttgaaagaataaaatattattatgatataaaatgagctatgtttttctataacgaaaagagtagattgattcaatactatcttacgggttaagtgctccaataaaatagttttatgtgtaaaagcttcaatgctacattgcgggttaagcactccactaaaatagttatctgtaaaaggatggcaaaagttattttcaaatatgtcccttgagtttgaggcaagaggctcgccacatacgaggctgcacatttgagccacatgtgaaaagaatactcgcaaaaaccatttgtgtagtagtatgatgaaaataattatttatacaattaataatttagaaatccctacgtgaaagtaatggtacttgtgcccatattattgtttgccaacaattgatagaaattgatagttctttctgttatgtagcataattggctagatcttttataacttattattgtatcgtgcagctgagatgcacctgctgattttttttcctatatgctgcattttcttaatgttgattaatggatgccttggtgcatgtgagtagtgacactatatatattccaaataaaaaagtctagttgagtccaaatcgattttggattgtggaagtttcgtgcagagtgcgtgagacttcacatagcctacgaatataattttatagataaaaataactctgcaatcataattattattgcagtgtgggcttttcatgattgccatcatgatttaaatatttttactttaaagtttttcattaaacattaggaatttatatactccaaacaatcactctttgtaacattcttttagctaacgtgcattaggcgtttagtattacacttacgtgtagagtattaccttaaattctaatagtcttcggagtataaatgtcttagaattttgttttttttttctctcaatatgtaattaatttttagtgatatatatctatgtgtgtgccagctggtttgcacggtgtgctcatgcaggttgtgcataatcttcaatgagaagcctgcaacatctaccctattttatcttctttgtttggtagaattaggcatttaaataatcatggtagtttattatgtccattgctataagatggcataggtacactggaagtaaaagttttactcgtgatgacgtgagtaaatctcaaagttttatttttataccatgtgatagtttttaggtttgcaatatatgtggttcatactatatatttttccttctaattaaacctccgtttatatgcatcgcacggccctatgtcccggtggtgcacacgtaaaatcagtttgcttgaactcgccggaaaacaaattcgctccaagttgtttgttgtttatgtatggtactatatatatatctatggcctgttctatgagtatgctcaagtatatatcaattgttggtttgttttaggcaacgaataatttagcacagcacagtataaatcaagacatatccatcttcataaagtcgaagttgtgttgtatacaatataaaatgtagctcgtcaaagaaactttttttttccaccatgacagcgatctcctgcaattgttggaggtgccatagaattttttttccaccgtgcatcgcatgcacgggggaggtgagatgggcttgaccgcttaaggctctaattaattagatcaatctaatgtaagtatgtaacggtggaggccccgattgttctctttcgatgagataaatccagtttggccctaaaataacatgtcatcaatttaagtgaaaattaaggatgagatgtttttgctttttatcataatttttatgatttttt

SEQ ID NO: 8071 - DNA, 11243 bp, Oryza sativa
accaccccatccccatctcccacaaatttgataggtgcaacgtttactagggagaaaatgttgtgcgaatcacataattttcaaaagttagttaacctatataagacatatgggcagactatttatcaaattattgaaatgaattatttactctacagtttggaaaatatgatttctgaaggaattttcttatactgatttgctcagatcatttattttaaactatttaatttaacagtcccactccggtgctttctactcggagtagaaagtaatctggaccctcaatcatatttaattatagggttaagatctagttctactcccaccagaattagtggaagtagaaatgtggaggggtgttttcgtctaggaaaaataattcgcgtaggggtattatcattttacaatccatagatcgaacaccatgtcatcctcgtcggagttggtcgtgcaagatcttaattgatccatataatccatgaaacaacgcagtgatcggaacggcaagaagacgaatgagccgagacgatgccgccacgcaaatgacgttgcgtgcgtgcgtgacgccgccgccgccgaagcccacgtcggaatttttactaccgccagaactcctgctcaagatcctcgctcggacgccgccacactcgtccgctcccatatggacaatgcgactgaggaggcggacaaggcggcgacggtgggagatacggacggcgacggtgggggcggacaaggcggcgaggccgggggaggaatagcgaggtgactgcgtgtgatggagtccggacctaatgcgatgcgaaccaaagaaaacatcccatgccaaaattacccctaaacgatattaggagattacttacctgcccttcaaaataaacggtcaagattaattctacttggagtagaatactgcaagtagattgcaccggagcattactcttaatttaaactatttaataagcttatttcttaaaatatttaatttatgtataatcaaaacgataatccattgtaatgatatgcgcaatagacacaatataattcatttaccggatatgagaattgattatacatcatatcaacgattttttttctctcaggcgccctctctatcacataatgtgattttctctcttttttaattccataattacgtacgtgcattcaaccagttagtgaaaactttgtatactctaattacctgcttaatgtagagatgtctattaataaattaagtataagaagtaaggattgtaaaatcaacctaattaataaacactactagaaaaatcatttttcctaatgtgggggtctttttttcgcaggcggacatgacccttgaagccaaatgaccgcctacataaatataaatcggggtgaagttcgttgtccgcctgcgaaaatatattttcgcaggcggaccacttaagcggcgcatgcgaaaatgatttttgcagacagaccacttaagcggcgcctgcaaaaatctattttcgcaggtgaaacttatgtggtccgcatgcaaaaatcgtatctaccaaaaaaaaaatctagagctccttatcttctcctccaaccccctccccaccactcatttccctctcaactctctctctctctccctcaacacatctctccccaccggacccgtcgtccccctcccctccctccctccctccccaccggagggggagcaacggcagaggccaggcgaagtgcggggctggccacacagtgcggagcagcgacgactacacagggggcggcggcggcggctcccatcctagatccggccggagggaggccaggggagggcaggcagcggcagcggcgaggcgaggcgcggggcgggccacagcgcggggtggcgacgacgacgcgcggggattttctagaggattttcacagttgtacccctacagacggtccttccccccgcttgagaaaactacttttggccgcctgcaaaaatgctttttttagtgaaaaagataaagtggttccacatgtggatacctcaagtccttaacctttgttagctaggttatgggcttatgccatttaaaatttttggtggggaatttcttcaaactatatttatcacttttttcttcaaagttaaaaaatgcgttggtatcttcaacctttccaccaatagaaaaatgacatgtgaaggcaagtaaccggccatatgccagaactgtcagctccagcaactctctactggtcaacctgagatgtgtattggttcatttttttcctttgcaccagaacgtcaaccaaactcgaggatgctgccgacaaggcaaatagatagtcacattttagtcgtcatccctgtctacttgtctagcacaaagttgccagttggtctcatctgttggcaataagaccaacgaataatacacttcgagctatatatacagcttgtaacttgtttcttttattaaacatatataaattaccgagccaaattttgattacataattaatgaacttattttgggacaaagggagtagcgtatattaacggggcatttaactttttgccacttttaagatgtgacaattaagaatttgccactcacagtttatgacgtatagactctcctgtatctatgacatgtgggtccaatgataaatccttaattgccacttgtaagagtggcaaatagttaaatatctccatattaacaacacgcaatgctggatggtttattagtgaatgattaataaagtattaacgattataaatttgaaggatggatttatttgatttttttatataaaaaataacttcaatatagaaaagttttaacaaaacacactgtttagcaattagcagtttagaaaacgtgttaatacaaaacgagtaaattgtagtttggagttgatatcgatacacaactgaagacagtcgatagagtgatcattttggactgtgagtgatgaaacgtgaacacttcttgagagtgttgggtgaccaacagtggacggttaatccggagtagcctttaatttgggcgaacgggcaagaatacagaaatactgaatccgaacatatacatgctccatacatctcatgcatgacgacatcagagtatggaccgatctgttaattaggtcgtcgctgtataaagtagtagaaagcttagcgtagcaagatggaaagcccgtggaccaaccagctaggcggcgagcggcgacggcgacgagagagataaagtcggcaggagacgacacggcgcccgttgactaagcggtctctctcgatcgtgtatgctcgcgcaagcagctgcactacggtgtcacccgcgcgcaaattgcccatgtcgatcacgagagagccagctgcgagcagcgggccccgccgccggtggagcggtggcgcggcggccggcccggaggatgacgacgaccacgatcgatcgatcggtgggccggggtttcgtcgttggtgtcgcgcgcgcgacgacgactgcgacggcgacgctagctggagctagctcagagcagtacgtacacgtcgtagccgatgggccagtggcgactcatccacgccaccgcgcgcaacgcaaaagtctctctttttcccacacggcgtcaacgcgatgatgcgggtcttcggcttgcgacaaaccggtcgcttgcgtatgattcatctcttcatttgatgagctaagttaaatgcttgtgtgtatatgtacatgttcttctttaatttgtacatgtgggacgatgcatggtacatcatccatagatgcgtatttttatgtgtaaaaaaaattatttcatcccaatcatcaaatatatttgactgggtggagtatatactaattttttttttaacttttggatgagatgatactcgtattgaactggctggtagctaaaagaaagtcctcacctgcgcgcatgccgctttgttaagtttctcgtcgttgctgtatggttcaaatttggtcttgatcagtttcttcttataatttgagaaatcaatgaggcctggcgtcgtttgatactttgaaaggctagccaaatatatgttggacaattcagtcaagttggttacgaagtcttcaaggttccatttggaatgccagtatttgtgtcaattacagtttacaacttgaagatgtaagttctcttttaaatagaggaatacacttattttaaggacgtgactacacaactagtgatagctagtttgataccactctatttatgagagattctatccacctatatttcaaataaaattttctcttaaactactcatccgatctacgatccgattacaccgttgtgttcgtaataattaaatctttctaacgagatctcacatgattatattttgatgaaaaattataaattacttttataatatatctaaattacttttagatttcactaagttacttcttagacatataaaagtaaatttaataaagcttaaaagtaatttacatatattatagaagtaacttataacaaaaagaaagtaactttaatgcatatcttttttcataggacgtgactacacagttagtggtaggcactccattcagtgtctccttttacttgaaaaatgcaatagtatatatcttttcttaatctctttaataacttatatcttttaaatcacatattgtttttaagatctatttgcatcattgtactccactcaaaatatgtgacaaaacgagatccatattgcatatattcaaacattttattaatttaaaagtaatttattacatgttagaaagtaacttccatgttatcatgaaggaactattacatcttatacataattaattctcattagttattccaccaatgttatttataatccatcaaaggttttatcttcttttctcattctacatgaaaaacaaaaataaaaggaaaaaaacaataggtgattaaattgatttatagagagttacttctgaacaatgaaaaagttacttccaattaacattgaagttacttttaaaaattgttaaacttacatgtgctaatctatgctgattaaatttaatttctatatagagtcatatttttatccctacaacgaatttacttctaatgccgtgacaaagttacttcggttttatattaagttacttttataatatatatgtaaattacttttaaagttactaaatttacttttatatgtctaagaagtaattcagtgaaatctaaaagtaatttagatatattataaaagtaatttatattttttttcatcaaaatataatcatgtgagatcttgttataaagatttaattgttacgaacacaacggtataatcggatcgtagatcggatgagtagtttaagagaaaattttatttgaaacctccgccacgtctaaggaaacatgccacgtctgtctctctcattctttctctctttctttttctcgcacgctaatggacgaggacaatgacgtgtggatgcgtggtggaatggctgggacggttttcctggcgtcgcgcgatagcgccagatcgagaggcctctcgaaatagtttttgcgttattttaaccgcatgccaataatatagcataggcgagagacgaccgaccagtgacctaacctatcgatggtcatggaaatcctgatacaaaaggagcatctatagtcagcttatggggatatgtatattggttgaaccggttaacaaatatcatgtttcgttgttgtcttcaagtttgaatatcctataacgtttttctgtgttcggttacatatataaattttaatttggggccgattttatagacactactgcacgcgattgatcgggagctcgagtgcaatacttcataaatgtcctagtcaatccacttcatttgacaaattaaacttgtggttactgctcttagttatctaaaagctattagctatctgattggtttaaacttttcgctggtgcagtatcagatatggcatgcaatggtgactgttgagcagtgacaatccaactatccaggagagtaataatggacaaccatgcatggatgcatgcatgaatactagtgtttaggcagcgctgtgtgcttgtgtctatatagaggtataagttggttctatttaggaaaaaaatctcaaaatttcttttttttaagataatggaatgaaacattcctgcctttgctcatcaaagctacagtcaattattataaagtatctcaaaaattcttgcaggagcatgaaaattttggcgtattaatttcaaacagcgcattgggaagtaaaataaagagacctgatcgaacgaaaaatggacaggttgcacactataacgggtcaaaaatttcggtgagagcggcgtttatctcagaaattaatgttgtagtagggtacccattccatccttgctactactagtacattttatgttggagatagagatgctgagatatatcgtctaaggggtgtttggaaactagggactaaagtttaatccctcttacaaaagtataagtccctaggggagggacttatatttttgagagaggggctaaagtctcgaagtcaacttatagttagttttattgcatactcggattcgctaaagctacagttgaactaccgatttgtacacacatatagccatcagtccagtgcttgaccaagtgaaccaatggattatccggtgccgtgctaatgcatgcatgaaccactggatgaaattaaaatatcactgcaagttagtagaaatgcgagaggatatgtcattgtgattttttttaaagaagtcgcgggagatttgtgtgtcattggataagaagatagaagaggcaaggttgacgaagtttcatcaattgataccccctaactgaccgagtgtcgagtgtgaaaaatatcaagtaaagtcgacaattgatcaaaatctacaccgtataatacactgctaaataatttcgtcagtaatatttttcacgaacggacaaacattactttgtactatcatatactccatataatgatatagtctggttccgtaaatagtttgatattatctacattagtgaaaaggggatcccaagattccaccagaatgagtcacgtcattaaataaatatgaaccgttggatgcatgatttgaataaagagaaccgttaattcaaaacagaaaaaaatcagtaaaagaacaaataatgccaagggatgttctgaattacccttcaaacacatcccataaaatatgtggtaacaaagatatgagaatgaaaaaacataccttcaaaatcattcttaattattaaaaaaaataccaataagtattcaaagcccaccgcccgactcatcaccgcacgtccgcgttccatgtccaggcccaccgctagatcgcgaacgagtccatattgatcacgagcgaacgagagagtcctcattgatcgcgagctcgtccggtttgtcatccatgcatcccacgcttgcatcggtctctgatagctgtactcccaacaattagacaaaaatcttattgggaaaagagatcatgtgggagtaaaacttagaaaataaagaattagagtctacgtaaagaatacattcgaaaatatatgaaattcagaataaaaacaaaaaattacaaataacaaaaaaatgatataagaatccatctagaaatacaatcagatattataaaatttggactagaacctaaaacataattaacattgatataatagtctatgtagaaatacaatttagaaacaactaaactttgaataaataatattgggagagtacacgtagaaatacaatttacaaatatataaaatgtggtataaaaataaatgttatagataaaagagttcttgcagagtacaatttagaaatatttttaatttggattaaaaataaataatattaagtgaaatggtcatcgcatatatataatttagaaatatttgaactttgggttaaactaagtattatttttttagataatggattatattaaacccggtctctacaccttgcgagggtgtacacagccaaaaccatagtcacgagtacataagactcctcccattacatagggacacacaaataaaagtttaacaaacgattaaagagaaatggaggctaaacttcaattcttcttcgaaaattccatccaaaggtagagaagaactccataactcgcttctccaaaattctgcacttgacttgagctttttctccttcaacttttttaagaagcaaagaccaaagccttgcccaatgagttgccttgaatattacctgtaagaaagaaatatgattatagccattaaagacgatgtcattcctaataagccacaaggcccaacaaattgccgctatgccctcccaagtttgtcttttgagtttaggttcaaaaccattcaaccaattaccaaacatatgagcgcaacttctgggttgtctaatccccaaagtaaaataaaccacactccatatgtatctagccattatacaatcaaagaaaaggtgttgtatcgactctttagagttacaaaagctacacaataagctatccttccatcttctcttagctagattatcctttgttagaatcacccctttattcaaataccataggaaaatcttaatctttaatagaattcttagcttccaaattaaagatttcctaggtattactccatcaaacataagtaacttatacatagagtttacgatgaacaacccttctttattagttttccatatgaattggtcaagatgacttgtcaggttaacattagccactttcgagacaatgacataccaatctgccaagtttttcccaactatcgctcttctaaaggacacattcaacggtatcgtttccaaaaccttagcaagtactgtattcttattctgaaccaggttgtacaagttaggaaattctttctcaagagatttgtttcccatccaacaatcctcccagaatctaacttgtttcccatttctcaccttaaagtgtccaagtaattggaatgattcttttgctgtcatgagactagcccagaaatgagaatctccttgctgcatttgaacctgtagaatggtttttttgccaaatatttttttctaagcaaattttgccaaattccctcttcattgattaacttagagatccatttactaagcatgcacttattttgaatctctaggttctgaatccataaacctccacactcctaaggtttgtaaagtacactccatttggccagcctatacttctttttatgttcatcacattgccaaaaaaatctggatctataatagtccagtttctttaagatacctttaggtatctcaaagaatgaaagcatatacattgctagactgcttagcactgaattgatgaggattaacctccctcctgttgacagaaactttcctttccagctactgatctttttttcgaatctatcctctaactccttccagtctttgtttgccagccttttatagtgcattggaaggcctagatatctaaaagggtaggaccctatcttgcagccaaatagaaaagaaaatgctttttctacttccttggcttttccgtaacagaacatctcactcttatgaaaattgatttttaagcctgaaagcttctcataggcacttagtaccattttaagatttttggcttcttctacatcattttccataaagataatggtatcatctgcatattgtaaaattgacaacccgttatctaccaaattcggtattacacctcgtgtcattcctctttcagtcgacctattgattagaattgccaacatatctgccaccaaattaaataaaattggtgataagggatccccttgtcataaccctttttttgtttgaaaaaaatttccgatttcatcgttgacttttacagctacacttccccctgtcactatctgctctatccatttgcaccaacgttccgaaaagcctttcatcctcatggtctgctgaagaaatttccagtctaccttatcatatgctttttcgaaatctagcttgagaatgaccccatctaacttcttcctatgcatctcatgtaacgtttcataaaggataatggccccttccatgatatttcttccttttagaaaggcagtctgtgaaggtcttatgactttttgtgctactagagcaatcctatttgtcataaccttagtaaagaccttgaaacttacattaagtaagcatatcggtctgtattgttgaatctgccttgcctccttattcttgggtagaagagtaataataccaaaattcaaattattgagagaaagattgcccctatgaaagtctctaaagactgccattaggtcatccttaattacctcccagaacacttgataaaactccgccggaaaaccatcaggccctggggctttattatgctccatttgaaagatagcatttttcacctcttcttctgaaaactcactcgtaagcaactcattttccgctacggatatttgaggtatatcatctttttggttctcacacatagagaaattattcttttcaggagctccaaaaagattcttataatagttagagatgtacttcttgagttgctcattacctttaattattccctcttcttggtctagctggaaaatcttagttttcctatgctttccatttgcaatcatttggtaatatttagtatttctatctcctacaatttgccttgtttttgctctttgataccatttgatctcttcttctctcaacatcttagccaaggcatgttttactgaattttttaactcgagctcttgactagtcaaaagtctagtttcagctagtttgtctagctcatctgcctttgccattaatttcactttctctttcttataagccccacttgtattcttcgcccatcctctaagaaactgacgaagtcttcaaattttattttgccatctcgcaatatttgttgcccctctaacatctttggtccaaatatttgctaacagtttttgaaagtcctccctaaggagccaaccgagctcaaatttgaacaatggttgactatccttgtgagaccctttacacgtgtctagcaacatgggggtatgatcggagagatctctactaagggcatgaacagtcaccaatgggtttttcacttcccactctgtgcttaccaaaactcgatctaatttttcatatgttgggtttggcatggcatttgcccaggtaaattt

SEQ ID NO: 8072 - DNA, 19880 bp, Oryza sativa
aggaacctagttttagccaagtctttaagacctctgctattccaaaaaattcctttcattgtaacccttttttctacccaacttgaaacctactctcccacgtatccttttaccacctttcctgcttttctttgggtatgatttgattaggatatcatcaatttcacaacttaggtgaaaatcctcatcatccatcacctcatccattgtatcaccacataaatggttaagcagatcactgtctacatattcctcctcctcatcattacaagaatcatttagtttttcaatagaaggagaaactttgtcacctaattcttccgatctaagaaattccgtctcttttaaaattaaaactgaatctgaaactaagttgctagaatctcctaggttcagtccaaagcatttaaattctcaacaatatgtgcttgcgaaaatgaaagaaatgaattcttagattcattacctgaaagaagatcgagattcatccaaaccttccttgatttcttcttttcaagggagtgcctcccgctgctgcccatcaacctctcactccctcttttcggggcaccaacacctcttctatgttagctagttgttcaaccttttcctgctgcatgactgctccatctatcttctcttcttccctctccaccctctcatactcctcccctagcactctctcaacagccacatccaacacattttcagccatctccaaaataacatcttctctcccttgatccccaccttcctgcacctcattttccttcctttccgagttttctttattgtcatcaatagccatatcatcattctttgttcttttagactccctctccttcccttcattattttctttgtattcctctccctctgaattaccatcctcctcatctccatcccaatcttccaaattaaactccacctcctccccattctcatcaacccctttcttttccacctcaaacttcaattcaaaataatggtcaccaatcaccacgtcaatcatttttgggatcaactttggattgagaaccgctacaaaaaacctcccaaactcatttttcctagtggttttcgtatcaactagctgcgttgcccccaaaagagagcccattgcccacagcgtcaagtactcccttaatttctttctcagcccaaaaacctttacccaaaccttaggcaaaagaaaaccttcctctttttcgaaccactcctcgaattctactcttaccccagtagccactcctccttcctttacatcagctctaccaaagttgatagcacgctgatttggaagtatattaaatgcggactaaaaataaaataatgagagaagtgtccgaacttttgcttatattaattaattggatgctcttctaggaacccatattaatcctacgaggtgaaaatagctacaagttaattgaaaattctttgaatccgtacgttgatcgaagaaaaataatataggttgaacatctaatctacactaaaaaaatacaactaacaaataagattggatccttagacctatactaatgcgacaatggagttcatagcatccaaaccataagcaacaacagcataataaaatataagaaaaccaatgataaagaattgttcatgacgatggacaatttttatttgaaacagattgaaactatctcgaatatacaataaaataagccaactttagtaggtgaaagaatgtcacaatagagataataagaaatgtcactaatagtctaaagataaagacggaggaagaaaacaaacaaatataccataatgtttttatatatgcacatataaagagttctctatggacataggaattaatatacttatctaaatattggtttgttccattattgtcgaaatataaattgtgtttccatttcaatatattttataatagaatgccaaagaacatatgctattatctgagaaaaaaatataatgatgctacccatgtaatagtatctatatgaaaattggtggttatcaaaggattttttaaaccatataaaaccgctatcacacccagttcaaaacataaaaattctcaacaatacggaggaaaacctgaccagtttcacagcgcttgagagaaaccggactcgaaggaaagtctcgatatatacagttcccaagtcagtatgcaactcaaccagtcaatgcctgttggtttctgccttgaaatgtgcatgcctctcgttatatatctctatctcgtcttttgattcttttttataccatgttgtgaaaattgaaggtgctagggaaccttgctttcgataggtgaacgaattagatggacaaaaagccattagacgacaagacggaataatagccatgtcggtttaggtgttcggagctttcaggtaaacctcacagctttcttcttatgcaatacgcaaagagaataagagatggatatatacatctcgtgactttggctcaggattgtgcgtcaccgtcgaacttgcagcctctaatgttgaacttggttgacaatttgacattatccagcaagaaatgacctaattccgtttagcaagaagtgaccagatcaccatcgcaacactttgaatttattttaacggacggactaaaaaacccacgcttatataagaccctgaaaacttagccacactagtaaaaatcaatttttactagcagagcattaagaaaaccgtatgaaaaatacatctatttttacaagtagtgctcttaaaatatgtcgtatgtaagagaatcaatttttagcggcggtgtcctaagggccccgcaaacaaaacttgtgggagagaataaaatagtatgtacatccccaccaaccaagccacggaaatcattttccccttgctcttttctttttttcctcggctatcaccaccaaccccggacctaacccctccctcaatcacttctctctctccctctctctctctctcgattcttcggcaagcggcggcggaaggaggtggcggtgccggtggtacgaggaggcagtggtgctcagttgtggcggcgcgggggaggggttggcccgcagcagcagccttggtgacgatggatcgtgcaaatctggcggcaaaggtggcacggtgaggcagtggtgcttggtggtggcggctgcgcgggggagtgggcggcttggcggcggccggcggcatgcttggcgatgacggatggtgcagatatggccctggcgagcctcgggagtggcgtttctaccgccgccggcctcgtctttcctcgtcaagtctgcggcgatggtgaggccattgacctagcaacgatgagctcgttcgtggcaggtagcggtaggggtgaaaacggtacggaaacggacagaaaccacctttatcgtttctgttttcatatttttttttcggaatcaaaatcggaatcggaaactccggatacgaaaacggaatcgaagattatcgaaaccgaaaacggagcgaaaaagaaccggtgcaaatatggtaataaaaatttatcggaataaaaaacccctcaaactgataaatccaattctcaagtcttaacggtcaataattcaccataaaatataatcatataagtccaatttttaagtctcaacagtacatcacaaaacacaatctatggaataaattatcttatgtttaaaagagtaatgctgttgataaatcccaatgcaggaaaaaatattcttatgtaacttcatatttgcataacaaatatttttaaagaaataacaaccaaacaccatggtattcactattcagtgcttaaaaaatcaagggtatttcagtctcaaaattttcggaaattccgagaaaattttcagaaagtttccgaccgattccgagttctgacagaaactgcccttatcattatcatttccgattccgtttccgagaaaatatttccgaatttgtttccgtttccaaaaaaaattccgaccgacagattccgttttcgaaaataggtccggaatccggaaagttttcgtaccgttttcacccctaggtagcgggcagatccaaggtcgagctctacggcagtggcgaggcctttgacccagtgacggcgacaacggcagatgtgctggtagaggaggctaattgggaaaaccatttattgtggaatttgtgctcattgatatatggatttgtattgtgatatgtttttgttcttagatttgctttgcaatgtggattgggaatacagggctactgcatctgaatattttcaattttttttcaaaacttctttgctggtggttagagagcaaatgcaatgcatattttcaattttttgaaccaaaataagcctcgcaggtggccggcttaatacatacgctagtgaaaattgattgtcactggcagcccacgtaacacgcacccgcaaaaatcgattattgtctgcggccacgtaacatagctaccatcgataatcaattgtcgctgatggttgaagagttgcttgtgaagaccttttattttctctggccttttgtcgcaggtggttagcctagtcgctagcaaaaattgattttagccgtcagaaaaaaaaccattttttaccgtgcacaaaaccttatttggaggagcccatggataaaattattttttactactgtacctcattttccacgcactactactaatactacgatttttttcagtcttgcagctcatgcaagggagcagaagcccaagaggccgaacaaaaccagcagcaaagacagcaacgcatcaaaccatttggcccaagtgtgacccgcatttcagcctctgacgcgtgatggtcagaaacgattgagataagttcactttaagtctctcgtcttaacaccgagtttgaattacatcatcgagccgtaataccaaatataaggtgtctctcaatttgtaaaacgatgtacctgaaatctcagacaatatagtgtccggttttagctaaagtgacgagtaggacccacgtggaccccacatgtcaaggctattcccaaaaaaatagaaaaaaaacaagtgaggcccacatgtaagcgagagaaaatggtgtgggccccacatctcttctttcttttctttttctcttctcttctctcagcgggcgtgcagtagcaggtgggggagaggcggccggcggtggagtggcaggcctgttcagctagcgtgagcatggacgtggccttgtcaggcacggtgagtagttgccacccggggacggtgagtagcgggcggtggcgcgggtggtgggctgccgcggtgaagttgatccaccgacgaggaggcacaacaccgagagcggcgatgtttggtcctcgtcggagtcaatggccggcaggcgcaacccgcgaggtttgtttcggtggcgacgaggcccgggaggcgaccgagagaggggattttcccattttggctcaatcatctcctctctcccgccgctgccgtccctagatttctagccccatacaggtgaatgggatggaatctaggcaccgttgctgatgttgttgctcctctactcgtggtgctcggtgacggcgtcaaggtacaacgggaaagggtgggactgggaggaggaggagtggcatccgaagaggggggaaagggcggttgtggcaaccatgtctgcaagccaagacccgcggagagagggttgttcgtgctggacgaggggcataaggtggtggagttgaagggtgtctagtagggtcgtgcctgtggtacgcggccgtgcccggcggtcgctgtcgtgccgacccgcggcaacgcgactggtagtggtcggcaacctttgggtgctgctgggagggactcgtgccccgtctcccgctgcctgtcgccagcaacctttgggtgctgctgcccgtcgcccgctgttcatcggccgtcgactcctctctccccctttcctcgtcgtcgtccctgcatgccgatcgggctgagggagtactccaggggaagcccttccaagttgcggcgacgacaatgtccgcgcggcgccggcggcactccaccaccggcacaccaagctatggtgggggcgggctcgaatgtggcggcggtgcgcgtggtcaaaacagctgtcgccggaagctagagtagtgggaggtagggcactactcccttcttttcttctcgcttacatgtgggcccgataaattttttaattttttttgactgactaggattcctcgttagcgaaactgcccatatatactgaatgagacctatttttcacaattttatataatttaggggtagagatttctgatattagatattagggaccttagacagactcgacgtaaagttgagttacgttaggcgaacttattcctttcctcatctctcgagtcctgggccacaatctgtgggaaggtctcagcgattaaggctcgtttggagcactggaaagatttgtgaatcctgacagaatcgaactgtctctaactattatcaaacttatgcaaaatcccaaaccaggcagtttttggtacacaaataatctgctcactatcatggcagctagcaaagtttgcttcctgtacttatacaatctttggtagctcgatcgccagaaaacaatcgccttaaacatcgatctgagaactggattgcgcaaaaacaacacttgagtgaaaaaaaaaagtcttcaactaactaaactaaggacctactatgtatatactgtatgaacacatgtatacagtacatgatattctgtacgtatacacgtgctaatcaaccgatcatgcagtagtgttcttggcttgctccagcagcttgacaacttcagccatggttggcctgttgcagggctcagactcgaggcacttgtctgccactttgaacaccagcttcacctcctccgccgggaacgacgactccagcgcgctgtcgaccgcgtgctcctccctcttctcctccatcgtctccttcacctgcacgtacacaccgattacccatgttggtatgttacaaacttaattaatcacgttattatcttgttttaatgattcgttgattaggcccaatagtagtacgtttgacagataattagtatacgcgtatttaattattcattgatcgtgcatgactttgtggtttgtagtacctggtgatgattggtcactgctaatgaatgatcagtctcagcaacaaaacactgtagatgatgtgtgtacgacatgaaatgaaatggatggaaagcttttaagttctgtttgacacggctctggatctaaaatcttttaaactgggtatttttaacttcacaaatatatgaattcgagtatgtgattacgttgataatatttagataaaatcattttgtttcattttaaatgaaatataagattttaaactttataacttaacaaacaaactttaaatctaacgcggatatagaatctggagctgtgtgatcttacccaggtcactagcctcgtgccgttctcaagaaacgactcgtccgtcggcctcatcccggtgaggagctccagcagcaccacgccgtagctgtacacgtcgcccttcgtcgtcgccctcccggtctcgaagtactctgggacgcacacaacatgttcgatcaaatgactgacagtggttcagagaagctggtgatgaggcgaggtgaggtgtggtggtcggacggagacggacctggggcgaggtagccgaaggtgccggcgacgacggtggtgacgtggctatggttgggcttcatgagcgtggcgaggccgaagtcggagaccctggcctccatgttgtggtcgaggaggatgttgctggacttgatgtcgcggtggatcacgtgcgggatgcagtcgtggtgcaggtacgcgagccccctcgccacccccgccgcgatcttgtgcctcgcctcccaccccagcgccctcctcgtctcctccttccctgcaaccacatcaagaactcaggatttccatggacaaaatcgccatagctgcttcgagttctgatgtgtatatgtaccgtggaggatggtgtcgaggctgccgttgggcatgagctcgtagatgaggaggttgaagtgcggggcggcgtagtagccgcagagcgggacgatgttgcggtgcttgatgtcgcccatggtgtccagctcgcgctcgaacccccggtccatctcggcgctgccgcggctcagcttcttcaccgcgaacgccgccttctcgccgacgcttagcctgtacaccgtgccgtacccgccggagccgatgatgtccttgttcgagagccccatgatcatggtcaggaacgacttggggctcagcgactgcatcgccgccgacctgaacatcaccatcttgccacctacagtacgtgatgatcaattgatcattcgcatcaacagagaagaattcagcaagaaaaacaagtcagaattaatctctgtttttttttaacctgtcaggctgttctcgatgatccgtttcttgcgagcccacttcttgtagagcaggaaggagatgagcatcttggacacgatgaacaggatagagcagattgtaatgtagagtgcaaccatggtagtatgcatcttgcaatcctgaagaaccaagcagcagctgcaactttgagcccttgatgactatatctatatgcaaaaaaaaactatattccccttgaagaattcagtgaaccctgaagtctgaacccaagaaatgaacaaaaaatcaagctctccaaaaagggcaacagagaacaacaacaaaagtcactgcatgaggctgtatgaacgagctgttctcagctcggaagcaacagagatgaatgaggaggccttcttcactgctgcatgggctcagctgctttggaatcagcaagttgtggcgatgtgatgtgaacatcatggagattggacacacatgtgagtgctgtagaagaagcacaggtgtctcgatgagcaagcagttgggcaggattgcatggaaaaagaaagtacattggccccaatcaatggggactggttggatcatgtgaatggcaggcagagtcatcgctcatgaacaccaccctttttattaatgggcgtgccaatcctaatttaattctgctactgtttatccaattccttttgttaatttcactgttgtttctttcatttttgtgtagtattttccatgaggttttacttttcagagaaggtagaattctactagtagtttcagaggtaacatcagaaaacaaccgcatagttactaacttactactgaatatccagattagagataatattagaaatttaggcatgaaactattttattccttggatctttttctgtctattgttagtcaaaacgttatcgaagcttgcgtgtactaattttggcggctgactctgaaactcgaacgttcacaatcacaaagccagcagttagatggaaaagcaatttctagtttggcagtgtcggtgaggtagggctcgattaatttgtcagtttgaagaaatttgtcctaagctgattcaattcgtcagtttgtgcaatggtgtacgagctaaaattgttgaaaaggctggccttgactagcttccaagaaaataggggtgttagctgccttttcccctgtgctgtgtggttgtaatcctggagctgcacaaggaccctgccgcctgtagtagtagcaacatctatcaaacttttgtttcaaatcacgtgatcaaactggggaagagctggcgaattctggacaataaggcaacgcgttgtatgcataattgcatgtatgtgtagtttttttttttttgaaaaaaatggttttctcacctaaaggggatagttatgataaattttaaaataaatttacgataaatgtactatatacctatattttttaataattatctatattgtattttagatgaaaatgtaggcgaagggacatcccctcgaggaagtaaaaacagtctccattttttgttctccactattgccatgcctatgcgttccaataagatctggatgaatatgcataggaatggttttatatataggttgggttttttttatctggtttatttggtggattgattttcacacgagaatattggttattgtaaagtgagttttttttacatgggaaagtgaaatggttagggtggggagaatggatgactccacttttaccataataaagataaagctaaggtgataattgtaaagtagattatttagtttaattctacatttctaagcactgattctgggtgtttcttaccaaactagcctaagtaaaatacatcaggaggatatcaatgaccatcgaccaactttgattatatcatgtttatttccagtggttgtgttatacaccaattaaatataataaaataaacttaatataatttttttgtgtggctttcataaaagtagtttattattacctccatctaaaaatataatgggtacatgtattttaatatttaactcttctaatatatgaccaacaattagtttaatataaactatacaccactgtctagctagccagaatttaagtttttctttggacaaaaggagtatttgaaaataatatcattgaattgagtttcgaatgtactttcctatgattatgttctacaaaggtgattttacagtgttcttaaagaggtatcaagggtatcacattctttctagtgtaaaatttagtatctcttgatatctccggtatttggaggtaaaaaattactaatattggagaactgatctttgttcggatggcaaaaatcacattagtcccggttcgaataggaatcgggactaaagaatatgttcagttctggtttataagcccaacgacactttatgatctttagtcccggttggtaaacacaccaactaaatatcatttttagtcctggtttaattgttgtcgagccgtgtcaagccaccaatgatctttgactaaagataaacactttagtccaggttgtttataccaaccggaagtaaagataaaaaaaatggaacgagatagccgagccgcatgggcttatctcctcgtcgtccttatcttcttcgcacggctgagacaaagaacccccgcttcgccctcctcctccccctcccctcgatctcttcatatggttgagactacggcgacggcgggcggcgggcgcgcgctcctcctccgcatccctctcgctcctaccttacccctcgccgccactccccctcctcctcctcctctccctggcggcgccacccgtttctctaatgccgtcttctcctcctccccccttccctccgtcctcgatgacgacggatgacggcgaccaccgtggccaagagtagcgaggaggtgcccccggcgagagggcttcctctgtatcttcacccgccgtttccacatggcccagagcgcaaaggagagggggccgggctagggtgcggaggcagggcggcgcacgacgataggtacattgtcttctctcctatactacgtctcatcttgtcagtcgtcacgttcttgttctcgatccgagtttttggttcgcaggattttgcatttttcttttcagttcggctcccgatgtggtgttcggtcggggtgcttcatcgatggaccgccacccgccgcttgccatctccccgtggaggctccgtccacgctcgctgctcgccgtttaggaatttggttgagatgagcggatccatgtttcttttcttccctagcggttgttcttgatgtgctagttttttcttgtataaatcctaaggaattacctaaggaatggttgattatattggttgttgtgcgatgcatcgatgcatatctttttaggtatttagggatggattgtttggtccgatacaagcagcaaaaaaaaaacaatgaaaaaaagaaataaaaagacctttagtttcggattgaatgttccggtttacaacccaggactaaagatgagtttctcagtagtgttaattacttgataaattaaaagtcaaaaactagttttatatatcacgctaattgtaaccatctcttatattttggaaaagaggaagtactatatttctcataggaatcttggaatatcccaagaattcactttacagacagggcgtttgcaccgcaaaatttcactagtataaagctttgatatatacgtgcatgtacatacagctgtcatatatagtatatatagctttagtacgcagttacacccactacttatatatactgatcaactgatatatatatatatatatatatatatatatatatatatatatatatatatatatagtgctcttgccactttgtggaaggctagctaggccccatggggttttaagccatatatctttgacctaactaagtgaccaatccaacaggagatcggcgacctaaaattgatggttataattaatcttggcaaaccatgcataggcacttataagccccggaattgttatacaggtcaggatatatatgttgtgctctagaagacccctgtgcccttcattgccgcaaaaaggttccagcgaaaaatttgaatggccatgatccaaaacgagggtctgaataatttgccatgcaatgcaaatgcaaggccgtcttttgtcacctgaaaacaagctagctaattccctccgtttcaccatgtaagactttctagcattgtccactgtatgtctatacgtatgtggacaatgctagaaagtcttatattataaaacagaggaagtagcttattagctgtacccaactctagccactacatcttgcaccgaacagacttctcaaaagaagatgatcatgatgattaaggagagcattaagctattaattatcacttacagtcgatcgatcgagccgtccatctcgcaactgtatggcgagcaggacgtacgagccggtacttttggtacgacctcctcgatcacatgtactaatcagtaatcattatccatctatcctcctgctcgccactacagtactatacgtacctaattagggggtttagcccctctctcctaaacaccccctaagctacctagcaaaacagcaatagcatatatatacaccttccggcgcaaaaaggatcagcttttatatacacgaatgtctagctagattcgtatataaagattaagtttattttaaacagatgaacgtatatatactctcagtatgtacgtaatctcaatctaatccgtacgtgtcttgtttgttgccgtggcaattggcaacacacaatcgatgctcagctcagctcgcagcagctgcaagcacacgttgcgatcagcaaatcacctgagaatgaccggtagagatcaacggccgtccagatcaggtgatcactagctgaattgcttgctcaggcatgcaggggctacctgggcctctcgtacgctaagcccctgcgtgcgtgtcagcttgtcattgtcatagttgggtaatgggtatatatgttttttcactttgcaggagaaattaaaccgagagtatattcgggcaaaaataatttctggtacgctcgagatcaaccgaaaccgccctgggggagccggacgaactcccagtcggcatcattccaattccagcatatgtgcaactgacgcccaaaatgaatcgttacatcgaccctatcacacccggtcggccgccaccatcttcccaagcaaatttacacccatatctctctctttggtaaatctatagctactgtactatatatacatgcacacacaagtgtatgttacaatgtagccatgtaggtgactaggtgtagagcctctgttcgtccgtgacaacttttacggtggtccctactggtcgtagtagaactggtgcggacaaccccatagcttttctatggttttgaactttgaggagctaggttgaagtagtagtactgaggctaccagctagcgggcgagaggggggcaggagaaggggtcgtcgtgggggagtaggtcgttggtgcggagcacggtgaataccatgagagcgagcgtgacggctacggagaggatggcgagcgcgagcatgagcacgctcgccgccacctccctcacctcctgcgcgtactccgccgccgccagcgccagaaccgttagcgggaatgagtacgcccaccacgccacactgaaccgccgcatcgccctcttaaacagtgtcggccgcgacacctgcatcatatccaagctattagttcatttattttgtttttaagttaaaataaaaataattaaccatgcttcatgacatgcattattgctttctaaagattcgtcttttttttcagctaaagagaattgtttatggcttaattgctaactaagcatgattagttggccgtgagtctggaggcactggcacgatacacacacatgcataaatatatattttagagaaagaggatgatcagcatacgtggcaccctagtggtatcctacagtcctacacgatcctagttggatcagttctttcccagccactaaaattaatgaaaacgaaaagcaaaaaggagatagatagatgcagagctaaaaagctgagggaaaaaagaacctctcagcgaaatggatggagcagaatttgatcatttcgagaaaatgcgcatcccccacttctcttcccccatcctttagttttctctcgcaatatctataaactctacctatatcatgcatctatataggacttctattttcattgtcaaatgcatcctaatttctaggggttaaaggaggaatctttgttgaaagttttggatcaatggagagcacatggtgctgtggttcttttagaaatgagaatttttatgatctttaagaatactagaaacaaatgcccgtgctttgcaacgggtaaatgttattttaatcttattattattattatacgatttagatatggtgaaattcactgtaagaatttacttatatttttttttagaaaatcataagctgtaattaggagtctgacttttgtctcaaattagattgcaagtttttttaaagaaatttcttatccgactccttttgtatttttaaaagcaaacaaaattaaaaaccgactcaaacaaagatgacgtaccaaaacaccgataaaaatattttcaattttttataatagtagagatagagatatgatactaaaattttacattatttaaaataagatacctctcgatattttttaaaatggtagagttaccctttagaaatggaatttatcttgagcgttggataaaaaatgggacggtttggatcggatgccatgctgactcatcacgttcatcctcggcgtttgcgtgcaaatgcaatataatggcgtaaacgcgaggcttttgctgtggagagctagcttaattaccagggaggcgaagaggaagagggagaggaagaagagcatcttgcagcaggtgtcgaaggaggccgagatggcgtcccaggcgagcgacgccatgctgggcgcggcgaagaagaggaagaacaccgggcggagcatcgccggcagcgagtcggagccgaggaaccgctggtacagcgtgacgaacagcacgaggtagtgcgcggcgcccacggcgaacatggcgacggcgccctcgtgccaccccatcctcgccgccgccctcgccgtcaccaggttcccgatcaccgtgatgtggctggccgggttggccaccatggacaggaacttcctcccccgggtgaaccactgcccgtacaccttgacgtcgagcgccaggatgggcagcgagaacgcccaccagagcgcgcggtaggggcgcgcgtcggggcggaggagcagcggcggcgccgcctgcagcagcagcagccaggagatccacggcgcgaagaggtagttcatggcaacgtggtgcctgaactcggcgcgcacggcggggaaccggaggaggcaccgcgcggcgtagagcgcgcacagcgccaccagggtgagcagcgccagcgaccagaggaggacgaacgccgccgacggcagcgaccgcaccacggggcccagcgcccgcgggtccgtcgacgcgtcgctcagcgtccgccacagcagcgcctgccccgacagcgccaggctgatccggaagtaccccgcgtggaaccgcgtcagcatgccaaacctcgccaccaccggcgccgccgccggtttcgtcgacgccacgccgccgtcgatggacgaggcggcgaagggtttaagcgaacgggacgaggtatccatggcgactcgactcgatcgatcgatcgatcaatgtcagtggagaatgtgttgcgtcgtgttaagcttttggaagtgagatgggtatttataggggggtacgtgacactgtgacggctagtgttgtgaagccagggtgcatgtgggtgaggcggtaaccgagggtggttgtttcctgcaggttttaattgattctggggttttttttctacttttttatttttttggggtagcaaataggttgatcagctagctgaaagatgaattatgctgtgatgtgaaagaagaatgcctatgcaatgtgggcaggttacttctgtggtagagactgggcttgtactttgggaaactattcttggcttatgtttcctctgatttgggagctagttagcccagttgctctgatttggctagtgttgtctacaatgtttgaacattaattcttcactatagaggttagtacctcgaggtatctgaattttacactaaattttttggtaccttcgtttcaaatcttacactagaaaatatgatacatctcaatactttttcaatgatgataaaatcaaccttctaaaatatattgcatatccattccctgccccccgtctctctcactctcaaaagtttttgtttcttgaaaattcactatataaaatttattactaacaattgaagtaaaaatatgtgtttagtttgatggatgtaatacctttatattcgtatttaaaaataatttatacgatattaattttgcaattgttaataatatattatgaactaaattaatggtcaatatatataatggtggagatcatataaaaagctagtgtaatacactttctatagcttaaacaattcactttcctctctcaaactattttgttggatcacttatcacataaatatttttttctcgttttccctcctgagctattaaaaactattcaattagcagcttaataccatttttcttctttttttctctttatacaattcgtaattcaatatgcaattgtttagccatagatgacaccattgtcaatgttttgaaatatttttaatctttttccgtaactgttcgctaaaattttaaaatctcaatgtttaaataaatatgtctcggtgtgtgcttccaatccatgcaaaattgcaaaccttggtaaaaagaatacttaataagagataataagttgtaatgcacctaacaaccctactaaattttagtgcgaggcatatataggacagagagaaataacgagagtaaactaaaccctttaatagtttaggggaataaatgagcaaaagaaaatagcttaagggttaagtgatccggtaaaatagtttgaatgagtaaaatagaattttttttcctatttttagaaaggagttagcactatactacatactaagcgttatttccaccagttagcaaatggatgaaattaacaccactggtaccgctacgtgctcgttaagaaactgtagccaattaaacaagaaaacatcacatcgtcgtacagctactactctcttctatagatataaaggattttggacggatgagatatcccttatgttctgggaaactgtagccaattaaacaagaaaagatcacatcgtcgtacagctactactcccttctatagatataaaggattttggacggatgagatatcccttatgttctgggacagagggaatagtagttaattaatctatccacacttctccatcggacagattaaaattgctactaggtacaactcactctcaagcctcccccaaaaaggtgatctctgtgctgatcgatcagaaaatccaccgattagtacataacctaattattaacaaggtcgaatcacgccgtgtatatatataccggaaattttatccatgatcagcgcttgcagcaacagcacggcgcacctcgactccagagtcgtcgtcggagtcatcgtcgccggccggtcgccggcgactttcttttaatttgcctgatatcgcggagacacaaccgatggaaaactaaagcacgcagcaaaatatgcaggtgcaggcaagctagctagcatgtccactttggcgtcgcattgtggcctctgcaattctgcatgtacacggagtgtgacagacagagatgaggttttgatcacttgcagatatgagatatactatcctatctctccaaatccaatggcaactacttcaccggcagtggaattggaccaaaaaaacggttagcacgtcctatgattgtgtgctagtaatgatcgagtctctgattcatcacttgtcaaatttgggcattcagtgaggattgaccgtgctgataagcattcaggcaagtggtgactggtgtgttgaaaagcttgcatataatgcacaggatgtatatgcagcagattcaggaagtcatgagaaatataagaaaaaaatggtaataattgcttggtgtcaaaatagagattttcttacattaatgaactatttgaaaatgtgcatttgtttttatttctagagagggcctgaatggtgaatctgcatagcaatatatatatatatatatatatatatatatatatatatatatatatatatatatatatatatatatataatgtggattaggagattctaagaagatttctggtgatgagttagtgcacacgtcatatatacggctcgatcacgacctgagtagagtgaccaaacaaacagcacttgatgggataattaggtagtaaaaacttaaacgcgcagttggcgatatatattatcaaaccgtcctatccgtgccgaatatatgtatattcagcaaacaggcttatcagaaaacgatgtttggctagcttcagtcagactgaagagctagctagccagcaggataacctatctgcagttctgcactttgcaatttgcatgcgcatatatatatataattaatctgcagagatgaggaagctaatggtggggatgtgagtggatccagctggttgtaaaatctgtacacaacaaagttactcgccgccatctgaaattctgaattgcttctttggttcaacgcatttggaggaagaaaagggtagtttccttgcacgataaaattgccatgaaacaagcaaaaagcgatcggaatacctgaatcatggtggcgattttgacctgaaaggagacggggacgtacgcagttacacattgcttcaagttgcgaaaaatgtgtagagtcgccctgccgtttttttgacaaattgacccttttcaaaaacttaattcgaaactaacccctgtcaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggat

SEQ ID NO: 8073 - DNA, 15194 bp, Oryza sativa
  unsure (1)..(15194): unsure at all n locations
acaatgtcagcgccagtcccgttggcgctgacacggccaacgtcagcgccaatgtgtttggcgctgaggcgacggcctatttttggttgaagtttttggcaggggttagtttcgaaataagttttccaaaagggtcaatttgtcaaaaaaaaacaggtcgccctgcatggctacgtatatacgagatttctagttaggcttatatatacagccagtagcaccgttgcaaagttgcagtaatatgtggaggtttcgccttttgtagtctttacacgcatgtcaaatgtcaaattagtacctgttatcacgtttgacttttgtaggtatcgtccaacggcggagcctaatacaggagtatttcttatcttaattacctactaattaattagatgattctatacttaaacaaattgtttggggggacggcgagttcataaatagttatattttggaacatataagtagtatatataaattttatatattatgatagtactttgcaagacaaatatatatatatatatatatgtgtgtgtgtgtgtgtgtgtgtgtgtgtataaccatttttatgttttctttggttaaaactaaacattttagtatcaaaagtctgtgaattgtcttaagcttttaatatatctgatgcttttatcccatcaagtaattttaattcgttggattccctaaataactaatttatttggactaatggattaattattaatgaagatgcgaataaaattctctaattttaataatatatattgtaacggtagtttaatttgactgaacaatggaatcaagaggtcaaagcagatcacttattggtcaattcagctgatagaaggctttgacctacctaccataaaacctgcaaaacctttgttgctacccctgtattgtgcgcatttatagatggcctctgtcatccacaagaaaaatgtatcagctatagatttcggacgtctaaacattttaaatttttcaatcacctaaaattgtactatcaaaggctaaaactaaaatactaaataatgtgtaattgctgtttattttcattgtgatctttgctagtctatatggatttaatttaatgttgtatcagcttgaatacttttatatttaagtcttataatgtcgtttttgatttgtaaatttgttttatgcttaggttgaacaattagttgctcaaactttttatctcaaagtggtaggtgatagtactggttagctagatttttcaactgatgatataaaatgaataccggtttgatggtcaacaattcaaatcgtttgatcaaatcttgttatatatgccatatatttatgataacgagtatttaaatctccctataattttttttctgttttaaccgaagctacataatggggttagcgggaggcttctatgtacatatgcgacagataaaaatcacttactccattttttaatatagataatgttgttgatttttggatacacatttgattaggtatcttacttaaaaaaattgtataactgcataagatataaattatgtttaaaatactttaaacaataaaatagctaacaacaaaataaattataaatacctaatttattttagtaagacgaataattaaacgtgtgttcaaaaattaataacatcatctatttaaaaaaagaaacttcgacaattcttagtacatcgagatagatacataataatcgaaggtatcaaattctacgtaaaaaaatataagtttgccatattaaaaaaaatggaaatggtatatatacggtacagaactagagagcgaggatggagagaattcagtagtacccagcaagtacgtagtgatcctacgtggattcctcgtcggagtggggcccagtaaaaccaacgcacgcactcagttcgatctctttttactcgtgtcaacatcgtacgcttgcgcgccgttgcgcgcggacacacacacccacacccacacccacacctttggttgtgtcatgtgtaccgaaaaagatcatccgctgccgcatggctcaaggcggaggcggaggcggaggtggagtggaggccgcacaaaccacacaagttgtgcgcgcgacctgtgagccagcactccccgactcccggcccggccgtatgtgtgtgtatacaccagtgtatcgcgttctcctcgttcggtgaagtgttaggttccggccggaaattaattaaccaaacgaaacgaaacacgtacgcgccttcaatctcttagccggcccgggacgacgtacgtgcaccaacaaatcgataatgcatgggagatccacaactgtagaatgcctcttttcttccggttcgtaacccccaatagttatgtgctgcaaacccggaaaaggaatccaggatgacgatctttagtcccggtttaaatactcggggagtaaatatgcatctctactcgtcaagcccctccgcgccgatcgatgcctgccgcgcagtcctctgcgccgccgcccgccgcgcctccccgcgtctgccgctcgcttgcccactgccgcaatcgcgcgtgagaggataggatagagagaggaaagggagaggataagaaaagagaggaggaggataagggaagaggtggttcctagaggataagtccgatagattatatactatgcaccaatttttaagtctcctctaaccgggaataaaaagagtagggggcgtgcactttttcgactagaactaaacatcatagaatagctgtgcggtttttaactggagctaaagatgatatttttagtcccagttcttttaggaaccaggactattatgatttttaaccgatccagcaaagatcagttctccagtagtgatcaatcagcttaatcgataatgaggctgatctattacagtgtttctgttccatgcaaccgcaatcaacgagcgaacgaagcatatgcatgccaaagcaaaaggaggcaaggatctgcagattgcagatcgagccgacgtggaacgtgaggccatcagcagccgttgcgccgagcatccacggtgcccggccagaggcgggcacaggggtgcggacctgcgaatctgcgatgcgtctgcctccccgtaccactaccaatgcaagttgcccagaaatgccaaaacccaaaaagcaagcggatgatgcaggggacggggccaccggtagctgtgctgtctcggcggcggttcaattccccggggttacatccactgcaccaaagcggcaaaatgtgcgtctcgtggattcttgtagttgtacttaattagacgagtaatggggtccgtttggattcaagggactaaaaatttaaccatacagaatcttaccatttaaaaatatttaataaattttatgtactaatttgctagatgaatatacaaggtatattaatccatgattagtaaatgattactatagcaaatcatggatttccccgcaaaaaaatcatggattaattaggttcattagattcgtctcgtaaattagcctggagattatggaataagttttgtcagtaatctacgtttaatactctaaaatatcaagattccggagggctaatattagccctccggatccaaacagggccatggagatttcgagcccggccatctgagcatatatattgcccgtgtccatttctcctactgttgtgaactcgtaccacatactatgttttattagggcctctcattgtttcgcttgtgattattagttaaaatttgaatatttagatttaaaattgaagttgattttggatgttttcaccgaagtttattttttagcttttgcttttatatcactgagaacacgtatataaaagttttatttataaactatttttcgtttacaaattggcttatccccgaataataagtgtgtaatcgaaattaggtggtgtcgcacactcgcggcctcgcgcgcggtcgtgcactcgtacacttgtctctgttgatctcgctctttaattccgtgtattatcttcacgtgttgttttgatttctctcatgggacgctttcagtgcatagtactactccagtatatagctgtgtgcctgtgtttagtgataagtggtgggcgcgtgcagctagctagctaactgtggcatcagcatgcctgccatcatgtgcatgcgcaagcagatctacgagtagtttgattcgaaaatgcgccaaaaggcacgcaattaagaaactatgtgtggcttcttatttggagaacacgagttaattgaaaaggtagttaattctttaattgatccacggatttttagcccacgagttttatctttcgttcatctggaactgataactacacactaacacacatgaccccctttctctcagttttaagtgttgatcggtcggcgatcgatcgctgcatcggtggatgcaatcaggcacgcaaggccccattttagcaccaaatcgatctaaccccatgaaaaaaacgatggattttgttgtagcagggggccaacgcccttcctcctatccggtcaaaacaccaaagcgataattcctggaaagtttctaagtataaaacagaaaaacacacttaagtgggaaaacactctcgagcagtaaaacactccctggtggaaaacactctcgagggggaaaatactctcgagtgggaaaacactcttgagtgggaggacgtacctgagtttgtttctcaccatttgcatgtaacctatcttgtttggagatgaattctaaatacatgacaggtgaaccttggcggctgggaagctggtgaagaacgtgtgagcccctaagcatagaagacattcggctagagaactcgaaggaaaaacgtatttcgagctaagaatgagtcgaatagaagattctgtaggggccacttcccaaccactcttgccagctagagccaaaagactataatgaccctgagaatgtatcataatatccttagggttgctgacatggccagggcattataggaagttcactaagcccatgagggcagaaatgtaatgtcacatgtaagatcgtatgctataaaagccggtcaaatacttgtagcaagacaagacatttttaatataaaagtaatcctcaaaggttgtgtttgttgttttgagcttatttctaagaatagacaggaaaacacttcttttcggcctattcccgatcttgttcgtgaccaaaggtcacaacagatttgatcaaaagatagtgctagtgttgcatacacatgcaaagcttccacagctggagggaggaagttacaaaagcgctccttggtgacaatactctaatgactaataccggcttctgcgcgcgctttaccccctttcttttccgatcaatgttagaggtgatcgatccacaaattaaagctagcagccagcaggagatactgcctagctacctacttagcttatctgaaaccatatcctgaacagcgaaagcataagcaagagcatgcatcgatcgatcgatatatacgtatgcccaaattaaagcacggctagcctgccgccccggccggttggtcgatctatcggagaacaagttgttggcttgttcccctagctgacgcgctgcatgctgagtcaatgtagctacgtgatcaagttatcacggtcagcttcgtcgacacgaggaaccgataccgaccagaactgggagagaatgcatgggtgtactacagaattaatgatggattatattctccgagatcaccgtgctttctatccctccagttataggccagacaggcgcagattatttcgccagcatcgtgcatgcatgcatcctagctcggtttcgatccgcaccatgctagctctgctctgatccgttcgttttcccggcgatttgcgcatagaatccgggcatccgtgacatctggtggtgtggtggtggtgatggagacgcgaattggcaggagcgacgcgggttggttccccgcgcatcgccgcgaggtggggcgtccagcgtccagcgtccgcgctcgcttgatcggatcaacgagaggcatcggttcgtagctgcgctggttggctggacgtctcaaccgatcgacgcgcgtgtgccgggggtacaatgttgcgggcctttgcggcacgaacgatgcgcgcggtgtcgtggggctactaaattccacaggtccaccggccggcgacggctgtagctagtgcctcgcggccgcggtgcgtgtggctgtgcacgtcgcgtcgtgccgggagaggccggggcattttccgctgcggttgggacgggagaggccaggggcgtgccatcgagcactactggagaaaaatgatctttgctagattgttcaaaatccacaatagctggttcaactaaaaattcacccgaattcaactttactcccgattattttactcattactaaagatgcagtttctcctatagtgtaggatcggcaacgacccgagagagatcgagaggcaacacacgaggtgaaattagcaaattcgcctttttttaatcaaacattagcgggccaacaaatgggcctcatccggatttcgttggatcaatttgggccgaatcttgaggtaaccagactaccagtgggccggagttcagtagggcaggccgacaaacgtatgttttaatagttttgctatatatttgttgataattttttcccaaaactttgtcagctgtaaatatacagtacaataatagtgtaattatatcataacttgtataattatagtacagcttgtatgtaatttttcaaattcccacggtaacatgtcattttcgtgaaccggaggtcatgggacttgctagtgtgtgccccgtgaaaaacgtctaggggttttccggttagctccacaaggtgataggctgatgatctggatttaaagtctcatccattctaattatttaatattagattcttccttaatattcgtgtcatttagtgtgtgccatgtgatttttggctttgtttgaccgccggctttctagtttcttcgtacaatcaagcgagggtgccggccactgtgtcaaaaggggaagcatattttgcccattagctggcattagggcttatcagtcttaatccagaccgagtatttctaatctaacggtcatccagcggattggattgcacgcagcaaaggagctgatctcccacgggcgaccgcaagtatattttgagcaagatgtttaacaaattgaatctccagacacttgaattcaatcaacaaatccaaaggaatattccagtacaaacgaatcatcaccatttcatcaccccagttccactcaaagaatcgtactttcaaaaggaaattattaaagcacaaaccacaactcgcgcgtgaatcgtgacaggcatgcatgcatggcccccgtttgaatacttgttacgcccttacgtgcgtacgtctgcgtcttcacctttgcacaatggcgatgcccatccatccaacacgcacgtacgccgatcgaatcgaatcgccggcgatcgatcagtagccggccgccacggcgtgtgtccgctccaccgggacggggccgcggctcccgctgtggatcgcgaggacgtagaagagctgcgtcgccgtcaggacgatcgtgaacgcctccatggttccctgaatgccaaactcccaaggtttcaattcacagaccattctgaaagaattaatctgacgaaatggggggaagaattgatatggccgggagatcatcttaccagcttcgcgttgcgtctgtcgagactgatctcctggcacgccagcctgcaaaatccatcgaattaacaagggcatccaaatttgtgttattattactctctccgttttaagttataagacgttttaattttggtaaaagtcaaattactttaagtttaactaaatttgtagacaaatatagtaatatatataataccaaattagtttcattaaatcaataactgaatatattttcacaataaatctatcttaggttaaaaatattattatttttctctacaaacttaatcaaacttgaagcaatttaactttgaccgaaagatactaatattattctacatcgtcatcaaactctcaagtaaatcatgtaagtgtaaatatataccccatggcaaggacggtgagcgcccaggcaagcaggccggtggtcgccgccggctgcagggagtagtagttccagtggcggatgtggctgaacccgacgaggccggaggcgatgccgacgacgccggcgagcagcgagaacacgacgaagaaccccgttgcccagttgccgatcgggaagaacatcgggtggaaatgcgccggcagccgcaatcccgggcctgcaaattaaatcattcaccaatgaacgaaatgatcgaattccctatactgacgagaaacttttctttgatgaaagcgcaaaaggattgcacgccaatatattagaagaaaaaaattatattacacaagtacacaacgcaatcagacaaaccaacttatattaggggaagggagaaaaagcaaaatttaaaaagactaaagaaaactacaacgactaaacataactccaaacagcgggaagatagtgacggaaagatttaatttagcatcttgtatcgttacctaggatgaagccgcgatcgatggagatgttgacggcccagccgccgatgatggcgaggatgacgtacatgcagaggttgagtatcagcagcagcaaggctacgggcttcagggtttcggccatctctgcaacctcgctagtacctgctaattaattaacacgaactggggtaatctcgctgatgataattctagtaccgagatcaactgcaattcccctgatgctttcagaagctgggacttggcttcccaatttatatgcgtccacggcgcattgcaacgagatcggatttgttctttgcttgcctctctcccaggattaagaacaactcacagtgatagctaagctcaaaaagcgatggagtttgggacttgctggcgaaggaaaggagctaagccgagttcttgggtgtacttttggtccgtgttggtgttcgtcctcctgatgcggttaggtatgtgtacgggtacagacgacgcatattcgatcggccatgttcgcggtaaattcatccattggttgattctttccgttgtgttcgccgttcggggtatagtagacttgtagctgggaattaagcccagtttgtgttggacacgggccgggacgggtcgggccgagtgggccatcgatatacagtactgggccgtggggttgaaggacgggagacgagccactccccgccatgtcaacacgtataatcagggggcggaggcaggcgtagggcagctaaggctttgagccctaggcctacctccaaaatcatggctaaattatgttatatcacaatgtaaatttaagaaaagataaacaactcactaattaagttttactttagccctactctttagtaatttctagctccgccagtaaataatgtgggtacttgaaatgcttcttgtttgtgttgtgtgttactcctacttgaaccgaactacacatccagcatatttaattacctcgatgatatgatgagcgtatagtttgcggtgcaagattaagacgccggaatcactccactcatctcaatgcagcgaatcttatgcgttctttcatcgttctgtgttgttttcgtaagaagcaatcgtgcgtgcgtacatgggccgcctgcgccgcctgtatcaatcaattaatactaacagttagggcggatccagcatggcacggtggggtctcaacgctcactcaggattcctaatttgcgtgtacgcgccgcgagcgagcacttctagcccacacggcctgtatgcgcagtgccaccagcgctgatcaagattttttttttcatagcggcatgtctaacgtaactaactctttaagggtaatgatgataattaatgaaagattttttttcttttttgagactttattactaatagatagaaaatttttaagttacatttgaaaacttttgacttaagatttaaactttgaagtcaaattttaaaaactttcaacttaaatttgaaaactttcaactcgagatttgaaactttcgactcgagatttgaaaacatttgactcagatttgaaaactttcgactcagatttgaaaactttcgactcaggtttgaaactttcaactcgagatctgaaaactttcaactcaaaatttaaaaattttcaactcaaaattaaaaaattttcatataaaaatcgaaaactttcaactcaaaattcaaaaacttttaactcatagtagtatttgaaaacttttaagttgatattttgaaaactttcaaatcgtattttcaaaattttcaaatcaaaatttgaaaccttttaactcaaaatttcaaaatcaattgtttttattttttattgagaaattactgtagcattttcaattcgttaatcactttaatatagcatcatgcgcgttgttttctttcgagaaaagcgctaagcgctactaaaacgaaggtccgcgtgcgcgcgacttatcgtcctagcgggtacgcgcgagctagccacccctctcaaccctatgctattggtgtggggatcatgagagccccacatagcgtacacaaattgttttgtcatatatagatggaaaataggctataaaactttgctctttttttcaggtcctcatgctatttctttctgaatctatcacttagcagcttgatccgttagttaatcatcatgaaggtttacagttatactaaatacttattgcagccttaatgatgtgtcctccaggttaacagcttagacgtaatcggccgtacgttatgtacaggttaattacacgtactacgaaataggtcgtttcacacacagggtgatgagatagagtgatcttggagctagacccaatcgatcaacatcgatgcatgatatgatcgaaatagcctggattctcatgcgtgttgacgtgtcgtctctcttgtctcgtgcctaccttaatttgtaggagtactacatacttttgtacgtgcatgcagttaacagttaatcacacgtacacgtacgccgttctgattaattatcggtcgttgatcgcacgctacgcttgatgtacgcatgcatatatgctttactggcatgaacatacgcaatgaagtgtgaatcgcactggtcaaatttggcataaacatagatcaaattaagcatttcggcgtaaagatttcttaattcagttccaagcagctagattcctttttgaagcctgcagggcacgcatttgttaggagtacgtagtacgtacgtgcaagggtatcggagaaaattaaaaaaaggaaaagaatataatattattggaccggatgaattctgaagaaacacttgcccaaacttgacacactttgagtgcagaaggaaattaagagacgaaaactgcctttaagtgaagagaaatgtaagatcaaagagtacgtcaaagtcaactagtacaaattgtacactaattaacccatggccatgtctgactatcaggctatgtggttagcactttgactgcgtgttaattaactaacaactactgtaaagtaggagtaagtacattcaacaacttaattagctgcaaaaaagtcatttcttttcaaattttctatgacagaaatattctacgcaacatattgtgtttgctagtttggttatgtactcatatgcttagcccaatatggttaatcataattgacattagtagaatttacttagttgattaaacttttggtaattaaaaaaaatcaatcttctggttcttatatatgtgtcttaaataagagcaatctctggtagttttcaagaaaagagaaatggggtagtgaaaatgagataaagaaaaccccaaaattaatcctgaaatcaaactctgtaaattcaaaatcagctacagattacaatacgaatatatagtttaagatcaatttataatattaattcataaccattttttaatgatcaatttatacatattaattttttgtgcgaacttcttcatattaaaactgaaattaccatgcaggcatgcacatgtggttttgtaaatactcctgccagaaacctcatcaaaaaatggttttctgcagcatatgtttataagaatttttataactaataagttggtcttatatatacatatataaaaaaaccttaataagctagaaagcagagaaaagctagcagattaataagattttcagatacgtgcgaatgccttaattaaccatgagccagcccaccatactgtaatttaaattccaagtttctgaaaaatacaaaaaagttatgtaggtaaacataatcttcagtactattcttgctgaaaatcagccaaacttaatgccaagtaactttcagaaaagaggattatttttttagataatggaataatctgcctctacatcgtgagactgatatacacagccaacttcagaaaagaggatgtatctgtatttagtaaaaggatcaaagaccaatcaaccagattatcaatctaattttgtttggttcttacgctagactagctagatagatatgctactgtttagcaggtccaaaacccaagaacaaataagtagaaaattcagcaaagttgactgccgtgcgtgtccagacacgtaatgtaccaatgcaagaatgtatgccacatgcaaatgttttttttaaaaaaataaatagcacatgcaaatgagtaatatgattatgattaattaattaaattggtgtttagtaactagctagttgctttccacattccagttgtaactttataagcattctgttttttattaagagctcaaatgcatcgactaatgctgaaaataccaaagaaacaaaagctatatataacgacagctagaaggcaggtcaacctgaccagtttgtgatccacgtaatcacgaatgtactgcagtcgtacatattaagccaatgacatttcacaactccctatatatactaacctagttatactaaattagttgatttctatagagagaattttaattttaaaaataattaaaatttgtaaattttatatcaatcagtagttaaattacaagagtatgtgcttggtttctaaaagtaataccttgtcaaaaaaacacaaaagttatatagacatgattcatatttctgagcaacggttttacactatattggttttctattgatcaaggaaatatttctgagaaatcaattgtcaatcttgagaattaacggccatagccctctaaaaatcaacatacctagctatgtcccaaaatataaaatcaaaatcccttacattttttagcagagatatagtagcacacaaaagctagtaaaaaattaaaatcatcgtaactaattaaattaaggatgagttaatataatgattaattaagtacagatccattaattggagatgtttcttttattcacaatatatcaggaaaaaagaatccatataatatttctctgtaaggtcatgtaattaagctgtacacgtacccaaaaaaacatataataagttacaacacattatttcgatttattgataccataagaccacttatatatatgtagtccaacaataataagaaacacataaataatgagacgaacagacgcaccgtagatccttaaatttgtataacttttatcatttttttttcgtatatgtatacttgtttcaggagctcaacaattgcaattttgtaaaacaatttggagtatatatataataggtatgcactcacgtcgtatatacgtactgccattttttttatttctctgatggatgtgtaggaacgaatttgtattgcatttcctgcctcgatgatcgcatgcacgccacgtacatgaatgcacacgccgccgccgccgccgccgccgtcgtcgccggtcgccggccggttagccggcgtagtcgcacaggccgaagctgcacttcttgctggggcagcggacgaagcagtcgccgcagttcttgcggtcgctgaggaggtcgacgcagtggccgccgcagcaggtctcgccgtacttgcagacgtggttgcagctgccgcagtgcgcgaagctggagccggtgtcgacgcaggcgcccttgcagcacgtcgccccggggctccccggctccaggcacaccgacggcggcttcctcttgcagtcgtagtacgacagcggcggcgagttcttcgcgctcgccaggaacctgctctgcctccttctaatggccgccgtctcgagctcggccccggtcccggtcccggccgcggcgagggtgagcgcgagcgccatgagaagcaccgcggctgttctcatggcggcggtggtggtggcgagcgcggcggtggcggcaatgcgtggtgtacgaagtttttgcttggcgaacgcctgtgtggagggaggaaaatgggggaggaaaatggcgggggaggagtgcttatagctgtagaaaaggcgcgagaggcgaaagtcagaggtcatatgcagatgcagatggttgatttgcacggcaaaagcctggagtgcagggagggagtgtgcgccgcacggatggatagctgtggactccgcaagctacctagctgctgatcgatcaccaccacaagctgatcaactttaagcatgcttgcaatggcgatctggctggctagctagcttgtgtgcgtgtcttctgaattccaggtttctgaacatgtgattaggcaaagctgcatgcatgcctgccgatcgatcgcacacgccctgaagattaggtagattaatctggtcgtggcagttgactaatcaccggaattacagtaacaatgatggcacttttaattacgtgaagagctagcgatagctagtgtgtgctactcttcgattgatcaacaaaataatttagccgtcgtcgtttccctccaggggcactttgtcggcgctgcctgtttagacagcagctgaaggaactctgcatgctggcttaagggaaagaagaactgcagtctagcatgttaccgggatcgtctgcgatgcacggcatacattggtctaggagccaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8074 - DNA, 258 bp, Oryza sativa
atcctgaacaaagaagagtaaaaacttggaaatctatgtgaaaattactgatccgaactcgttgttactgcgtctcgctgttggtgttgttgctcgtcgtgttgttgctgcttgtgttgttggtgttgctcgtggtgttggtgttggtgttgttcgcgttgctgttgccagctgccgccgcgtgctggccgcctatgatggacgtgatcgccgccgcgagcgccaccgtgaagttggggtcagcggtgatcgccgccg

SEQ ID NO: 8075 - DNA, 32380 bp, Oryza sativa
cggctgaatcggaggacatctgcaggccggagaacttggactggttgtacagcacctgcggcggcacggcgaacgccggcgccatccctccgcctggcagcggcacctggaactgcggcgccggcgcgcccggccgcgcggcgttgagcggcacggcgttcggcgcgcccggcggcgcgtgggtgaggtcgagcgtgaccgtcgggaacggggccgacgccgagatggtggccatgctggacgagcacggcagcacggtgcgcgccaggaagttggagctcatgagccccgcggcgccgtcggcgctcggcatggaccccgacagaagcatcgacgccgccgccgacgtggtggacgccatcgccatcgcggccggcggcagcgggtggttgtgcgtgccctcgtacgtggtgatcaggatggaccggtcctccgcgcaccgttgcacctgttggtcaattccgtcacgttcacaaagttagaccaatcaaacaacaccccttgcctacacggtagcactgctactcccagcccttcgtactctctacttctgagttttgacccgtatctcagtgagtcgtcgtgtccggtcattacctgcttccgcaccgggcagccggtggccatggtgcagcggtagtacgcgcgtggacaagggtttcccttcgccatcttctgaccgtacttcctccattggcacccatcggcgatctgcacggaaccaaaacgatttggaattcagcacgtctcgatgagaaaatgcctgtgatcgatgtggttgctagtggtggggtcttacgattggcgcttcggatcgcgcgcgaacggagacgcgggccttcctcatgttggcatcctgggcttgctgatcatggctcttgcccgccgcgccggcggcgcccatctgcggcgccatggcgcgtcccggcaaccacgccgccgccgtcgacggcgcgtccgggctgtcaccacgttcttggtccttgttgccggtagacgacgaccgacgcgggctgccggcctccgtcgacgagttggacggctcctccgccgcctcgccgccggcgccggaggacgggcccagatcgaggaattgcctcggcacgaccgcgccctcggccttgccatcctgaaacacacaccaaagtgggaaacccggttatttccactccaggtagctgtgtaatactactactaataactgtggtaatatagggtggttttacactaattattttacctggtgaggcggaggtggctccggctgggtcggaggctgcatcatttgaggcctttgctgcatgagcgcgacgagatgcatctgcagcgcctggtagctggtggtcacctgggtcagcatcccccggagccgctggttctcctcgttcatgcggcccagctccgcctgcatcgccgcgagctgcaaaacatcacacgagagagcgtaaatatcgagcgatccatccatgaccaccggtcggggtcagctcgggtcagatccaccatgctcgccgctgagctagcacggtcagggtcaaccccgtcgaataatcgagatcgcgatgacgatgaattttagttagctaagctgtatgtatcgatcaaccggccctgccgggctagctacctacctcgttgctgctccggctcttctcctcgtgatccggccgcgacgccgcgtcgtcgtcgaccaccatcgaccggtcgctcctcgcgttgttcccggcgggaagaagctgcaacgaacacggacgagcacacgcgttagatcgccgtgagttaaacaggtgtctggcgatcgacgagcgaagaaggcggcggcggctaacgttaatggtgaggtcctccttcttgatggcgaggccggcggcggcgggtcccttggcgtcgtccgcctcggcggcgacgccgcccgagacacggctcttcttcatgttcttcttctcgtcggagaagaagtccacctcgacggacctgcgtgccctgccgccgccaccgccgctgtcgtcggcctccatggtcgacctgtggaacggcggcggggagagcaggttcaagaagccgagcgggcgcggcgacgcgtccagagcgagcagcccacctcctcctcctccgccaccaccgaggtggcccttgtccatgcaactggagctcctactcctcttgtccttcttcccggaggcggagaagatagagaagagaagacgacgtggtagggagagagagataattaggggggagaagagagtgggagagtctgaagtctctcaccggtgggaggaggctcgtataaaaaagggaagcaccctcgactctgacatcaggagctgcgtcagtggcgaggcgcacacgtggcgagtccccattggccgacccgggagtcgacgacgactcgagcctggtgccgaggcgaccggatcgtcctttccggcgaggcgcggagacggctcgtttacgtgcgtgtctccactttagctttccgccttttctcttccggatcagaatcccaactcgttaagaaagcgtgagattttttttttccgtggagcggaaagcgaccgacggctcccgtcgtcgcaacgccaaattaaccaaagcgaggccccccgcaacggcgactcccaccccgcgccggtctaccggttttcaacatccatcatccatccatccaccgttgcgctgtcactcgcccacaccacgtagcttgatgaaagaggttttgtgtacatttgcacgggcagatggacggtgcaccgtacacgtccactccgccgctcgacgtgtcgatcgatcgccactactacggttatctcggattcgatctccggcggtacgagcgccgatgcaggtgtgcaatagggaagaaatattgaggtcagcatgtactgcacgaggggcgttttttttttccacggtcagaaggttccttccgtagattacttgccccccaaccgagaaaagagaaagaaacgcaggtctggattggtcagagacgagttcgggaggatcgtgcctgtgattgatcggctacagctacagggtcgcgagtccacacagcggactcggatcttaccctttctttattgccgctactaaaaactttctgagatcttctatggccaggctgggcccaccagtttaacgtataaataaatttgtttctttgtgtattttgctctgagttcgaggagggttagggtttgggtcaatgggtgcagggaccagttcttccaccgttccacgaaacctccgctcccgattgggccgccgggccgatccacgtggagaaaacgtcaacgcccttgactcccgcggcccccaccgcccaaaacccccccgggcccacaccccgagatgcaagtacgtgacacgcagcctctttttttcttttttcttttttctttcttcttcgcgtcgttttcggataagactgtcactagttgcatacttgcatgtcgaactgcaaataagcagggggatatatatacagtgggagaactggagaaatattatgttgtgggaacggtccaagatgcgatcgctggtgttttgttaatacacgaatctagctaaaagttggctcctgcctttttgataattgggataaagtcggtgtatgcatggcatatcagcatatgcttggacaatattggcatgtgtgaactttgagtttgtagggtaagtagcccacaaaagtttctctactttttagaaattaattgtttttgttggagagtggaggaattatataagacacatgcttgaaagagaggttgcaatttctctctcgagtccggaagaaattggtcctaatctggttgagttaatttcaacacgatgatagcacaaagtccaaaaggcaaggcaacgctatttcacatgtgcctatctacttatgctggattgttccaaatgggtaccatataaaagttttaaacagctactagttgtctaatgcaagttgcatactcaaacacactgtaaactaaaggtgtcgtgggaggtagaattgttctttagctgagaagtgatatcagagccgaagagttgaaaaccaagaacatctatattcaagattgcacgatcatgcacgagacatatgaatcaatatgatgggagagattggtgagattaatcccacactgatttttatttaatgtagttctatttgtctccagtaagtcgttataattggtttgtatgtgtgtgtcgtatgtccggcgaagttctggaataaaaccatttccactatctaaataggtaattctaataatgatagtaattttctttcaagaaaaatctagttgtctcatatttaattaaaaaattgataagttattgacgatcgaaattttagaagtttaactaaatattgtcctaagcatcagatatattttagtagagtagtagtagtagtagtattttcttaggctgtgttcgggagtgagggttgtgtgcacgcaaaacgaaatagtgtttagcacataattaattaaatattagctaaaataaatttaaaaaatagactaatatgttttttaaaataactttcatataagatttttttaaaaaaaacaccccatttagcaatttgaaaagcgtgcgcacggaaaacgagagaaatgagttgggaaagtgttaggctgtgttcgatacatggggttgggaacccatctccttcgcacgaaaaacggagcggtccattagcggcgtgattaattaagtattagctatttttaaaaaaatagattaatttgatttttttaagcaactttcgtatataattgttttttaaaaaaaaacgcaccgtttagcagtttgaaaagcgtgcacgtggaaaacgagagacaggggttgggaacaccctaaaacgaacgcagcctaaaagagaatatcaagatttattgaatatttagtccctcctggttaaattttacatgttatccatgtttccagttggttggatgattttttttttcgaacggtaatgttgttgccgatattttatattaagaagaatgtgtctcattttaagagggttggaagactacttgtttatatacaggttagagctaattctagcctatttgattggtttttttaaaaaaaaatcgtgagttcattcttattgttgaaaaaaagaacatcgtggttgattgactttttttagttaaggcttatctgaactgtgtagaccatagaaatttcaacgaaaataattttctcaggactacaatagtaaaataccctccttgaatcggtgaagatggaaggcatagaaatttcaacaaaaaataatttttctcaggacttcaaaaaaaaaattagcccactgaatcggtgaagatgggcgacaaagtggaggccgccggcgtgcatgacccgcgagtatacgtaaatacagtggcgtgcgacgagtcgacgacgtacccacacgccgagtccgcgacacgacgcccggtccgacaccccgccagcggccagccagtcccaagtcccaaccgactgggacccgggagggagttagagcactactagctctaatttttctatagctaatctaatagccaattcatacaataattgcttactatactactccctccgttttaaaatgtttgacaacgttgactttttagcacatatttgaccgttcgtcttattcaaaaaaattgtgaaatatgtaaaactaaatgtgtacatgaaaatatatttaacaataaatcaaatgatacaaagagaataaataattacttaaattttttaaataagacaaatggttaaacacgtactaaaaagtcaacggtgtcaaacattttgaaacggagggagtattactatatggtctcacctgtcatacacacactacgtcttgaagtccgtgctacagctggctatagatttatagcccgttgctcttctctcttattttttatatctcattaaaatatgtttacagctggctaatagactgttattatatctgcccttagcaactccgcgttacgtacgtcccctccctgacaccgggcgcacgcgtcgaccggccgcgtccccacccaccagcgccccgaagaaatgtgctacaggaacaggagagaaaccgtaggagatgacaggctccatgcgtcgttgcgcgtgctggctgggcgtggattgcggcgccgggagagctaggccccacgcgtcatatttactcgtgcggaaacggcgaaactcccccccccccccccccctgggcaccagctggcagccagctccacccccccaaccgtcaagccggccaccggcagttgaccgcgcgctcgatcggatccgcccccgcagccggtgcgccgcgctagcatgcgacgaatccgagcgctctccttgccgccgtcgcgtcgcgtgggcgtggacaccgtcgacgcggtgtccaacgaaccaggcgcgcgaagcgatgggagcacgagggcggacggacggacgtacgggcgggccgggttttacaagatcctagaccctaggatcggtagcttctagagagaatcactgtgcgatcgagtcatggaccggccggcatgggcaagtgagcaactgatgattctttccggtttctacacgagcggccccccggtccacgtctcctctaccggccaaaaggcgcgtctcggcctcccacctctgtagtctttctttgacctcaactgattagtagcagggggtgttttagatctatggtgtaaagttttagcgtgtcacatcgaatatacagacacgtttaaagtattaaatatagactaataataaaacgaattacagatttcgcctgtaaacttcgagacgaatttattatatctaattaatccatcattagcaaatgtttactattgcactacattgttaaatcatggagtaattaggtttaaaatatttgtctcacaatttacacgtaatctgtgcaattagttatttttttcgtttatatttagtattccatacacatgtctaaacattcgatgtgacgaggtaaaaattttgggaaggcatatgccctcgattgcgcagggaaagagcgcacatgcgtgcacgctgcatgccccggtttcggagcaccggtcgtcgttgcgttgagtttgcctggggatcaaggaacggcaaaatcactcatttcaggttgcatctgaagttctgaacgatcttatctgagcttctgagagacttggttttacagagaagagtggtaaattacgagagaagcgtgtgtaactggaggatcagtcaactgccaccgaaatgggcaactatgtgcaactgcatttcgggatggtaggctgcccagtcgcgtgcgtaactgtccaaggctccacttgcatgcatgggacggggatcgtcgaacgcgcacgctgttcggtgttaggtctaagtgagtcacgatcataaaacgactcagaaaatacagttatgtctagatagcggagaaaatgcaatgagctgttgtgtacctttacgtccatgcgccgatgcacggtcggtctcatcttcagtttagtgcaagggaagaaaaatccggttatctacaaactaccctattcgagtagtatataattcctttctgaaattcttgtattccaaatgactcgttgttgtttagcttctgctcctccgagtgggaaagaactagctttaacccgctgacgattgtggaatttagaaacgcagcttaattatatatttaaaccgaacaaaaacaagcgatcaagttcaaaccacgtaccaaccgtggaggattagttatatatattcttccgagttctgacgccggagtagtactgcacggaccgatcgatcgatcgatcgaccgtcttgggcgacttaattacccgcagaattgatccttctttgacttaacctggccgccaacgtagaagatctcaagatgaagcaatcaatggaggagctggtcaatgggggtttcattattacctccccctgatacggattaactggcgtgattaacttgatcgatcggtcgatcgacgcgtgatgattccatggaggacacaaatgtcagcgtaaacaaaccggtcgcccgttgacaaaagaaaggtttccacgtacgtacgtgccaattgtcaccgtgaccacgtacgcatgtgtagcaacgacctagctaagattagtttgtttactggagtagtagtgcattgtccaggctacaggtacacatctggaattatgtgtgtatttttttttaacgtaacgccgccttctccctcgtctgttcacatttctagctagctagtttggtttcttcaacgagattttcacgagtgtgctgacgaattaagctagcatgtggtgtgctgtcacgttcttgcacggtttttgtgtgcagcacttgttgcctcgttggttagttccctgccgtacgtttagtataagcaaaatcaacactgcaatttggatgggagcagcttttatttgtcgggagatgcatcggggatctggccgatgatttcatcgagggaaatatcatatatatttttatgtaaaatttagtatcgtcaattatagttatgtcaagtgtataattttttctttaaggaccataaaatttctcttttatccaacaacatttattggcaacttgttcgagtttataaagaggtggtagatgcatattaagaattcctgcaaaaggcgtattgtaacatttcggaacttctctgcatctaaaaaaatgtttagtatacggggagtcatttagtggatgagggaaaaaaaagtgatcgtattattagctctactccaaaaccttaaaaaaaatcatatggaatagtaatatatagtacaaatataaactaatatgaagcatttgtccgaggattttttttttcttttcaaaagagagccaggggttcatgtagaatcaaaaaatctcaaaaatcctcattttgttttccccagagaaaattactgtaggggtccattgagcatatcgtacaaatatattcctcttctctcggatattaatcgcctcttttttagaccagctattggacttagactgagaaaactgtatatataatacatagcactgattaaaaataactttatttattgattttgcacataccattcgaggatagcaccctcaacgttcgcattttctcgaacaaatgaaattatgattcaaggtgcagctcaatggtttagccccttgttttggaataatgcacgactcatttacggcacatgaacttcataagtaacctacattcactactgttgactttttagacgtagcaaaaataccgcgaaactactactcttatattatcttcagtttttaatagatgacacaattaattttttaatacatgtataaccattcgtcttaataaaaatacataatttttattttgttgtgacttggtttatcattagcttaatttacactctcatatttgcacattttttatacggcgaatgattaaatgtgtgtgaaaaaatcaataatattatctatttaaaaacggaggaaatataagtctcaacaagtttcaaatgaaaacatgttccgggacggctggactatatatgtaagcaaaaacaaaagtttacccgtattataaagcaggagttttcaaaggagctggatttgttaaactcaaattgtaggtgaaatttcctgggtcggcaccactcatttccaaattccaatcgaccacaggaaaaatcaagaatgagaagaagggtcagagagggtagaacggtagaactgcccacgtcgtatcgcactatacggttggaaaatggaggcatcgccccctcgaagcggcatcccctgattggtggatctggtcttcatgtagtcacctggaacgcgacttccgcagctaatatatctactccttccatccaaagaaaacgagaaaccctgatttccgtgttcaatgttttaccgttcgtcttattttaaaaaaaatatgaaaaaattaaaaagacaaatcacacataaaatattaattatattttatcatctaacaataatgaaaatacgaattataaaaaaaatttataaagacggatagtcaaagttggacacgaaaattcagggtttgttttttagctgagggagtagtaattaacaaaattcgccgaaaacctctcccaatccatcatgcacgcacgtacgttctaacgtgtccccgttgattaatttgttaggcttatgctaatgcttagactaacctaaccgtgtaggttatagcagataacgtagacaaaagcacctgtccctttcgattagcaattagcaaaccgggttaaccagctatccatcccatcgcgatacaaaccacgggatcgagtgccttgttagaattaatctcgtgatgatctggttgagatatttgtggcgtcgtttgaccagatgtaattacgtacaagagccaggaggaaattaaagtcttcttgctctaatcagttaggaaacccgggcagcttgaagatgccgatctgcgtcaagaagatgccgtgaaaattagcaaattgtactccttcgttctaacacaagttattttttcacaaattgatttttaaacctcttacaaactttttattaacaaatcgataaatttattatctattcaatatattctagctacacctaataattgatactccatccctcctaaaatataatagattttggttatatgagatatatatcttataaataaatacggtctaaatctgtacgattaggatgttaccattcaatcaaaatcttttatattttaaaacagattagtattttaaaacagagtattaacgaagcccgttcaatatttttctttaagtattaaattttattttacacacgagaaatcaatttattttaggacatgaagagttctacagagagtgtgaattcaggggcaggatggagatgcacgtacgggtgctaagcttgggttagcgacgacgacgcaccccgcacgtctcctgcagctgatttcttggaccggcgctttttgacgccggcgattgaacccgcgtagaccagacgagcaccgtgcctactcagcaactaacacatctctctctctctctctctctctctctctctctctctctctctctctctgcccatgcagcctatggaaattgataattgatttactatcaattaggttcacctaattggagaagaaaactggatgtgcaaactgcaaagtgcaaaaggctttggctttgggaaaggctatggctacttggcgagggagctgggagtttcagctacaaaaaatgcattcaaatcggacgcagaaaaaggcctgttctttttccaaaggtttccaaaagggaatccatgcataccggacacttccaagcgtcttttgttgtgatttactactcctatctcccccagaatggaaaatgtgaaaaacaaggagaatcaatcttctttagcccttttgaccaatgtaagaaaagaaaattcttatttgcagtgatgcagaatttcttcttgtgagtgaccccggcccagttcttacgtgcacactgtacctacgagcctagtatagggtcctttatcagctcggttgatcatcctcattaccctgccccttgttaccttaagaatgagatcctctaactttgggggttataagcagaggaataataccatgactctgaggtgtttctagctgtctgattcacagcaaacgaacgagatcgattactaaaatatgctaaaatactgaaaaaacagtgatgcgatgctatatattttactgttttacactgttgctacagaaaatatatgcaaaatcacaatttcttattgtaccatcagacttattttattgtacgcccctacctttagtgcctaaagtcagaggatctggatcctatcatcttctgctttatttgttccttattagacgttgagttgggtgtcacaaacactctctccgtgattttgccttcgagcttgaattctcccaacacggttgaaaacacctcagctgatgcttaataacgatagagtcagtatttgtatacctataactcgattatttcctataacaacgatagagttaatcaacttatgaaagttgactagcccaagataaaagaggaagtaaaaacgtggagcgttacgggtgcgagaagcctcgctgcatggctgtcactgtaattagccttttcagcagggttgcagctctgtttttgcttttgtaaagtttccttttgtacagttttcttcttctctaatcaataaaattggcggcctcgtcaattcgttaaaaaaaaaagttgactagccggctaattagagcataattaattaagtacgactaagtaaaatatgtggttttgtaaaatttatgttgagtattatatgttgcaaagttaaacacggattcaataaattgtttcaaaaataccgacgatgaaatattctttagaaaaacgtgccatttcgtagctttagaaacgtgcccgcggtaattttagtgggagcttctttacatacgcacctcacatgacaaaatggaagatatggggtatcaggtaccgactatcaaatcatgggagagtttgatgacaatagggaaagagaaagctgagatctactcctagtactactacttgggaatcggaatacaagacagatttttgatgatgtacaggtgacgaaaggaagctggttgaagagcatggacggcattgaccgcgggatatgattgtctgtgtgtgtgtgtgtgtgattcacgccccccatatttcttctggtctccacaaccacgtgggctcgagagttgccaaccaatccaccaccactagtcgtcgtcgtcgtcgtcgtcaccaccaagcgacaagcaaagcagctagaggaatattggagagacgagtagacgctctctctctctctctctgtgtctgtctagacccggatcgatcggtttttgccttgcatttataggcgtgatggcgatgtcgacgactgttcgagttggaaaggaagagaaacttaattcttttctctgagaaaaaaaacatggctcactagtctctgcagcttggaaaagaaaaatgaggtgaacagcttggtctgaacttctctagtctgaagaaaaggatgggcaactattttgtcaagagctactcgctagctaccgctgtctctgcttactgactctccgcgatgtgtcgagttttttctgaaagtatccgcgtcactgttcagactattgggctatgcctatgcggaatacaatatagattcagtaggaggatcaattgatcgagtgtgtcaggtttataaaatcaaaacaagtgtgtcaggtgtattgtatattcagggatcatgggggattgcaagtactgatacggtggagggatactaaattagtggtactaacagcagccatgtttgtacttcgagttgagtctttgactgcaattattgaaacatgaaacttggccatggctactgatacagttagttgtgcactttctgaacttaacaatgccaacatggccgtctgattctgcttaggtttgtcccatgttgtcatcggcaactcccttgattcatgaacagaagagatgtcgtggtaaccggtttgatatttctttagtttccagagctgttttcagtgttctatcctgattccatcagttacttctgaaacacactccaaatgtagatcaggcttattcaatatgtcccttttaagttattaaataccgtatgcgttcacctcaatcaattggttgattttagcacaccacagtactattcaacaacattacttttttgcctgttgctgcatcattatatgcaagataaattgatcagtgaatgctgaaatggccaagtttttcaaactgcaactggtaaatataaattgaatcagcagttcagcaccacatcaagtggaatgcattgggatccagatacacccaggatcaacctccaaacaaagtcttcaaaatggtttcagtcattgaatcttttgcagtcaattttttaaacacatttttcctgaagaagggatatttagattttagaagaggcaattcactgattcaccctagggtttacaaaaccgcgtggttaccacgcggttatcacggttaccatgcgcggtaacctttttagtttttgtaaccacggtatgtctcgcggttaccgcgggagtgcgataagcgcgccaaaaacggtaaggggagccctgattcaccttcattaacatgattatggttcatgccaaatgcttagttcaacatgtactttacctacttgcatgttgcagaaaatgtttttgcaggacatgagcaccgtgacagttgggtccttgttttttaatgtttttgcaggacatgagcaccgtgacagttgggtgcttgttaggatgttcgagtacttaacaattaaaaacgcatcacgcttattttccctcttaacagctgagctacttcgaagaacacgggcatctgccctttaaaacgctctaaaaatcacagtaattaagcatccacaagtacgtgacgacgcgggcaaaatctttgacgcgaacatgggcgtggtcaccgcgaacgacgcggcggcggccgcgccgggcaagctccggcggccgagcagggcggcggcggcggcgctgtgcccctgcaagggccgcggggcgccgaagccgccgccggtggccgtgatcgcgcacgagtgccccagcgcgatgcgcgccctcgtcgtggaggtccccgcggggcgagacgtggtgtcgtgcgtcgccgcagtggcgcgccgcgcgcggcgcggcgcgctggtgctgggcgcgtccgggcgcgtcgcggacgtggtgctccgggagcccgcggcggtggtgctccgcggcaccatggagatactgggcctggcggggtgcttcttcccgtccccaccgccgcatgcggcggcagagggcgcccccggaggcggaggcgcttccgcggcggtgttcctggccgggccgcgcggcggcgtgctcggcggcggcgtcgcgccgggagggctcgtcgccgccgggccggtggtggtggtgctggccacgttcgtcgcggcggcgttcgaccggctgccgctcctgaagggggaagagaccgcgaattcggaagggtgcgacgtgcatggcgtcaccagacgccggcggtgcggtgctcagccgccgcagcagcagcagcagcggtgcgggtgggcgctgtgccggaagctgggcgcgaagagctaaccggtgtctaacgcaatgggccgagtgagatgcgggctatgtggcccaggaaaactgggcctgtttagttttctagtttgggcctaatgtcgcttacattacctcggttggccatttgaaatcagaagaggaaatagccaaataggggagaaaaccacaagaatgtgatacaaactcaacaaaggattggcgaaacatatgataacagtgagatggggtgtttgaaatcgtaggcggaatccgtaaaagctggtaaataagtaaacttgatgctctcacttaaacttgtgataaaattacggttacttggagttgcatagattgatttgccttgggacctggcataggggaaaaacgttatgcgttagctgatatttgaacttatatgttccaaatggtaaatgaaaattctgtgcacttttcatgtggtgcaatcctccattcccagctggggtaatgagaacacacgaggaaacctattcattttccctgtaggtgttcacaagagtattctagcaaatgagccatcacattcgacacatgataaacatgagaaaaaactaacggtgaagaaatccgtctccttggatatctacaaccattataccaactggagaagtggagatcagcccatcaatgacgatttaactctttaaataactgacatacaaccagtattgaagataaccttatgaaaaccttcatcttgagtgcgagcaacaaagcagggtagagccaacgcttcaacgagcttcgacatggtaacctcgttgacctcctgatcactgtattcactcacatccgatgatgagtctgctaaaaaaatacagaatcaacatctatgccaaccgtgtccgttgacagcggaactaggggtgggcagaaaaagaccgaaccaaaaagaccgagaccgagaaatttggttctaggtagtgaaaaaccgaattttgttcggtcaattcggttagtctcctcggaaaaccgaatagaccgaaaagatcaaattataaaaaaaaagtctaaatgcaacctacaatccactatgtttaataggattaaattctaattttcacatccctacttcttcaaggcatgcaacctaataaaagtctttacttataagtgcttatgattttttttgtgatttttgtgttgaaatttccattatatctttgcatatatgaaaatgttgttgaatttcggtcaagactgagaccgagaccgaatttgtcagtcctgacattttttgcgctgaaattcggtcttcacttttcaaagaccgaaagaccgaagaccgacaccgaaattttttggttagaccgaatccccacccctaagcggaacccattgatgaactgacgagggctagggagtaggggatcacacctgttaccactcgcggtcttttaaacattattgccacactcttttcatatgcacaaaaataacctagaattatgtcctaaaattgaagcaattttgctatatatttgtcgacaatttttttcctaaaaagttaacatatataattacagtataattataatgtaattacgtcgtaacgtgcatataacttttatataattttaaaccgttagatttgtttcaaaatttatgcaagtgaagaagaaaaaagtcactgcgtgcacatatgtgagaggattcgttcccacgacctccgtttcacgaaaatagcatgttacggagagatttttgaaaatttaaaattatgtctattaaaattttaggaaattttttttcgacaaatatataggtgaccgaaactgaagtactcgcttatcaaattttgcagaggacttctaccaatccgggccgggcccaaaatgctgtaaattattcccagattaaagggggcccacctgtctgtgtaaccaaaccctccagtgcagcagagaatccaatccaacccaagaaaaaagaagaatccaatccaatccaccacacacgcgcaccaaccgaaggcgaaatccccaaatcgaaatcgacccagccagccagccggcacgccgatccgatccgtcccacccacccacgcatccggccgccaccgctgcgctgcgccccgccctcttccactctcccactccatccccatcccaaaccccgcgccgcctcttaccgcttcgcgtcagcttcgatttgattcggttcggttcgcgcgcgccccgatctatcccgcgcgaagtcgattcccacgccacccgcgctgttatgtgcgcggctcccatggcttccactgcccagccgcagcagcagccgcagcagcagcaggagcagcagccggtggcggcggcggcggtgccgactccggctcctccggcttccgaggcgcagccgcagaagccgacgagggtatcgttgtcgtacgaggagatctccaagctcttctcgctaccaatcgcagaggcagcctccatcctcggtaatcccgcccgccctcgctctctctctctgtccttctccagatgtgggcgagatccgtcgcctggctcgatttgagggccgcgcagcagctgaacgaacttttgggtgggggggggatttgcaggtgtttgcaccagcgttttgaagaggatttgccgcagccacggcatcgtcaggtggccgtatcgaaaggtatgttttgccctgtttcatgagccgattcctgtgttctcgagtgattgtgttgaacttgaatgtcagaactgacgaggaattcagcagattagtttcatgagctgattcctgtgtttttgagtgattgtgttgaatgtctaactgacgaggaaatcactggtgcgagaaggaagaaagaaagctatttgccgatgagaacttgcatgcttgttctaatttagggctatttgagcaaagagaagtatgcagtggttgtatcctatatgtaaacatggtgctctctttgcttatatattttgcagcagttggtggctttaacaatttacaaggtagactgctttaggaactgatatcgtactcatcagaggcttatcttaatagttgaattaagcgtatcccaaaaagtaagcaaggagacgaatgaattatgtcagatgttggctacttgaagatgttcatgaaagattgaagtttgcttcgaaggaagaaaagaggcgctagattctatgccctagaagccctattatgtaggtggtaattcattgctttccactaaatttgatgtgcgctctcagtaaaactccacctcccttgtcctcccatgctggctgcctctaaccagaacagatagcgaccaccccttgctccgccatggcaatcatccattaattcagagctcttcctgacacaggccgaatatatcaagtataatctacatcgaagaaatataagtctaattccttggtattgactagttactaagatggatgaattattttattccacaatcagctgctaacagaactgctgctaagaaacaaaaggccatcatcagaagcttcaatcacagcacctgtggcttttgggatgcacttggtgcgtgccttgattgagaactggaggtggcagcctttgccatggagaaaacagactgaggacatggtaggatgaagggtaaaacaggaaggagaataggcgaatccttgtgtttaggtgggaaatagtaaacaaaataggtaacatggcattttattaagagtgcacgtctgtttagtggcaaataattaattggcatctgtaaaatggcaaatcgttgaagccatcactgttgagtggcgaatagttaaatttccctaataaaatactccttccggtaaatattcgataactgaaatatgctgtctagctgcataattggttaaagcttgttcaatggctattcgaatgcccatagtgagttggttcaaactgttattgaagatggtatttactctattctgcatgcaaacatagaacaactacagtctgaaagctatttctaccccatgttgtcttctcttccgcatattgattatgttttcccagctttgttcttagtttcttctttgcaatccaattatttatattatttttcttaaatattcatgcttgcagcttgtatctgggaagtctggtgatgacacaaaaaacgctgaaagagagaaagccaagggacttcttgagatatctaaagttgcaaaacagaaggctctaagcgcatctggtctatcaacagtgtgagtagtgcgttttaacttgattgtgttgatgcccatattttattcctgtttcctgtgcaataataaatatgtcttctctcttctgcaaatgttaactggacatgcttggttctcactgaatgttagccacgacaactgcttgctagtgctattttcttgataatcaacagagtatactgaggtagttgatggaataattcaaagctttttctactcgcatgaatatttcagtgtaatatcacgcttaactagtacaagatgtgaagaaagtagtacttgaaattccagcatttccttgttctcttatctatctggactgataattatcatctatggtagatctggatattctgttacagtccaactccatcccagttgtaatattggctgttttatggcagtgtcctatggtaattcctattgcgactgattgtagcttgtactgccagcagattcaagttatgctgaatgcactatgttgtaaacaacagtgatgaacatatatgtggccaagtaatacatatatcataagggatggaactaatttacaggacaatctgttttttcataaatttacttattaattttaagaagaatttgtcccagttttttttatctgctactaagatttctgctctggatcctgtataacttgagagtctatgcacgttttactgcagacaatatcaccattaacttaagctatgtagtgcaatagaagaagttaatgatatgctcattcttgccttcttgtcgctaatctgtattataaatctaaaagcacatgacaattttaattgtacttgtagcttctgcttagtaaacttttactgctactagcttttggcttgtctgatttaactgctcaaactcggttgttggtctcatgacccttaggtgttctattattccttttatggctactttgagctgtggacatggataattgtgcttatgaatttcagctggaaaaaaaatatttgcgcaatacttgcatacagtgtgtttttgtagtggttcattgctcaggattctactgaccatccgctgtctgagtatggatgctggggcagtagagtgggacattgggttggtaccaggtaaacctgaccacaacaacagtttagaccatccctctgtgggactctctgacccgaggctgcgtgtttctatgttttcacacttggatgctatcaactttccctctgttgttaccagttaccactattgtagtctaatttggtttctcagttctctgcatcaagcaccatatgatgatctattgtcactattgaagcggtttgcagcatttgttctgacacttaaatctggacatattgatagatcaccaggcgctttccaaggagtggcaaaatctcaacagggaagttcgaaggcaggacaagtctcacccccaggaaaacaaaatgtgttgggtggatcagcaatcttgtcctatggtacccaaaccaaaggcatcccaacctacatggacgacttcaagtacggatttccatcatctggcttgtctttgcaaactatgaaatggtgggggactgacagccacacggagaccacacctgcgaaagacgataacggtgaagcccctgaatcagcaaatgaggcttcgaagggtatgaccgacgatgagttggactggggagcagatgaagctgaagccgaagccgatgccgatagtgcgatcacaaccgaaccatctgcacagctgtgctccctgagaaggaaagctgtagacgatgggcgcaagctgctgactggcaagtcctgcgggggactggagctgtgcaggctgaataagaggcagaagatggccctcgcccaggtgttcggagcctcactgccggagcagttgaggagcaagctcgggtgatgattttgcctgccatttgtacctctgtgtaacactagttactagtagtagcgaccggcatggttaagctggttcctgatgtaacttgtcctgatccatttgtgttgtgagaactagataaattcgttgtgaagaggatggtaggagttttgcctgcctgctttcccatttcacgcataattcctttcgtctcaaaataactttatttattcataattttatttgtctctaaataattttatcttttaagccataattgcattaaaagtttataaaagtagaggacatatattggggtatgttaaaataatagacgattgcattgagatttgtattagggtttgttaaaatgagagacaattgcattaggatttgttaaagtgatggacattttagtcatttttatttctttgtaccttacaggtaatacgattttactgagctatcgttgatacagcaaatgaacaatcaacaatcgtacgtgttgtacgtctacctacgtggagtgaggctgggtcgtcagtcacgccgcatcgggctattttggtttgttgccaattcttaccctttatagactgtagtcatttcgattggaatcaatattagctggggcaaatctatctaaagttggcttaagatttgacacaactattttttcttttaaaaaatattgtacaaacacacgtgaccatataaacacatacaccatagttagcgtctatcactaaattacaagtacatgtgctaagtttagaaaattaaattaaactcgagtggatagacttcttttttttttttaaaaaaaagaactaacccattaagctgcacccgcttcgtgaaacaaccaaaattatggcatgctttaaaccaaaatgagtttcaagatcgcatttctatatatccattgtctttaaaaaaaagacaaaattatgacaagcttcaaaccaaaattgcccatggagcctagctggggtgattggggtccatgttcattggttgctcaacgtggacatcgaggccaccgcgaagaggtcatatcactgatcatgcaccacccggcgtggctagttagcagcctccatctccatttggccaacaaagtggcagcaatttccgcatgcaagaacgacaactcgagaggagacggcaaaacaatgttagtgaccgttttattggcgttttgttccatcattttctttagcgctgttctagagcttaatttgtgccgtgcatgctagcttaattgattatgataacctagctacgggtgtaaaactgggatctctttataacgattaacgaaggaatgttatgggatattttaatgtttttcaattaagtgtccataaaaatcctgtaaaagttttttcattactccattcgtccaaaagttttaaagcttatttattttctgttttttttctccaaatgagatatgcgtctccatatgcatcaaagacttaaatgaaggacttgtactttttacaatgctaaattaaattgttaactaaaattcaagcaaacattgtaatactagttgcatgaatcatgaatgcatattattttttctttgttatatgtgaaataagttagtttctacttggtctttgtgataaaagaaatatgctataaacttttggttggggggagtatgaataagccctcttataattcgactaattaatcagagggcttttgctgcattacacttagttatggataacttcaatcagcatttaaacatgtgtagaattatatggcatccatctcagcgtaacatcttataactgactaattacaatctaccttctttatttccattttttttcatgaaatgtatagcatttagatataaattaatttcatagagccattgaaggtttgaatattcttttaaaaaatgccatggaaatattttggttgctctaggaacgaattgtgctctagaagagagcgaagacaacgatgcctaaaacagtgtcaattgaaatttgtttatcgtagctgttagtttgtactacgttactctatccaccagtactgttcacatcagagttcaaatcgtagtgtccaaaaatatggttgccactacatttggttcccctatgcgagatggatctgtatcaaacatccaaatttcccacgaatattttgcgagtttcaaaatttgaattcctttttcaaattccaaggtagtacaccaagcactatcaagcttgctattggctacagtgcatacatacacatccctagctatctacccagtacacgcatacgtacatgcacgtattgtacgtacagcttaattaattaattaattaaattagacgttgacgagcggcgagccggtgaggaactcggtgaaggcgagcgcgacgaggccgagcatggcgaaccgcccgttccagagctcggcgtcggcgctcatcacgccgccgctcctcgcctccgcggtctcgccgcggagcagcggcaccagcgacgccgcggagagcacggcggcggtggcggcgaaccacgccagcccgctccagctgccggcctggtccaggagcccgccgccgcgcgacgcctccacggccagcgccgacacgaaccccaccatcgccagccgcccgttgatccgctccggcgccggcccgctgaacgccagcacgtcccacagcttcgtgctcgccgccggcttcgccttgggcgccgccgccgcggggctcggagtcggggtcgtcgccggagacggggacgacgacgacgtggccgtctcctccttcgtcggctccacctccggctgcagaacgatcaatcccaagttagcaaattaagaagcaatcaccagaacacacagtgatcaagtcaatcaagcgtggcatgctcagctcacctcggactgggccctgacgacgagcgcgacacgccggcgaggcgcggcgcggccagcggagacgacaccacgccatggcgcgccaccagcagcagcggcggcgacggcgaaggagctgctcagcgccatggtagcggccgccattgcaaataactcaaacacaaaaattaaccaactaaaacgcagagagagatcgatcgagctggaggaagcttagcgaggatcgaattgaagcaaagaactcaggcgagcgagctagctagatcactcttcttcagttcttctgctgctactgctgctgcgggtgacgagacgagcataaataggcggggagatcgagaaggtcacggggaggtggggagcggtggtggtggcggaggcggcggccacgtcggcgggggagaaggaggcggcgacgtggagggcgacggggtcagaggttggtggtcgcggtcgacgtggacgtcaagggcaccgtgcgtcgcccgccaaaaaagggtcaggaagagtccagaaggcgcgcgccagtagtcgcgggggcagggtggcggtttatggggccacgtgtcagtgaccggtgatatgcttatagccttatacaaggctagtagcacaagtggctgtgtatggtttttaggtggacaacatgacgagagacgcgtgatcaaactcttcgttacatgtggttgtgaaaattttgaagacgatggtcatttttataatgattttttattatttattgcttaattttaataatcttcttccttatatatatccggcttcacgattttttaagtccttcgcacagcatatctggtttttagaaggacccctatgtaaaataacatttcaggagaactgtttgtggggaacctagatctaattacgcataaatcagagggttttttcgaaaaattttcactccgcgcactgttcctatccgacgtggcatcgcccagcggccgctccatgcgccgtcactatagccattttagttgagtaatattcacatcaacttctgtaaatggtaactttgctcaaaatgtacattaatatctatttttttatagtatgcaacattgttttgttttaatccaagagcttcataattgttcacttggtgggttacaaattattttctttgtatagctaagtttattgttggatcaatgttccggaacttatttatttcatttcatgatctggaatataaatttaaagcagaaagattctccgtagaattgaatatgttgtcgaagggagactccaggaccctaggttactgttacttatcacaaatggcacgcaagaaaacaaaggagcgtggtgggcatcgacggtctcttcacctcctcccgcgcatacagcagttggagcttcatgctcaccttgaattcgatttcatatggtcaattggaggaggccagatgctggctgcgttgcccctagctccaaaccaggtcgtcgggcatgcacatgagaaggcacatggcacacaagggagaaggctagggctgggttgtgacttgggaggaagagggggctgtccacacacccgtgcctgcttatcggtgccgtgcgcgcgagaaggtgaggctagagacaaagaagacatatgggttaggattgggagaggagaagtggtgcgaagtggaggtcgccaggccatggcgttgcggcggcgaaggttagggaaggtgaggaggagcgatagaggcatagggagaaatcatgatcatgaggccaaaggcagtcggacttggatgatggatgaaacggagtatgacgaatagaaaattacaattttttaagtagggttagatatccattgacataggggcaatctaacacattaagaatcatagtccactatagataaatttttatgccgggttcgtcaatatttttgcattgctttgagaggcctgtttacgaaaaacgatttttctatacgtgtctgaaccaaacaacatccaaaatatttttacatgtagatgttcttttagcccgcatgtaacaaaatagggtgtgcgtccgcaaaaatcatttttatagtgactaaaacaaaacaatgttgcatacttagaaaaaaagacaaatacattatattatattaatgttaaagtgtacttttgagcataacattgataattctcaactagaacggctataatgaattgaaccatctctgtgaaccgttgccaaggatatagaaaacgtgcagatacagccagtatcgtaggcaaaccatcacgaacgacgtgaaaatctccgacgcgttcgcccgtagtatgggcttggccatctccctcgtgctgcgccagccgagaaacccaatcgcagcggcgtctacggcccacacggtgccggcaatggcgacgagcctaacgtccggtgcggctgcctgccgcgccgccgtcacgaggcggaacagcagcgctagcgccgccataggcaccgacacgttgcaccacttgagcaggctgggcatatcggacatggagaaaccgtacttctccctgaagtagaggaggcacatggggagcgcgaagaagacggcggcgtaggagaggcctatccaagacacgccgccgacgaccaagccgccggctatcgcgcttgcggctgacacggcggccacgaagcgaacgcaggcatagcggatcaccttcaggtggggccggtcgtaggcggcgaggtgcttgggcatgtccaccgggtaggcgcacgtcttctggaagtacgagaggcacagcattgggagcgcgaagaatgcggcggcataggagagacctgtgtatgacatgccgccgccgccgccgccgaccgccacgccgccagcgaccgcgcacgcggccgacacagccgccgcgaggcggacggacgcatcgcggatctcgcccaggtcgagggcgaagaggaccgcggcggggtctttgggattgtaccctttcatcatccgctccagtgccttcccgctctcctcgtactgtttcctcctggtgagagccatggcgagggcgccgccgtgcgtgaggcaccacgcgagggacaggacggcggctacgtcggcggcccagacgacgcaggtggcgagggcgacgtcgccgccgccgccggccctcgcttggttgagcaccgccaggacggcgacggagagcgcgacgggggtgaccgcgacgcacgcctggacggacagcggcgtccgcgcgatcgggaactcctgccgcaggaactcgagcgcgtagacggagaacgggagacggaagaggagcgcgccgtagccgaggacgaacgcgagcgccagagccgccggagcgccggaggccgggtaggcgaccgcggcgccgaaggccgcgtacgccatcgacgccaccagcgtgatgtgaaccacggtcttgaaccgcagccctattgcgtcgattctcggctgtttcgtatccattatggctcctcctcgatcaaatcgttactacgtctacgtgaaaagatcaaaagaagaggcaataataggttgccttatatatataggagtaattaaggaccgtttcgtttcgttgtcggttggaataagtccatttgcctccctcaattcttgccctttatcgaattacatccctcaaccgcaaaaccgggtatattacctcccccaagtgttaaaaccagtacaaaaacaactcccttggtggtttttgacagtggttttactgacgtggcttcctagtcataaaaaaattaaaaaatacttgaggacccacatgtaagtggcatttctattcttcctctcctccaccactctcctctctcctcccccttctctctccccgaacagagcacggccaggggaggcgccggaggcgcgtgaggtgtggggactgccggaggatgcggcgggcgcacgccgcgagggagaggatccgctgtcagcagcagtagatgcaggtggtagcggttgcagcgggggagaggaggatgcaggagctaggaccgaagcggagctcgaacaaggacccggcacaccaaggtggacgcccggggacggcggatccggatgccggtgctgtgcgtcgcctggatcttccagctgacgtgggagctcggccacaagtccgacggtgagaccgtccagtggctgctccagcaggcggagccggcaatcgtcgccgccacggggacggggaccataccggtgtcggcgctgacatccgtcgcaccatgccggggctagagctaggactctcacaggacggccacatcagcgtgctcgccgcacagtcgctcagccagttctaccaccaggtcggcagcgccgatgccgccggtcaactgccgcacccgcaccaccatcaccaacaccatcagcagcagcaggaggacggggaggatgagcgctacgacggcgagtccgatgaggagtccgggcagtagtaggcgcatagccaattgttcatccatgcatctcacgttgtctctttggagaagaaaaatagaattccaggaaggacatgcagctaatggaggggggatgcttttgttactgttgggttgttcttcatgaggttttttatgtctgatttgttcctcgtgaggtgtcgaagctcgaaagaggctaccacttgctccggcgacttgttgggatggatcatgatcatcttcagttgttactcctgctgctccatggatggtcgccagtttatccccctccaagtgtttaggtgaaagcttaatcttttgcactccacagtcagcacatgacatgctcttcgaaaggtagcctgatgagcttatgtattttgctggaggttggcggcgcggatagacagcaggaggatgtgttgccggccgagcagatcgacgccgtggcaggtgaaccctccccgcgtgggcgccgcggccggtgatcctctcccttgcggcgtgcgcccgcatcctccggcggtccccacacctcccgcgcctccggcccctctcctggccgtgctctgtttggggagagagaagggggaggagagaggagagtggtggaggagaggaagaatagaaatgccacttacatgtgggccctcacatatttttaagtttttttcgatgactaggatgccacgccagcaaaaccactgtcaaaaaccaccaagggagttgttttgtactggttttaacacttggaggaggtaatatacccggttttgtggttgagggatataattcgacaaaggggaagaattgagggaggcaaaatggacttattccttgtcggttcgatgtttttcttttcccctctttcgagggggccgcctatgcatcactcgggtgatttttgagattttttctttccttggatttgcatccaacggactacaaaataaaataattaatacaaatttacttacacaacatttttatcaaaattacagtgcacttacatgttatatcaactaaatttacatatgtaattttagttatataggactgtaattttatatttgaaataaaataactaatgcaaatttacttacacaatatttttatcaaaattacagtgcacttacatgtcatatcaactaaatttacatatgtaattttagttatataagactgtaattttatatttgaaataaaataactaatgcaaatttacttacacaatatttttatcaaaattatagtgcacttacatgttatatcaactaaatttacatatgtaattttagttatataagactgtaattttatattttaaagaaaataataagtacatatttacttacacattatttttatcaaaattacagtgcacttacatatcaaatcaactaaatttacaaatgtaattttagttatatatgactgtaattttatattttaaagaaaataatatgtacatatttacttaaacattattttttatcaaaattacagtgcacttacatgtcaaatcaactgaatttacaaatgtaaatttagttatataggattgtaattttatatttcacgacaacgacaagagagacggtgtctctcgtcgatcagtattggccgtgctaccggcggctggctcgccggtcagaggccactgtgtcatcgtgcttctccgacacggtggccgatgtgctggtgtccgacgcgccggctgacgagcctgaaaaaaacgtgaaatgtcagaaaaaaatcacgcgagtgatcgttagcaaaatcgctttcgggtgaatgggctccgcgagtgaaataaatttagaaattgggccgtattggcccaatgtgagattcatcataggcagacaggccggccgagccgtattcggcgccaaattctggcccatccactgaccagcagggccaacccctcgacaagtgggccggcacggcacggcccgttagttgttccgagcccaaacgtggctgggccaggacgtaaccggatcaatttacatataggaaagaaaagaaaaaaaccttagcgtccaaaaatcattgtgcctcgagcactcgagtatctccgccgtcctttccgcgtcaaagaaaatccccccgtctcgtctcgtctcggcctccgcccctttcgtcctcgccgatcccccatctcgcgagcacagcaagggttagggttggggcgcccatctccatctggcgagcagaggccggggagggaggggcgccgtcgtcctgctgcatcctggtgagcatccacatcctccccgacctaattttgtctcgaatttgcttgcgctaaccctagctttttttttttttgtgggggagttaaccctagcttcaattctagatctggaagaagctcctctattaatttcagggcctaaactttaaaataacagtttgtttgttccccaaaagaagtttgtgagggttcaactgaacccccatgtcccaagttggatccgcccctggtttgtttccaataaatatatataataatagtaaattggggattcacttgaacacccatgtccaacatgaggtccacccctgtgtagcattggacgctgattgagtattgcaatgtgtagagaattcgaagggtgatcctgtgctcgggatagtggttttcacgcgctattgtgtagtagcaatatgcgccatctactcgttatcaccattttacctagtatattgcttcttggtaggcgcattggtagtgatattgactgtagtttaggagatgcgatgtgtttctcttccagaactgacattgtttgtatgagtcacagtagaatcgtattatacttgctactatcctatttctgctctgttgccatctacctgctggttatgtgttggctgcatgtaagctactgatcaagctcgtaatgggtttattctgcgaattccaggcgagatagaagcatgatggcaaagaccctgcaagggactcaacagcaatatgcagcaagtggatttcctacccagcaataccccacaagtggctggacacaatctgcagctgaaattcttcagttggataatatggatcaagatacatccgtagttcgcaatattattcaccgtaaaatgtaagttcttaaaccaccaatattgggattagctttgactcgcagattactagttgctttatactagcatgccgtaccaacaaagtatacactgtacatatgttttctgcaactttagttgaacatttcaaaaactgcaatgctactggcacgattttatctaaaatctgtgactgctagtgaccagtctgtctgataacatcacgtgcttttggtggcttgttgcaacttaagttgtagcaaaccgataacttattgcagttattatctcttgttcaactatatcctgattcttttttcttatccagtgtagagtacctaaatgagcggaaggaattctgcaactttgacctatcctttcttatggaaattggaaaatgtattgaccgacatctttttgagaaagctgattcaaaggtttgtgttgtctcttgctgcattagaactattataggatatatgatcacctatggtgctttaatttggtgtggtttctactctaatattggacaatattgaacttatctacatgctttattgaataaatacaaaattcagcatattcttgtaatccttaaacagaattgttactgctgaacagtttggtgtac

SEQ ID NO: 8076 - DNA, 1180 bp, Oryza sativa
caatacatagaatgtgagatgaagcaagagacgtggagtcggtcactagagcaatcagatcagtcaaacattaccactggaaaccgtgacttgtatcatgctcaaattcatccgtacatcaatggagagcacaaacgggatcgatgcattcaaatgaaagaaaaacttgggcatacttctgatcatgaaggtttctccagggagaaaagctcaaatttaagcaaccactttatgcatcatcagcagggcttcatgactaattatggtgcttgtagccctgtaagcaagacagtggatagagctgaacagacatcaaatagtactgtatcaaagccgacttcacctgcttcagatggatcttctggcaagcattatccagcaaaacgcttgaaagttgatgttccccatcttgtccatgtcaatgaaatggaggcttcaaaggaacaacaacctgctgccaatgagacttatgcatctgctgaaacagtacaatctgaagtcactaattcaccaacaaaatcaccatgttgtacttccttgggggacaacattgcttgcaccgataatgtacatggaatggatatggtcagattgtcggggagtgctgtacaaactgaagaagaatttcgtcgtgaaaatagtgacattgagatgaaggatgcaaaggttgatttattggaccaaacattgtcaggggacagcctgagggcaaggaagagaagaggggcctcagtactttatgcattaacttctgaggagcttaaagatcacttgtgtactctgaaccatgatacttctcaggtgagtgaataacctgttggatcttgtatgatttatctagtattgtaaagcacttgattattattggttgatgtagtctagagaaattttcaaactgagcagctgcaaaattaactaaatattatgtactttcaattgattttcatttggtactaagattttgggttttgttgtcactcaagctttcttgattatattgtacagagtgtgtgcttgttttaagcaaagtttatatctcttaacatgattaacttattttttgtagagcaaagtgccgactgaagagctgctatcagttgaaggcttgcctgatcagaacacatgcaatttatgtgggatggaaagactcctctttgagccccctccacgattttgcgcg

SEQ ID NO: 8077 - DNA, 4489 bp, Oryza sativa
agtgccaaagccaaatatcagaagagattcagctatgcagagacagatgctgaggcagaatgggtaacatatgcttctcttatttctctctagtcatttggaatcatatacgaattactcattttttgtttaattatgccttttcagtgggtccagtgcgataagtgcaaagcttggcagcatcaaatctgcgcactttttaaccccaaaatcgtggatccagaggctgaatatacttgtgcaaaatgtttcttgaaggaaaaggataatgaagatgttgattcacttgagccatctactattctgggagcacgcgagttaccaagaactagactaagtgatcatattgagcaaaggctttctgagcggcttgtgcaggagcggcaacagagggcaattgcttctggaaaaagtgttgatgaggtagttgtgttatgcttttcttttataccttgtcccgtgtacagaatatgctggtgttgcattctgctaccgttgaacaggctacctcactgttaacctattgaaccacagccaaaagttacatacgtctttccaattgcatttttgtgcttcttgctctatgtgctggattgaaggttacaagtaacatgttagtccttatattatagtcttctaagttgacttagataattcattacatgaatgcatctttactgtcatacgtttctttttattttttacaatgtactgatggcatttcacttaatcatgttcttaatacttctcttggtgcatctagcaatgtgtatttatggcttcaggattgcagctgattacacatgaattcatctttggaacacatgttgatgaccatatatttgttgcgtttcagtatcctttttagtgaaactacttttttcttctttttccttgcattttattggattccgataaaagttggttctgcatattcatctgatttagctgaccaagatgtcatattacaattcatggtcaaacttggaacataaacttgtggatgctttgcttagtcttatctgatcatctatgctgatcttaatgttatttttctgcctctaggatttttattacactgtaatatactggagaaacttattgggcgaacttttatggtccaattattaggtaccaggagttgaaggtcttactgttagagtggtatcttcagctgatagaacactgcaagtccaaccacgtttcaaggatttttttaaaaaagaacaatatcctggggaatttccgtacaaatcaaaggtgattatgtgatacttatactttactaatgctattattataacatccatttaaattatgctttcattatttagtggataatgtgggttaccatttccgtgttttgtgcttgtgcaggccattctcttgtttcaaaagaatgaaggtgtagatgtatgcctgttcgccatgtatgtgcaagagtatggttcagcctgcccatcaccaaatcaaaggcacgtttatcttgcatatattgattctgtcaagtacttcagaccggaaatcaagtcggccagtggagaagctctccgtacctttgtgtatcatgaaattttggtatgagaatgcataatcattaaacacttagtgttcttgatcttgatttcagtttatggatctcatgttggtctgattatcttccaatctgttttcccccagattggctacttggatttctgcaagaaacgagggtttgtaagctgttccatatggacttgcccatctacaaagcgtgacgattatgttttatattgtcatcctacaatacagaagatgccaaagtctgacaagcttcggagctggttggtcttcatcatcttttacagtcaatcctaaaattatttatgggccttcatttgataatcttttcaatatatttaggtaccagaatttggtaaagaaggctgttaaggagggggtagttgtggaacggaatacactctatgacttcttccttcagcccaccaatgaatgcaagaccaatatctcagctgcatggttgccatactgtgataatgatttctggcctggggaagcagagaggctccttgaaaagaaagatgatgacacctcacagaaaaaagaaactcaactaggaaggcttctacgggttgccaaacgtgatgaccggaaaggaaacctcgaggatttttacttgtgcataaggttggttgtttaaatcatggtgctccctttcttcagaattttttttcgccgggccttcttcagtattttaggcacttgaccccttaattttcattgttggcagcttggagaaaggttgcgaaccatgaaagaagattttttaatgctttgtctgcagcaattttgcaagcattgccaccatcctattgtatctggtagtagttgggtttgcaccagctgcaaaaacttctttctttgtgaacggtaagcattcagtcatgtaaacttttgtgaccatatagaatgcatttcccatactgaagaactttctggaacagcactaggggaaatgtctgctgttggtaaaaatatataattgcacatggcacttgcatagttcaaccattctagcttatacagtgaccgtttgcctgtcaaattgcaaaatgaatctacattcctactcttttgttgttattcaattactctttgtcgttaaggcacccattatttatgatgccattcttatttgtcctcgtagttgttatgctgaggagctgaatacccctctgaaggacaggcacccagctacaacaaaacaaaagcatgcatttgaaagagtacgtatatgaattcatctatttaaggtagctacaatctgcctgcatggaaatactaaccagattactaatctcctctgacagatagaggaagaacctcttccagaaacggatgatgtagatccaacaatggaaagcaagtactttgacagcagaatagatttcctgaagcattgtcaagacaatcaataccagtttgatactctccggagggcaaaacattccacaatgatgattctttatcatctacatgattcaacttgttcttcttgtcaccgtgccatggatcaatgcttggcatggcggtgcttggtttgcctaggctgcaacttttgtgattcatgctataaacaagacggtgaaagtttgcatattcataagttgaggcagaaaaaagaccatcacgtattgcagaagtacactctacaggtatccttaaattggtagctgaatctttttcatctcctatttgtgtttttcatgaatgtttattatgcactcgaaattaacatcttctgattttttgggaacaactctggggatctgatttttttttggttgtttgctcttcgcatgattatatttggcataaactgtagaatataagtgagttgcactattattatttgttccataattttatccttttggtttaatcttgagcatatgtgtgaagtgtatgcttcactattcttatgtgttgcttcatgttatgttttgtcccagtattttgtgactgcatatccaaattttcaatcaggatgaaaaatattctatgagcttttagattctaatgtggtaattatgtggtttcatcccaaatattattttctgctagtgatatttacggtgcctcttgctaatgaattggatgctttcaaagcaggactaccttgaaggcttggtgcatgcatcaagatgttttgatcgaagttgcacttccaaactttgtttgacgttaaagaaactgttcttccatggtgtacgatgtcatacccgtgcccgtggtggaggaggttgccatatgtgtgtattcatgtggaaactgctgttcacgcactcactgctttgtgacaatgcagactgttcagctcccagatgcaggtaaagtgtgcatcacccgcaatattgatctgccttccggagttgtgaaataattttcacaattttattttttccaattggcttgttaattatctttttcccttttaaatcttttcagggatataaaggcatatattgctgacagaagcatgacagaccttagtatatctggatgagcttcatgtgaacttgtagaagttttgttagacaatacaatttgttgctagagatgcaataagctggtgttgaccatagtaagtggcacagtagtggcaatagcagcatagtttcgctggtttccccagtatttgcatgaaggcatgcagatggtggtggtttggggatcaactttatcctcgtattttcttgaatcgcctatttcgactttcgatggaggcatagcaaaaaccttacgtaggcaatctgacatgttcccgtaaatacctgtatagttccttattatagctagattaataggatagaggattttcattcctttttattattccttttcttgattggattgaacaaaggcacattttgttcaatgtttctgtgccgtggcaaaagtccaaattcaatgaatgggtatatttact

SEQ ID NO: 8078 - DNA, 2092 bp, Oryza sativa
ccggatattttcctgataaaatgaccctgtaaatctgtaaaaatggaggcaagctaatcgaagggtgcaaacgtgcaatccttaaattcgaatttcactcgcaacaccaccgtctacgattatattgaagtcgaattaagagcacccaccccccccaaacacgcgagaccacacggaggagctccctcgaacgtcggcaacccgacgctgctcacgtcgacgacgtacgttcgcgaacgacggcgtccggcggtggctttggccatggacgatctccgagtcggaccacagacgatgatctccacgtacgatgctgcacctcctcccctgtcccgctcggtgtgtactcccctgtcccgctcggtgtgtactcctcgatcccggcctttgtccacgaggacgggacgtacgtcgcggtagccatagctcatcggcgcgcacggtgagggcgatgcgcgtgggagggagccccagcgcgcgtgttaattaccttcacgtagcgatgccgagggagagttcgcctcacgagtcgaggagcctgtgtgcacctcctgcgtcgccgtcgtcgctgcctcatcaggatctgaaaccgcgtattataccagccagagccaggttggtccggctcgggtgaaaacgcttgggcgtggccgcgtcgtgagcggctgagaaggcacggtttgtgccgggatgtccttttttttttttttagcccaaaaggctcagcctaacttgtctgcacctggaaaatgtgtccatgttttcgtgtatgcgagtttacagagcgattcgttcgcacgggccggtgtactagctaaaaagcgtgcttgtgtggctgcgcggcgattgttgtacggtaaaagcacacagcggcttccagacgccggtacgccggccgcgcgcggcccaacctcgtaacggttttccccctcaaaacatgccagccaagcgaccgtaagagcaggtacaatagcatgctataagccagctgcaaatatattttaaacagataaatgagcagagagaagagcagcgggctacagatttatagccagctatagcacggactccaagacgcagtgtgtgtatgacaggtggggccaggtattattagtgtagtatgtaactattgtatgaataagctattagattccccgaaaaaaaagctattagattgactataaatgaattaaagctagtagttggctatactattaaacttgctcaaaaccaaaagtccctgatctcaaatttagcccctctctcccaaacaccccttaaatgacctagcgtgacaaacattttatgatctccggatataaaataaaccacctcatattttaatttgtgccatgataggtcgcatcaagccaaaaaaaaaccctgaacaccgtcgtttaaggaacacatacaacttttgttttaggatcaccgaaacaatagttgacaaagactgatgctctatttgtttcagcttagaattattataattattagttgataccccgcgttttgttgcgggatatgtggattaatgcatgtatatatgatttacggttttgctagctaactgtcgatagttttcaatcctgaaaactgtcaattttttggtcgttgattccgcgctaagatttgtgctgagatattttgctatcagatctaaacctctttttcacaagctagtctcatcatcacatgtttatggcagatttgttcaagttacatttaagttacattctagttacatgctaactacattgtagttatactattgttatatacttatattgtaagtatagtgtaactacactataactaaattgttatctctatataagatataaagttgcatatattgttttaatacatatatacaagttattattattatagtatagttctaatgaaattatataatgtagttagattcgaaagtttttcctaaaaaatactcgacagctttttagctaatcccatgatttatggagtgaaatggtagatgtatatgtttcaataatgtaaaaatggtgtagagatatataacgatttaatattgcttgcatattgagttctaaaaatacaacaaaattat

SEQ ID NO: 8079 - DNA, 10849 bp, Oryza sativa
agcccgcatcccctcgcactccggtgagcaccacctccatcgccgctttcggccatggtttccgatcgccgtggttcatctccctccctctaatttctctcttttcctctcttagggcatctcggagctcgtccgtccgtcgccgccatcctcccatggctcacagtcgccgttcgccgtcgtcctcctccgcgccggccactctcggtgaggcatctctcctcctctattcccctccctctccctcctagccgcgccgggtcgagccgccgccccggtcgtgcgccgccacctttgcgccgccatctcccgtcgccggttgccgtcgccggcaacgcgcgcgcgccgccgcccttgccatggccggccggccggctttgtgccaagccgagccgagccgagccaggccgccaccgcaccgtccgatcggccccgggccgatccgggccgtcgatcccgtggaccggcggtggaccacccgcgtggtcccagtccacgttagaccgaccacccgtgcgccgctgccatatggggcccgcttgtcggcgccgccccctctctctctccgtgatttatttattgcgcaataaatcaattaaggatttttccgtttatagtaaaaaaacagtgtatcttctaaaattcataactaattcatccgtgctccgtttaagcccatccaagtctcagtaaatcaagaaaaatttgtccattaaaaatggttttgttctctgtttcagtagtcttatagcatgtttgtattgtttgcttcgtatgtcgcttagattttggttcttccgacgctccggtttacttcgagatagtcgccgaggttcctccagcagcagagcaaggcaagtcatgcctgtcacttgaatatgttgatcctatattgcaaatgctctattgtttttcttcaaatactgcattgttttataatgttactatgggatgttaacctatcgttacagccatgctatttcgtaccatgttcctttgttagcttgggatataacatgactagagattggactagggattccttagccatgcttagttcaactagcacacaatgagggagatcctattaatgtttagactgtaggttctaatggtaatgttggattagtaccaccgctttggtgttgattaactaaaatgaatcacatggtgggctatgggtgcatggttttgctagtcgcacccatggcaattaaggaccggttcgcgggaaaccctggaagaattcctcgtacttaccacaagccagcgtgggcaacggctggacttgtagtgtatctttcctctagctgacgcattcaggcaagggtgggcgtgatggagcgggacgggccctgcgacggcctctgtcgctttcggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcaccgaaacgtgtcgtggggctgtgtcttgtgggtacagttgtacacctctgatcagagtaaaactattcgaatagccatgcccgcggttatgggtggtcaaccagattcaccgtgattagtttcaccctagtgtagtctaatgaaattggatagtttaggtggatgattgggcctgttgcaacgtgggatagcattggacagtggatgattaatattaattaattattacaactgtttacttctttcaacttctgtttataaatgctcgctttatgcaaatgaaccactctagctctcctttgataattctctgcatcatatccctattccggtatgacttgctgagtacagtgggtagtactcagtcttgctctattttccccaaccccagagtatgagtatgtgtcagatggtggtttctccgaggagtaggcttcgtccgtgccgtcgagaatgcctgtggagtggtgttcccgccgcagatcaagtcaaggcttagctccagttatcttttgtttttccgctgcatttatgtaagacttttatgatatttgtaagacgtggatctgaatgtcaacattgtcgtttgtgtaccccggccggtcctggacggggattttaatgcacattctgcttggaattctattcgggaatttctaggagtgataagttggtatcagagccgaccttgaccgtaggacaagccaaatggaaaaacctaagagccctctgaatccttttcattgcatatgttctttgcaattggatttgttccgggaaaattgggatctattcttgtggttcaagggaaaaatctttgtcgctcgtttaagcgagatttgtcaaaacaagtcagtctagggttttagtaaaattatttgaggtttattcgtcagtcagttgggatttgatgggtgaaatgcattgggtcctagctcaggaatatgggttgcaaggtatttatgcttttattgttattattagtatgtatctaatttccccattattttatcgctatgtacgtctgtcttatttattcgctctcatgcaaaatgatctatgcataaaatttcgttcttactcgcttctcttatttgagtcctttattgccttatttaaatttggatttgagcatgcattgatcctactcctttgtcttctctagatggccgaccacccacccaaccaccgcggagaaggcatggatgactttgtggcataattggcacgcatgacgctggtggtgggctaccccaacgcgccagagtacacgactgttccaccgctcagtggcgagcttcctcaccgtgtccacctggaagtccatggctacgtgggtacctgcctagctaatatggtggtagaggcatccggaggcacagcagatcacgcctgtcaggaggcagcatacctgatgatggccagactacgggagcgccacaactacatcttccacaacacggcgtaccgatttcaccctcgtcgagccagcggtgatgatgtcagtactttccgtccgacagtcggcgagaacaacaccacctttggtcacatgtgcgccgtgatgagggggatggacaggatgcactcggatctgcacaaggcgtccaaggccttgaacgatgggaagctagtgaggatcatagctctgaaggatgagatagcacgcctgaagaaggagaatgctcagttgaagggtctcccagcaccaggaggagtccggatccgcaccacgccccgcaagtcgacgactgcacccgtgcgcattcagcttgcgcccaagaacccacctccgcccgcagttcccgcagctccagctccagccccagctccagttccagtgtcagctcctgcatccgctctctccttcgcgccagcatcagccgtcaggggccccgccagtggcaacgggggttggttgcctgctactcccagtggtagccgcgaccatagaagcagcagttccagtggcacagagccgggcagtggcgagacgtatctgccagactccaggagccgctcagagggacctggtgacaagcaggaggacgccttcgacttcaccgaccgcaggagctgttccgagcattaggctcgctttctattagtttatcgactgtttagcttttgcctgttagtttgtgtgtttaggtctgctcgcttgtgggtcagttgacggtcgatatcatgtgcctatgatatggctgtcttaataaggatttttgcttgatgtttaagtgttttaattcagatcagaacaactgcagtttaaattcctatataataaagcttagttcttgagcatctgtttttcttcttttcccccgtctgcttctcctccagatggtctacaccaggaatggcacccgcaccacgggcgagggcagcaacggcgaagagcgcactgatggtgtgcatcccaatagtgattccggcaatggtccgccaccactccccgagaatccgacccttgcccaagtaatggctcatcagacgcagatgatgacagccatgatgcagcaaatgcaacagcagcaccaacagatgtaccagaggatgcagcagcaagccgagcagcaccagcagcagtttggcccccctccccctcagtccaaactgccagagtttctacgcgtcaggccacccaccttttctagcaccaccaaccctatgaaggcaaatgattggctccatgccatagagaagaagctcaatctcctgcagtgcaatgatcaggagaaggtcgccttcgccacacaccagctccaaggtcccgcgtcagcttggtgggacaatcacatgactacccgcccgccaggcactgaagtcacttgggcagagttctgccgcaacttcaggaaggcgcaggtgctagatggggtcgtggcacaaaagaagagggaattccgagcactccaccagggcaacaggacagtgacggagtatctccatgagttcgatcgcctcgcgcgatatgcaccggaggatgtccgtactgacgccaagaagcaggagaaattcctagcaggtctggatgatgagctaaccaaccagttgatatccggagattacgccgactttgagaggctggttgacaaggcaatccgtcaggaggatcagcacaacaaaatggataggaagaggaaggcggcgcagttccggtccaaccaagcaagccaccagcgaccgcgcttcattcccagacagcagggtgaacctaccaccatgatcgtccgccagcaccgccctttcaactcaagcaacttccaccagggcgctagtggcagccagaaccaccgtggaggtcagcccaaccgcagtgcaactccgcgcccaccaatggcaccagcacagtcagctccgtctgtgcaagccaagaaggagaccggagcaaagccagggtcctgcttcaactgtggtgagcttggccacttcgctgacaaatgcccgaagcctaggcgtgctgggccaaggtttgtccaggcccgtgtcaaccacgcgtctacagaggaggcacaagcagcaccagaggtcgtactgggtacgtttcctgttaattcaatccctgcaacagtactttttgattctggtgcaatgcattcgttcatttacaagaagtttgtcgggatgcatgggttaataagagaggaacttagcacaccaatgcgggttcataccccagggaatagctccacttcggtacaattcagcccttctgtaacaatagaaatccaaagatcaccatttctagccaacctcattcttctggaatccaaagacctagatgtcattcttgggatggattggctgaccaagttcaagggagtcattgattgtgcgaattgcacagtcaccttgatcaatgagaagggagaaacagtagtgtacaaatcactagtctcaccaaaacaaggggtctctttgaatcagattgaggtggagatcccagtggtcaccgaggagaagaattcgaggaaattggaagagattcccatagtctgcgagtacccagaagtgtttcccgaagacctcactaccatgccacccaagagagagattgaattccggattgatttggcaccgggaaccgctccaatttacaagagaccgtacaggatggcagccaacgaactagcagaggtcaagaagcaggttgatgagcagctgcagaaagggtacattcgaccaagtacttcaccttggggtgcaccggtcatttttgtggagaaaaaggataagacgaagaggatgtgcgtcgactatcgcgcactcaatgaggtcacaatcaagaacaaatatcctttaccgcggatcgatgatttgtttgatcaactgaagggagctaaagtgttttctaagatagacctacgatcaggctaccaccagttgagaattcgggaagaggatattccaaagacggccttcaccactcagtatgggttgtatgagtgcacggttatgtctttcggacttaccaatgcacccgcattcttcatgaacttgatgaacaaagtgttcatggaatttctggataagtttgtggtggtattcattgacgacatactcatctattccaaattggaagaagaacatgagcaacatctccgtctggtactcgagaaattgaaggagcaccagttgtatgccaagttcagcaagtgtgacttctggttgtcggaagtcaaatttctgggtcacattattacagctcaaggcgtggcagttgattcatcgaacgtggagtcagttaccaaatggaccccacctaagaccgtgtcgcagattcggagttttcttggacttgcagggtattaccgtcggttcattgaaaatttctccaggatcgcccgacccatgactcagttgcttaagaaagatgagaaatttaaatggacagccgagtgtgacaagagttttgaggagctcaagaagaaattagtatccgccccagttctgattctgcccgaccagatgaaagacttccaagtctattgcgacgcatcccgccacgggcttggatgtgttctaatgcaagagggtagagtggtcgcatacgcctcgcggcagttgcgtccacatgaagggaattatccaactcatgacctggaattggcagtagtggttcatgctttgaagatctggaggcactatctgattggcaaccgctgcgaagtatatacggaccacaagagtctgaaatacatcttcacccaaccggacctaaatctccgacaacgaagatggttggaactaatcaaagattatgacatgagcattcactaccacccgggtaaagccaatgtggtggcagatgcattaagcaggaaaagctactgcaatgccctatgcaccgaggacatgtgtgaagaattgcagcaggagcttgagcgtctcaacgtgggaattgttgaacataggttcgtagccgctctggaagcacggcctacgcttgtggatcaattcagagcagctcaagtaaatgaccccgaaatagttgaactgaaaaagaatatgagagtgggaaaagcccgggacttccttgaggatgaacatcgcacaatctggatgggagaaagattgtgtgtacctgacgacaaggaactgaaggatctgatactcaccgaggctcatcagactcagtactccattcatccaggcagcaccaaaatgtatcaagacctcaaagaaaagttttggtgggtcagcatgagaagggaaatagctgaattcgtcgcactctgcgacgtttgccaacgagtgaaggcagagcaccaaaggccagtaggtttattccaacctcttcaaatcccgaaatggaagtgggaggagattggaatggactttataacaggactgccccggacatcatcgggtcacgattcaatctgggtagtcgtggatcgactcactaaggttgctcacttcataccagtacataccacctatacggggaagaaattggcagagctgtgcctggcaaggattgagtttgatctattgagataattcttcttttcatacttaatgttgtatcaattgagtttgatctagtgagtcgtgcttagaatattgatctctagcctgccacctagttgtcgattagaatagcatcggagtttcagccgatcgtatctgatttaactataattatctctatttgcttcagtgatatgttaaatctaccctttatgccaagatattgttgtatttgaatatattaggtttttgcttgatattctatatttgttttaatatcctgatatagagtagtatcggagtatttgccgatacatgctagatctatatgatcggctatgctgtaaacttatatagtcttgttattaatatatatttcggtcttagtgatttatactgtctcggcatggcgaccgatctatcccaatcacttgatttaagtatatatcgatataaggagtatataccgttaacatctacagccgatcaagtaggtttagttttcttccttatttattcacgattaccgatcgatgcacagatgacatcggctaagatataaatgatatgtcatcggcctctggccgatcggctatcatttatagatttaactatggctcctttgtctttatttcttgttgattataggatcaaatcaactggcacgctcatacatccgaaggcgagttttggacctgcactggagttaagcagatatctcaggcctcatgttttctgtcaacacgcttttggcacgcccggtgggacctgattagaagttaggcgttagttcttcctcatggccgagaaacgagcaccactaccatcaagcccaggctccgttaaaggcaaattaccgaagccgggattgactgacatcattgatgacaatgtcctgccgatcgatcccgagaaattcacgcctgaccagaagcaaaaatttgaagcaatgatgcagcaagcacgggatcagtatctaagctcgttcatgcaaacccgcaagggaatgctggttcagaagtacaagttaaaactggttgctgacaaccctggaaccggttcttctaaagatggagaagtgaaacaagctccagatggctcggctcagccgagcaacaagggtgctaccagtggttctataggaaatcaaggcgataaccctcaagaagtgcacggagctccaggtgatgctgctcaagggccgcaaggaggaaatcttaatcagaatattgagctagcacaagattttttcaacaacttttaagatcgggttgattacgcggtgcatcatgctttgatcaatcaatccggggtcttagtcaatacactgtcgaacatgatgaaaacgatagccgatggctcgatagctgagcatcaggctacaggcccggcatacttgcaagaaggcatttttccgaattatcgaactttgatcactgatgctcagccagttgtgcaggcgactccatctgtcgaacccacgactcaaccaacagcgccagcatcaacgcccttacctgctacatcggccacggcgtcagcttagccgatcaaccctcgattgctaatgagggaacatccacagcttgctggaaaagcctcgaatcagccgactcaagatcaggttgctgctatgttttttccaccaccaccagttgttgattcagtgcagcagcagccgatccagcagacgtcatcaattcagccggttgtacagccgatccaacaacaggtcgcgcagccagctcagcaaacaccaccaattcagccggtggtacggccgatccaacaacaggtcttgcagccagttcagcaagcaccatcaacgcagcagcatctccaaccaatccagcaaacaccgccaaggcaacgccttcagccgatccaacggactccggtacgacagcaggtcgttcagccgattcagcacctggggccagccaatgcatcggctggatttgcagcacatggggggcaacctgcgcagcagtttgtgaatcaagttatcccggagcatttggttcatcatgcacaaccggatggcaccttagtaactcatatggttcctgagcacttggtgcacaacattcagccgaatctgcataactaccaagggggtaacttgaactatcagtatcagctttcatctccgcaagcccaatatcaaccagggggatcggcacagcaacagttcgctcctcagtttggtcagtacgagcccatgcaacagcaaccacaaggagcagctctgtcacaccccgaagttctttcccaagcctaaattgaagttataaatggtctcaagaaaataccagtgtaaagcaagagtaaaccttaataaattaatgcaagtaataatcggaattggcatgtggaatttttcttgagttctacatgtcgaaattcgctaacaagatttttagtggaattttcagagctctcgaaataattttaatcaattaaaattgagcacaggcaatatttaaatccctgggaattcctttcttcctttttcttttttctttttccttagtgggccgccggcccattccccctcctctctccccgcgccttgctgggccggccggaggccacggcccaactcagcccgcgccccctcctctctctcggggtcaccgacaggtggggcccacctgtcgggtcctcccccaacctccagccgctcgccgccgcacccgcaaccgccgtcgcgcctcgcgcccgcgcctcccgggccacgtcgtccacgtcgccttcgcgcccgcgcctcccgcgcccacttccccctctctcccgctcgcccgcgctcccgagacggccgggattcgattttcgaatcccgcctctctctcctctcccactcccccacgtcggccggcgattcccgcctctcccagccacgtccggccccctctctccctatttaagctccgccgccaccccctctctctttttttccccatttcgcctaactctctcgtgctccccatcgctcccgcgccgtgcacccatccgccgccgccgctcccgctactccggtcgtctctagccgccgctaggctcgccgccgcaccgtgccgtcgccgccgttgggttcgcgtggtcgaggtccacccagtccgcccctcctccatcgaggtccgtcgccggagcccgcatcccctcgcactccggtgagcaccacctccatcgccgccttcggccatggtttccgatcgccgtggttcatctccctccctctaatttctctcttttcctctcttagggcatctcggagcttgtccgtccgtcgccgccatcctcccatggctcacagtcgccgtttgccgtcgtcctcctccgggccgg

SEQ ID NO: 8080 - DNA, 708 bp, Oryza sativa
ctcggcctgcggtttgttgccccagaggaggacaacatggagacgatcgtcgcgcttgatgcgcttgtaatcacgtggaactcgtcgccagacaccgcagatcttgcccgtggcattctgatagacactgagagtgcccgccaatggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaacc

SEQ ID NO: 8081 - DNA, 357 bp, Oryza sativa
atggtaaatggctggcggccgttcgattgctttgaagcatttgttgctatctaaattccatttaaggtcgtaccttatcgcccagcatcatcttattctctatttgtattccctccatctttcagataccgatgtagccttggatgtgcccgtgcccaatgaagaggaagagcgcaacatgaaacgtaagtacaaaagtacgggacacccacccagatcccaatagaatccgccaaatcctgcgggaaattgtaatcccattcaccagctcctacatttaattaacaagagaactattgtatttatctaacacctggattatctccacctttcatttgatccctatttatagattac

SEQ ID NO: 8082 - DNA, 783 bp, Oryza sativa
  unsure (1)..(783): unsure at all n locations
ttcttctctttctctatctcttccaaagccttcaaacgcttgtcgatgacttcatcaaggttgtctcccattaatatcttgtaatcttcacttgataaatcatcttgcttgatgtaacgaagagaaccaagatttacctcaactggtaaaacggcttcttgaccataaaccaactcaaaaggagtgactttagtggcaccatgtttagatatcctatacgcccacaatgcttcagaaagcacctcatgccacctctttgggtgttcctcaatcttcttttttactatcttcaacaacgtcttattactcaactcggcttgtccattagcctgagtgtagtaaggagaagaactcaacaatttgttaccataagattcggcaaaactcttcacttccttagacataaaagaagcaccttgacccgtagttaatatttgcggaataccgaatctatgtataatatgcttcaaaataaagtcatttaactccgtatgagtcatattcttaagcggcacagcttcggcccacttggtgaagtaatccgtagcaactagcacgaacctatgcccctttgatgacgaaggataaatttgaccaatgaaatccaaagcccaacctcggaatggccatggtttgatgatagggttcaacacggcggcgggcgccaactgaacattgccgaactgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8083 - DNA, 859 bp, Oryza sativa
  unsure (1)..(859): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattagtcttaccatctatttgatctggaccagcttttggtccagtaacctttgaagcattagaaccagatgggggtttaaccaacttcttctttggagtctgtacaaaaaatttaggcatagaattaacaaaagagtggacctggtgtttgcaactaagtaatatgtacaatgaagtcagtattaaatataacagtagcattatctgacgatcaataacaaataatgtagaacagttgtaagataagattcaagtagtattgttgacatcaggtgtagacccccgtttttataacaggaatcactcgtgtaaactgtaccatttccctggatcaagtagtctggtacacacgatttcataactggaataccaatgctcatacacgagagtctagtacgaattattacaacataagcccgcaggcattgtcttaaatcatcagaccgagcggtctggaatacaaccaaaagcagagtttagataaggcagcggaattttaggcagcggcatgccattgccacaggcaacgaccgtactaagacctactggacgccatcatcttcgtctccctcctggtagtaggcataaggatcttccgtggcttcatctcccgcttctgattaattttataattgcaagggtgagtaccaaccgtactcagcaagccaccacagcaatgatgcacatgaca

SEQ ID NO: 8084 - DNA, 20534 bp, Oryza sativa
ttatattaaacaatgacggttctgtccaccatccattgtgatcccaaggatagcttcccgccattgagtcgttatggctttctgaggatgtccatatttccacctctcaggaaatggctccatcagcataaaaatcatcatgcaatatcccatcccacacaagttaagagtttagagtctagccaagtgtaatacatgtcccggtgctcaataaccgcgagcacggctattcgaatagatttggtttactcacactgcagtggatgtacactttacccgcactccgcgactgctcaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttaggttctcataaggcagtcctactgatggcgacaccactgtagacacccgcctcgcggttctaccaatggctgccccaccgtagagcccctgcctcacacatcaagaaaccactatgcaggggtactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaggattcaagggtaaacaataatcaaggcatggcataatcacaagtagggtgttcatcattgcatgcaattttatttataaacaaaaccatttcgcaattgggatcaacatgttcaaagaatagtgatgacttgccttgctcaaagtcttgcgggtcttggccttcgcttggatctgcaactccctcgggctctatagttacgtgcaagaattgatttgaattcggttagaattcaaataaaaatccaaatgaatccaaataaaagtcgcatgcgaaagtcgattcccttttgttaacttcactatccgcggactacggccaacccaatttcgatttaaactattttgcgagtataaatattttgtggtcatgagtttttaacttaacctacccgagtaacatatcaattaataggttagaaatttctatcgcgagctaaacatcggacgaaatcccagaatattatacgacttaatttagtctatgattaaatataatacacggctaacatcctagtgattaaatccgaattgctaccgttaatcgattatttatagagattacccagaaataatccacaataatttacgagaattcatacatttgtttaattattaattacatctaaattaataccgcgaattgatttcttatggagagtactagaaattatctataatctatatgaattcatccaattatattttcattaatcctatatttaaatgctagtattttaggtatttaattagtaagatttcatctaactatattttcattaatcctacaattaaattctaatatttgtaagtattttaaatttccccctaaatttttcccttttcttttccctctctctctctcttttcttttcttctcttttcttttctttcctttttcctctcctctcttttcttttcctcttttcttttcttttcttccttttctctttttctttccttcctcccggcttcctccttccttcctctccttttcctccctcggcttctctctttctctctcggctcggcgacaaaagaaagagggagggggggcagcggctcaccgacggcggcgacggcggcggcggcggcggcgacgacggcgcacggtgcggcactctggggcggcggcacgggggcacgaacgcggcggcacgacagcacgagggcggcggcgcggtggcacgatggcggcggtgcgacggcgcggcggcgtggaggcggcggcgcggtagtgtgggtagaggagaggggtggagatggaggggaagagggggaaatagtgaggcttatataggggaggggaagagctaaggggggaaaaggagaagggagacgcgacggcgacgcggggcgcgaggcgcaaggcgacggcgacccgcggcgatggcgatggcgacattggcgcggcgcggcagaggcgaggggacggcgatgggaacggctcggcagcggcggcgcgcggctcggagcgacgatgggacgcgcgcggcgacgtcgacgcgcggtgacggctcacggcagcggcgcggggcgcgaggcggcaggctcgcgtcgcggtgatggaacgggcgagcggcgcgcaggcgcgaggcgcgaggcgacgcgacggccggacggtgacggcgcgcggcgatggaacgggcggcgcggcgcggtatcagcggcggcacggggctcggggaagcggcgcggcacggggtgcgaggcgacgacgacgacggctcggtagtggcgacgagacggtgcgcggcgcgatgggacggcgacgcggtggcgacggcgatgcgacggcacggggctcggggcggcgagcggcgtgacaggcggggcgacgcgacgcgcggcggtgcggggctcgagacgggtgacgcgacggcgcgcggcgcagcggcggcggcagagggaaggcagagcggcgcgcgacgcgcggggcgcgagatggttgcgcggcgcagcagcggcgaagtgacggcgcgcggcggctcggggtgcgaggcaacgtgacggcgcgcggcacggcagcggcgacgcggcgggcggcggcggcgcggggcgcaaggccggctagggcgccgggcgcgtggcgcgcgggcgcgacgcgcgacgggacagaggggcagatataggggacgcactcgagcacctggcgggcaatgaatagtgacttttcccatttttcccatttatcccgattttaatttattccccatataaatttgattctaaaaattcctaattttacatatatgcattttactcaatatgtgtgttatcccaaccaatggatccatccctggttaattttacccatattttatttttatatcattttcttgaatttaattagatttaattcttattcctacattttttaatttaattgatacaaatatagtcccaataatattttactcatttctatcctctctaaatattattttaaattgctctttaattatttacttagtcaatttactttttagggttttctcctaactaattttccattattcgcgatttataaactccgagatcaaaattcattaaaataatggaacaaaatcggcatgatgcaactttatttaaaaagtttttgaaggtccgtatttttagagtttagatttcgtcggtcgaattttcagggtgttacatcaggaataaagcatcttgagaaaaaaagggaatctgctgaacctcattcgaacttggatagctcgtaatctatctatagatcttttaaattgttctttttacatgggcatatcacatatcagcagcataactaattagaaaccagatggcgaggtaccacgaacagggattaaacaattaagaacaaaataagaattatagtagttaccgagcgttttggaggcttatcttgatttgattccatggttggtttctcatctttgtcgaaagcatctataggcaaccatgaagagaaaatagatcagaaagtgaataaaaaggagatactagtttggaagtttgtcataacaaaataataaatattactatctccgtcccaaaatatgagttttagggttgaatacaggcattaagaaagatggtggaattaaatagaggaatgttgtgattgattgagaagaggaggtaggaagggatttgaatggtggaaagttgcgattggctaagaagagaatgtatgtggagaagaagttatattttagggcaaattatgaaggctagatgttgttatattttgggatggagggagtagtaaactaatgataccttcttgactagtaggggttttcctcctagtaggtgttgcctttttgcccttatttagtgcagcagcatctccatcccctgcatggtctgaactagccttgttttcccccttttgttcttctccagatggtgtagtccttgtaggactgttttcaggagaatcatcggagcccgaagaaagcatcaccgtcgatgtagttggtggctacgaaaaattatgcaaaataaaattggtgatattatcaccaataacaagtcacaatcttggaaagccagagaagttgtaccaagaacagaaagtgtaacaagtactagatacagaacatgcttgctgcctcacatcggagcctatcggacatcggaaccaaaatcaagacatgtgttcgttgtgtttaaactaggaatcggcgataccatagcgggaccgtttagcaaaaccattggcatagaccaagtaaacaagttgttaaacacatgtacaaacaacgttttctgaataccgaaaattcgcatcgagttgtgcgaaggattatcaaagagcacgaaattctcacgaacatcacaaagcatatttaacacatagcctagaagcacaacacggaatgccattttgtgaaatgacatagatcaaacttattagcgcgcccactaattcagttcaattctcaacttaaatccacagagaaaaatgggtaaatcgaaaccgctcggcaggatggaccttattcccacggagacctggcaggatttagctagggcacatcacacggccacgggaggcggaggagaagagatggttacctggaacgcgcggagccagtcggggtcttcttcttcctcgcccatgcctgcgcctccctccctcaaaactcctccagagccgactatggaaggcagcccactacgcggaccagccgagcgagcgagcgcgccggcggcgaggcgaggcggcggcggcggagcccgggtcgtcgacctgcgcagctgcgctcgaggagaaagagaggtcacgtgcgtcagagctgttgctacgaggccccgttccagccgggccggcccacgagtgtggtgggccaaacacgcgatgctggattaggatacggcccacgagtaagtaatctatgagtatacctttcctaatcgttcacgcccttgtacgggtggaaacctagccaagatccccatcgtcgccgccggcgccgtcgccgtcgccatcgccgccggcgggcgccattggcagtaaggaaaaggatgatccggcgattcttgtacattgctgaccactgctttacaggcccctccctctcccacaggctacggggagtcaacccatcacatttcttctaccccgatggccatccactagcaacgaaaccggagcgagcgacggtggaggtggaggacgctcgcctgcctccacccgccatgggcttctgctccccgggcaccacggcgacggccatgggcatggagttcatgcgcaggaacgacggcagcatcgtcggcattgaccacaccggccgcgccgtcctctacgaccccgccgcgcgcgccgtccgcacgctgcccgccctcgcggcgcccaagctcatgcccgtctcggccgccgtcggcgacgacctgtacgtcatggagacgacgcccctccccgacggcgccggctgcttcgaggcgctcgtacgcctcgaggataatcccgccgagtccgactccgacaagtgggaggtaggggacaactacctctggcaacccctgccgccgccgccgccgccgccgtccccgtgcgtgaacgcctacgccgccggcttcgaaggctcctcccgcggcatgatctgcgggtacgcggtggccggcgacggcgacggcggcacgcgcatcctggtatccaccacgaccaacggcacctactccttcgacaccgcgagctccgcgtggagcaaggccggcgactgggagctgcccttccgcggccaagccgagcacgtccccgagcacggcctctggttcggcatctccgacatggatcacaccattctcggcgcgtggaatctgtcctccacgatccagcagccgcagccgccggtggcgagcctccagttgaaggggttctccgtggagagccacagcgacgaccggaggagggagttggaggtgtacacatcgcaagtcgtccacctgggcggcggcaagctgtgcgtcgccaagatgttcagtgttaatcgcagagaaaggggtaaaataaatttcgctatgctcactggcgtggaggtggtacgctgccgtggcggaaagctccgcatcgtcaagcacaagtcgtgccgttataacttcggcgaagactacacccctgattatctactctaactagtagagtactcctacttagtactgtcctaataaaaacccttatttgattaatcctactcttatgcaggatacatattcatcggttagttttaaaactctgcattgcatagctctgtaaactctgttagtagagatgaatgatttcaaggaagcaattctattgttaaggacctgaaaaaaaaacatttataacctgaaatacttatcatctgatcagatagcagtctaagtgccaaaaactaatactagtgacaacaaatggcagctgccataacagataagcctgaaagcaatatgtcagcttccttgatgatgcatatgtggccatgcgggttagctcgtctctctataattttcattcctttaacaggctgcataaatgcatgtagtattgacgatgagaaaaacacaatgcttaaatcatcattgggcaaaaaaactgttaacatacactccacccccttaacaaaaatcatattggtactaaaatgaaaatagtctctagtgaattatttttttttctctctattgattatggcactccaaaacatttagtcactgttgtcgatgtacttataacttgaagaaagtcatactgaaatttgtctggcacaaatccttgatcaatgtagtcttttctttaaggacagttagtcagtgaacttcaagaaaggttatatactagataactttgggaaacactatggatcttagcaaggctctttgaaggtggggtttgttttcttttgctccattgtaacttacaagtttagctgtgcatcctactctaatatacttttcaatgagtatatcacatgcattatttcaatgaatgcctctgcataattctttcctcataattcagttacattgcgttagatccaagtacaacatgccaatattgcctggtactatctcctgtgagtctataatgattccttgtcttttcatctccatctcaagtcctcagtttattgttgaagtcacaaaacattgttaggaataaggttaaatttatatatatatttttttgaggagaggttaaatttttatattaagtatgcatatcaatatgacgtttcagttcatgtttgaacctattggtgtcagcatggtattgtaattagatactacatatccttttcaattggtcatttcgtgatgttggactgtgatatggacaccgtgtataactgaaactattgtatctaaggcacacaagcagaaaaataaatctacatagttggagattgtcatttataaagttctgataggcagtgtgatgttgtgatcatgccaatcattgcacatatgcttcttttcgaccttaatttttctaatctgaagtttcctgatttgttgattaggtttggtaggtctctctaaagaatgtgctgatacaagcagtacgtgcccttccatatcattggatgttgttaacttttacgtgtctgacagctgaattactcaaacaatgttctttcaaatttcatttacacattcacgtttctgtcaaacaacgtagacactataaggctcttcttatccttgtgtattgtatcatatttgtgtcattgttcaagtaacagctatgtctgtagttacttactatgatggaaaatgattatgggaagtatagttcatcttgcagtctagtgtatactgttgccagtgcattatctttgtgaatatggatgtgaaaatggcatgtaattatctactgtctgccaggcacttcttgtcagctaactgtgcccatggcatgtggacatttgcattcaaccagatttgctctatgctatattttcagatcaagcgaatgactcaccatgttagaacgaagggagaaaaagtctctaaatttgcatttgatgcgacaatctttgcctctttggtcttgttttcgccacaggtgcagatcatgggagtcaatgttgtttaacgatgcatgctgcatcgacaaacccattatctagttttcctaaagcctgactaagatagaggcaccgggccggagagtgacccgaagaataaaggcagggaaaaaaacttgaggttgaattgatccagtaattgtttggattgatgcacaaatatgaatcttatcaattcttttgcaagggtaatgcaatttggcaaacacatttggtttgttgccaacagaaaatgaaatggtagtgtacattgtttagtctctaattgatctcaaattaaacaatgctcaaagcaattttaccaagaaaaattggcaacaaacctaacttcgtcacaaattttgcaacgctcgtatttggcttacagaaatattttaactaaggctataaaccaaacaaaacaccaaacttaattctgtgtaatcattcttccaaaactgacaatctgataccattagatgtttttactagcagttagtaaaatgaacagtggtagatgtactaacaaaggcaatgtaaccacagagcatggggctttgacatcgaatttgtatgcctgcagtacagatactgcgaattgactactgtgtcaacggaacatcaacccgtactttgtccttgtcaaagaaaacaggaacaggactgttgagtgtgaaccgaacatcaactgtacgttgtccctgtcaaagcaacaggaacagggtggttcatcgagaagctatgcaattgtctcccaagatatacctataccaagcaaagcaaaaggtatttcagttagtaaaatcttgtttcatgtactacaggagatcagagagcacaatgacctactataatgaaaggggaatgaactgctgacctttacctggctagccgttcccctcatttgaataacctgtcaaaatctatcaccttgtgctgacgtagagccaccattccccacatcatagctgggagtgtcctagggaaatactggtgatatatcctgtgcgtttgaacgatcaaatacttagatccaggttcagttctatgacagtacccgtccctcctatacgttgcctgcgaccagttgctgattctatatccatggcttaactgcatgctaagaagcgggtgttgatatccaccacgacctacaatgacctacggcgacggcggcacgcacatcctgatatccaccacgaccaacggcacctactccttcgacaccgcgagctccgcgtggagcaaggccggcgactgggagctgcccttccgcggccgcgccgagcacgtccccgagcacggcctctggttcggcatctccgacatggatggcaccattctcggagcgtggaatctgtcctccgcgttccagcagccgcagccgccggtggcgagcctccaggtgaaggggttctcggtggagagccacagcgacgaccggaggaggagggagttggaggtgtacgcatcgcaggtcgtccacctgggcggcggcaagctgtgcgtcgccaagatgttcagtgttgatcgcagagaaaggggtgaaataaatttcgccatgctcaccggcgtggaggtggtacgcggccgtggcgggaagctccgcgtcgtcaagcacaagtcgcgccgttataacttcggccaagactacacccctgattatccactctaacgagtagtactagtagactcgagtgcgttcgtttccttgtgttggaaactcgtttcctcagcacagagagtgattcattagcacatactagtaattaattaagtattcccttcttttctaaatgtacgccgttgacttttttaaacatgtttgatcctttattttatttaaaaacttttgtgaaatatataaaactatatatacataaaagtttatttaacaatgaatcaaatgatatgaaaataattaataattacttaaattttttgaataagatgaacggtcaaacatgtttaaaaaagtcaacgacgtcaaacatttagggatggagggagtatttatttatttattgaaaaatatattaatataatttttaaaacaacttttatatagaaaatttttgcaaagcacacatcgtttagtatttatttatttattgaaaaatatattaatataattttttaaaacaacttttatatagaaaatttttgcaaagcacacatcgtttagtagtttaaaaaacgtgcacgcagtcgagaagataaaagaggagtggcaggctataaatttattgtcagatgcaacacggactctagaacataatgtatgtacaacaagtgggtttatatattaatagtgtagtatatatttatatataagtaaaatacaatgtatgtatgacagatgagactatatattaagtgtaatatatatttatagataactattgtatgaatcgatactatattatagttggctatactattatactttgctctcagtgctatcctaataaaaacccttatttcattaatcctgctcttatgcaggatacataaacatacatattcatcggttagttttaaaacatacatattcatcggttaattttttagttttaaaactattcatcggttagttttttagttttaaaactatgcattgcatagctatgtaaactctgttagtagagacgaatgatttcaaggatgcaattctattgttaaggacctgaaaaataaacatttataacctgaaatacttatcatctgatcagatggcggtctaagtgccaaaaactaatactagtgacaacaaaacaaatggcagctgccataacagataagcatgaaccaatatgtcagcttccttgatgagatcttgtggaaatcaagaataatacttcgacctcaaatttccagtacatactttgctacatacagataaataaactggaggtaaaaggaaacagttcaactcctagatgcccatgtttgggtacaagtgatacgtcacgtcagtcattgcacaaccaaaaaggatttcagaattcaaagagctctgctccaacactcgagactccggtagaagagataaaagacctatccgattaacaccaggaggcgccgaggagggaacccaataggcaaagatcctgtcccatgttgcagcatggttccctagtatgccacgcctgtgagccccagaaatcagcattgtatcaagcctggaaatgtccctcactcctcgttatattccgggttcttcttcagaattacaaagccctccaataccgaagtcagcggaatgtatctgcaaaacgtaaaacaacggatcaggttttaggtttcatggggaaacttgtagaaatggcatattgttaattgagctcttattacttttcggttgctaattcagcccgttcccctgctgcaagcaatacgggtgtcgaatgtgtttggaaaccagtaattgtcttgggccttccagcctgaccaaccacatcaacagcttgcccaacccgtactggaacagataggggctttagatcctcatccaccgttaaaagcattctaggctgtacatacaagaagagaactcaattttagtaccaaatagtagtttgcactagcaacaaaactgtcaattaactaaatggaccatacctgcatcgccaagacgataatgtaaagaatgtagtggtatttccctagaatggtggatttcatatcgaggcaagcatgcaatacagtaacaaggcctccaagggccattctacacccaaacaaaaaattgaaggattaatattgaatgcaataaacagtagatgtaaatagcactagctatactcacggggaaagtagaaaccggtcagaatggtatggagagagagtcaacaaacccttcccaaggtgaacaagtccttgagcaattcttacctgaatacatgcaaaattttgtcaatatatgtacgcattatatacaaccaggtacaacagaatggagcacaggtttaaaaggatcattgtggatttattaacttacacaaaacagatgcgcagcttctttgtaatagtaacttgaaagattgcgaagcataccagctattctagcattgtttgtaccagcaccaatgaaacccaatgaaatgattgcagcctagagaaatttaattcaggtataaaacgtaagccatcaattaggacaaaatatattgggtatgtcgtgggttaaaaagttatgaatacaaaccattgacacatcagcatccgcatcatgactcagtctgctaagcgtgtccataacatttacctgggatgggataatagaattgtaagtagatacaacaacactgagtggggcataaattgctttgctaaattatgcaaccaaatagatgtagaatggaccatcaaacaaacacttaataccgaataagcatgacaatatccttgcaaaatatgagtaatttgacagaacagtaagcgctgaaataaatagctaaagaaggtgcttggaataagatattgaataatggaacatcaaagtttagcactttcaagtaataactccattacttgttccaatgtactaaatgttatggtgtcaattgagaatttgagcacaactcctttttttaacactcttttcaaacataaaacaattgatcacactttcattgaactggagtttagattctgcatcctctctcaaagttttttttacacttaatcatcaaagcattacttcaaatttaacttagatcgtgatccttaacaaaacttatgttggtcaaatgttgcataccttcggattagatatgcagagtatgccaagagcaagaggaactgcccgtctaatattctgctcgccatactgtaaaagacgctcaagtgaccgtacagccatctcagctcctaattcttcagccattgcaataagcgcaattcctaggacagctggcccctggtgggtttcacctttctcaagatgctgtgagcaaatcccaaggagcttttgaacctgcgtaaaattgccaagcatatcaaaacctcgaaatttaaacaagcttgaagccacaagaacctctaagcattaaacatgaagtaccttgagcacatttcctgttccagcatatgctagtgacataagtgttacatcacagtactttcttatcttctcatcaaatgttttagaaacttctgccgtagcctctacactctcctgaaatggaaattgccaaacaatcataaaaggtacatttatctaaaagggctgcataaagccataaacaacagttagaaacaaaggcagctatagtatatgcatacagtacatttaggaatagaaatacaatatataaacaatacggacaacattacaatgcgaaaggtcagacatcatgtgggaaccatgacatggcatttacagcaggtaaggcgcttgacaaaaccaacagaaacaagcacttgcttaaaataaaataaagggaggacacactaggtaaatcctcgaatccacaggtattgaacagtatttcaaatgtataaaagcagggaatactggattttttttaagcaaatgctagtgcacacagcccaaaaaaaatgaatcaaaaggaactaagcttcaaggttgctcaaaaagtacctgctttccaagatacagaagaccaagcgcaacaggaagcaggcgtataatgggttctgccagctcagcctcactgcgctccatcaaggcaaatatgatagattgagcaatctcttcattgcaagaaccaacaaacaccaatcccagagcgatggcggagaatatcaggacctcaagagttgatttctcagagtcccccaacacagttgatagataagatttaagctgaaatttcagatagcaggttatgtggaacatatagaaaatgtttttttttgtaaaagcacagaataacaattcttaaatcccacctcctctttctgagaacccgcatatgcaataccaagacccaagattgccccaatccgaatgtttgtgtcatccttgttaatgtactccatgagaatagcaagtgcctggcagcaaatttagggtattaaagaaagtatttgcaaaattttgggtattaagaaaagatttgcaatattaatcagtaggatggaggttgggaaacttagacagtggagcacatactggatcacaatcattcttcacaccacatgtgacaataccaatacctagcaaagctccagcaacaacatgagcatcattactatgtaagtacttgtcaagctgagcaagtccagaatcagtatcccacaagagaatcattccctgaaaaggtgaaacagtacttttgttattattgttgaccagttaaagaactcagttgtcaatggtttgtagagtttgtcaaatatcaataacaatgtaacttaccaggctagctgctgcgctggctttcccatgttccttgttcttgaataaccagtttccagaagctccgctactggaagaatcagatggagcagtcatcaacttatcctgcacagaagatatggtcttgagattcattctttcctcggaaagaactaaaagtaacatattgtttgtagagctaacctgaccaaatccagcatttacgaatgcatttacaaatgttgcagctaaattttgtcttgcagaatcaagactggagctggcaccacgcccatcaattaaatggacctgtagattgttaaatacaaatattaattattatgaatgaaaaaagcaaccttaataaacattgatagtaaaatatagatgaccttatatatatcctctggagattttgcttccatcacttcgatatctcgagcaagggtgaggtacccctcactcagcttactattattaacgatttcttgcaaaccctccttatcattgccatcggcagctatctcgtcgtcaatctccatggccaaaccctgcagaagagaagcgcttgggtcaaatttaagggattgctacttttagcataagatgcaaaaggtggcaaccaaggtagatagtgcgtgagagatttatacatggcgtgcaatgatgaatgagaactgctttttgagctgaagatcctcagttgcggtgtagacctgcttcacatactgcattgactagaaacgatggagatgtacgtcagttccaattcagtcatacaaagagaagaatagcatggcaagcagctcaccttgttgtcaaggagcagagcaatccgcaaagcacttgtaaggtcttcaaacttcatgtaaatggtataagcaatgtcaagcgccaacatgtcatcaggagcagggaggtatctgtggttttacattcaaagatgcagctattaattcaattcaattgaaatttaacactaaagtacaaaattcagctactccaaggaaatcttgccagattaggaccacaggatctacagcataaaaaagtatacaacacgtggaaaaagagacatataatggaggcaaaaaacaaaacaaaaatgtgtttacatacttcgatgaacttgtaaggtacaagcaagttcttttgtagttcgtagagtcaacatgctcaactagcaaatcaagatcttccaccttcaaaggagatgaaatgtcatgcatcagcatagccatcagtagacagattgtggtaataataaaatctgagttaattagtacactatatgaaaatacctccatcagaagatcaactgcttcaggttcagcattatgctgcattacaaattacaataaagcaccattaatgcattaattatgtcaaacaaataacaacagctacagctactaagtggcatcaatcagagcatcaaattaaataccaaaaccaaaatctctgataagaatcaagtcaaccaaccttcatatggaatgaaacaatttgctgcactagttccataagagcgtcaatcggcatgtcatcatcctgtgaaacaattaattattgaatcaaaggttccaaccactcaaacaaaacatttaaagaaacgttgtcctagttacaggcatcatggaattaaaatggacaaatagtatgcatggcgagagaatcacatagggggcaagaaagaataaacgacggtttcttaacatggtaacctcataacttatttcagctatccaacagtcatcaatgcaagtctctgggcatgttattcaaaagtcaacaagctttaacaaaaaaacaagaaggaacaaatacgtagctattgaaatagctggaatcagaaagggaccatgataggaagtagtgaattaagtcaccaaataacaaaagaaacaatttatcacaacttcagaacaaagtcatgaagggaagataaatacaaggtaacaaaaaaaatgtaaaagtttcagagcttctattaacatgaaagtgagagtggtacctgacgcttttggaattcttgtgcaatttcgcctgccaaatttctgtacaagagacagctatttcattagaacccaaatatgtaatgaaaacaaaaaaaaaacattagtataatatattgagtttgaatacactgttaaaatatcaaatatagctaaaattcaggtaatttggacataaatcagggataagtcactgcaaaataaaatgtcaaagacactaattaaaaggttccaacgatacaacctcagtcacaatcgacatattgattcaaaaaaaacattcctaatcataaacaaaactgtatagtttagaactcaatacagtgctatgactatcataaagttagttctgtcccatgattctacaagttactcagtatattggtcgcaggaatattagttaacaataattgacaaagctgtttagttcaatctcaattatttggcacctcaaaatataaactaggcacgctttgacattcccaataaaagcacggacagaaacattgtctggactctggagttcaaacatatgcttggacagaagtaagaatcaagaatgaaaaaacaaaaacttttcaaatataagtggagtaggaagtgacagttcatgacacaaatgcaagttacagctaactaacactattatcactttagaataatggcacaagcatatcataccactttagaaggcaaaatatgaatgtcaaaaacatgtaaaattgcccttaccttacgtattcatgaccccatgaaccgatatcaccttcagagcccaacaaacggtacttaaggctttcctgaaacaagtaataggcaaaaaaacattaggaaaagtactgaagtttcaaacaaagaaatatcttgttcagattagatacaaaaagcttttattgtggcaggaacatactctttctccttcagcggacattgtcaaagctaacactgataaaatgtcggccatgtacctctaaaaacagtaagaaattactatcagcattcatcgctgtgacaaagagaaagttaggctactgcacaactgggaaatcaacagacaatataccttcaaatcagaagattctggcatggtttcaaagtaagacttgagtgttccatagtgtggccggaggaatttcagtggctttggtacagatgtcattgagcttgtggcggaacgaatctcctgccttttagggaggatgatattttagtgacagaagatggaaatcaaagcaacaaaatttggtcttaaccaagtaaatctaactatggtggatcaaaataaaccctatgaaccactgcatttacaaaatttgcctggagaccagaaatctaaacctagatttcctactgggattcaggaaacgacgcgacgctaccctaccctaaaaaaaagaatcggttaattaatttcagcaagcgaacagcacctcatactctcaagcgcgagcttctgcacgccgggatccgcgtcctgcgcccgaaccacgtagagctcgagctgctccttgagcgccaaatcctcctccgactgcccaccaaaaaaaacagtcaacacaaaaccacggatcgaatccagcaaacgaaaaaccgaggttccgaatctcgatctccctcccatcggccgttgcgcgccggggaacggacgcggggggacactcaccagatcgtcatccttcttctcgtccttcttcttccacttggacttggccggcggctgcggctgcggctgcgcggggtcggacggcgccgcggggcccgcgccgttggggttctcgggcggcgccatggctactacgggcgagagctagggtttcggaggcgcgagcgagaaatccgcgggcgccgccgccgccgctgggtgtgcgaggtggaggcggtggtgggagcaaagaagggaaaggggatctccggtttgcttgcgacggaggcgacggggggcttcgtttcgactcgatttgccccctcctccaagaatggatctgtgggccttggatttttttcgcgaacgggtgggccgggcctggtgggccaagaaagggaaggcttcggctttgatgggctcattctgtggcgagtggcccaaaagggagaaccaatctggttgtctttcgagtgaatttcagtttcggcttgtcagatttttcctcttagtgccttgtttagtttttttttttgtctgtgtttatttttcttatttcactttggacccccattatcctcctcttctcaaaatcacgcgccacgtggccataatttatgagtcagtgagaatgtttaggggcagtgttggtgtgaggactgagtgtgaaaaaaaaaactgagatgattaggagaagctagccatccgatgtaattaggataggataggactagccacatattttcaaacctttcatttaatctaggtaaaatatgagcaagttcgagacttcgatgctggttctatagggaaaaagcaaccaacccttgacaaatcgatatgattaagaaatacttgaaacctaggaggctaggactaaggagagcagttaatgaggacatcaggagaacagaaaaggaggtccacaatgaaattcaaacaatatagggtcatatggtccaaggtaaaaatatgggttgacaaaagtgtatggtgaaactttggttagaagaaccaaaagttggacattggctgaactcaagaagttgacaattttcagttgaaagctttttagtttgaatatatcactggttacacaaactaaatcattagtattgtctcctagtgctaatacatagaaagctgcacattttacctcaaggttttagtattataaactgaactcaaaagttcaagttttcaaatcaaaagaactttttgttgaagattttacaaattacaaaaactaaatcagaatactatcttagtagtattaataaaataggaaggttgaaatttctagctgaaacaacaaggagatttatgtgtgcgtaacgcacgatgtgatagcaaacgtgggtgcatcttcttgtattagcgaaaaatgtggggaatacttttcccacaaaaggacaaaaggctactgtttatacttatcaaaacgttgtactccctctgtcccataatataagtgattttgagtttttgcttgcaacgtttgaccactcgtcttattaaaaaaatttgaaattattaattattttatttgtgacttattttattatctacagtactttaagcacaatttttcgttttttatatttgtaaaaataatttgaataagacgagtggtcaaacgttacaagtaaaaactgaaaatcccttatatcgtgggacggagggagtacttctcaagccaggtacacatgatttggaacttgcgacatgtctgcctttgaagaatgtagttagagaactttttacccaggatgatctagtctacggattgataagttttaaaacttcatgtatcgaattcaaacgagagggtgtgagagtgctttggccatgtatatccttgctatgtagagatcgaaagtgttagtacaattgtatcgtttcaatgtaattggggagttcaattaaaaagcttccattgtctaacaaattagccaaaagatgaccttgaatgt

SEQ ID NO: 8085 - DNA, 9029 bp, Oryza sativa
caggcacatagagttgttctccagtccagtgtccctatcaaagatagtactagctcttttgtgtagcaagtggaggaataagatgccccatgccatcactccagtgactgcagtccagagaggaaaaggcgcaaaagacaggatgatgctgatgaggctctgaatcggatagcaagcacaataaaatcataatcaacgcccatcgctttcgctttgtaatagtactcaccaaacgtccattactgatgcacaagctttgctttgctattgtgatcttgctgtggtcttgctttgctattgtgatcttgctgtggttggaccagacagccaaaaaaacacagccaaccagtactgcaataatgtttaccaggttgatccacaacgtgtaactgcacaagatcttctcaccaccaaatgctgataaagcagaattcttgataagttgaacataaactttttctcgaaacaagtagatttcacattaccaataagaacaaaatttgtacggattgcaaacagctgaagaatgtaagagcagattggaataataacacaaggcaagcatagcttaataaagaaagtaaatattccagtagtgtctccctctcccagctagcccaggaagcagcacagcctaacagctacaaaaatttccaaacatagttgcatacggaaaagagaaaaacatggaagccgtccttaaccacaattcaaatagaccccgtccttaccactcctcccaaacgagaaagttggtcatattaaaacaaaaacaaaaacaaacttttatccagaaccttacttcctaagacataatctagagaaggtcagcgacgttggccggcagctcctcgatggtcacattgtagaacctctggatgtcgaacagcatcctctcatcatcgcgggtgacaaagttaatggcaactcccttcctgccaaaccgaccactacgaccaatgcgatggaggtagttctcaggctgggtgggcaggtcgtagttgatgacaagggagacttgctggacatcgataccacgagcaagcagatcagtggtgataagcacacgggaagaaccagatcggaactccctcatgatgatgtccctagtgttctggtccatgtctccatgtgtggcagagacagtgtggtccctgctcctcatcttgtcggtgagccagtccaccttgcggcgggtgttcacaaagatgacactctgggtgatggccagtgtctcatacaagtcacaaagagtgtcgagcttccaatcttccttctccacattgacgtagaattgcttgataccctcaagggtaagctcatctctcttcacaagaatcctcacgggcttgttcatgaacttgcgggtgatctcaagggcctcaggaggcatggtagcagagaacactccgacctggatctttggtggaaggagctggaagatatcatagatctgaaaagggaacaccatatgtaagttcagaccatgcaacactacagcataaagaaatgaaatacaacttccataatagctcatcaaccattagacacacatagtacatgtattaaaaatatgcagtcatattgttgcgttaacagatagccaatgaagcaggtgaaggtcagcaagtaaaaaaaaagagagagagaaactgtaagtcctaaaagagtcctaaaaatgaactaccagctttacaaactagtaatcacctatgatttcttcaagaatagtaacattaagtcataaacataagcatagcgcgcactcagataacaattccataaatatgttgtacttatatcagattttgatgcttgaaacactcttaaaacacaattacacaaacatgaacactacagaagacataatgtaaaagatcagccatacaaactgttggaggtattatagcagaataatgggctggtcagaagcaaacctgatccttgaaaccacgggagagcatctcatcagcttcatccagcacaaacatcttaatgtggtctgggcggagagattgccgacgtagcatgtcaaacacacgtccaggtgtgccaacaacaacatgcacaccactagcaagaatcctttggtcctcacggacagaggttccaccaacacaggcatgcaccttgacacctaagtagtcaccaagagcacgcatgaccttttcaatttgctgggcaagctcacgtgttggtgcaaggaccagggattggcactccaccaatccatagtcaagttgctgcaggatcccagaacagaaggtagcagtttttcctgttccagattgagcctgctgaatcacatcaagccctttgcagaagggaacaatccccctttgctgaatagctgatggcttctcaaaacctacacatcaaagtacagggatttgtaacatcaccaaaatatgtgttgttgaaacaatggaaaagggataagactttttgtataccataagcatagatgcctctgagaaggttctcttggaggcccatgtcatcaaaactctcaaaaacttcatcatatgaagtgaagaattcctcattgtcaccttggtgcctgcatgttgcgagagacacaaagtccataatgaaacccatatagcataacgagtggtgcaaatgagaaatcaaacatccattagctgctactaagattacaaatacggtagaatagaacgatggcttacagtagttcctgcatcttgctgtcatagtgcttagcatcaaactgggagccttcgggtgccattcctgccatggctgtattcaagggaaaaaaaagagcaggttacaaaggatgaatggcaataatgtttgaaggacacaaagtagtagtaaactcagttgtaaaagcagtcttgacccgcacaataaatgttagtacatttatagctttctgctgcacacaaggaacatagcacccatagttgaagtctatgcacgacacaacatgatctcttcgaacagggtttatgcacaacacacaacatgaaatcttcgaaccgggaaacacaaactcgcaacagtccagaatttacttaatcgacctaacaggttagagatcaagctcagtatacaatggatactgcatgtggagcttaatctaaggaatcctcctaacacagcatactcaataagcgaacagaccaaactagttggcccaaaaaagaccttcgtttggtccataaagaccttcgacttcctatggttcctccactgtccttggcatacaaaggataataatctaacagtcatcaaagtacaaagcaggacatcgaagtgcttagcaggacaaataatctaacgcagtcattaaaaaaaagtacatatactagcatgttacaaattttagatttgcaaacactaggacacccaaaacatcaattactattgtcaagcaccacataccacttctatagctgctcaaaaggataacaaacatgccaacggagatataacaatctaaacatcattaaagcaatcaaagtcacgcatctcccacccaaacccctctctctcacagactcgccaaaatcacatcgaaccaacccagatccacgcccccaccacccggcgacacccagatcgagccagcgccaagccggaccaacccgaatccagatcgagcacaaacaaaacagaaaaaaaaaagcatcctcagcgggatcccatcccatcccatcgttcattgttacctgaagaggagcggatcgatccggaggagggcttgtgttggttgaaatcaacggtctcgaatccgagatcggcgtctcggactcgattcgattcgtcgggatcgcgtgggcgctgggaggcgctggctttttcgctgcgagcggcgagaggaggaggaggcgatgcgacgattgagggtttgggaggagagagagagaaagagagagagaggttataaaggggacccgacggaggcggagcgcggctcgacctcttctctcttctcttctcctcgtctcgtctcccccttcccgttccgttccgttctacgggccggctgctactgtggagtgtggagtatgagtaagacggggggtagggtttgcttccgttccgttccgttacgagcacgagtggtgggcttgccttgggcctagtgtccgtgtgggcctttcctttttttaaaaaaaaattataagcacagttacaccaccctcatcctaaaatgtagcaattagagagataacgtactaaggtgtgttcgggaggacgcaaaacgaaacttgtattattgcatgattaattaagtattaactatttttttaaaaaatagattaatatgattttttttaaaacaactttcatatagaaagtttttgcatatgtcacaccgtttagcagtttgaaaagcgtacgcgcggaaaacgaaagaggtgggttcggaaaatggggggaagaacacagcctaattttttttacaaaagtcatactaacaaatttttataaccgtttaatttaattagatggatgaaagttacaagagatctagatttacttagagctcatcacatcatagtctataagtattttgtaaggaaattttagtacgtatggacatttcctttctgtgtgtgtttgtgggatggttggttgccaaaggtggttcgaaattctgcgaaattcggctggagtttgattaggtttcgttgtgtttttggtctagacgtacttgaattgaatacttactgttttctgtgaagtttctgtgattgcgacgatgactcccggggtttccttgggtaacaaggtggtgttgtttgacacggtgagaaaaggaaaagaaggaaactatgcaaaattcagtactttttggatggaccggatgtgaacttgagcagagttgcagtatgtcatgttgcgttgcgggcaagtaattaattagtcggcacgacagcaatcgcgcaagaacatggagcatgggtgcgttgcgagttccaacgcggacagctcaacgcaaccgacatggggcttggatcatagaagttcatgttaagataattgaattcattttggcctatgcattctgacattagaataccatattaaggacatggattattttcatcagcttgatttgaaaaaaaaactacttagaataccatattaaagactactgactgaacttttgttcaattagacaattaggcaaggatcatctgactgaacttgacacagcaagtcggcaggtggaggtatcctgatagataaacagatcacacaaacaactcaaacatcgcaaacctgccaatctcacaataagagaacattaatttgcagctttgcttacttcgatttcattttttctcaggtcaagaacaaaatttacatcaatgcgcggttgcaatctgagtagtgatcttttactccgtacagtgatgacgcaaaacttacaggagattagctactacaactaattacacttcgcatgtccatggaaataaggtaccatatacattaattctgaaccaagtctccgtatttcaggctccttgcagcatatggctttactctcagcttgctattcttgcccaactgcttgtggagttgtggggtgaaataggtctcaccacctgcagaagaagttctggttctgaaagacaacataccttccatgatacattgatgcctccagataggctcagaagtctatcataccaaagatgctctctactgaaggattcactaaacaacctttcatattttcatctttatttcctaaacctaaactcaactttttagtaatggacacaatttctcggtccaggaatacagagaatgcgaccaataagaggatttaaaaaaaaaattcgaagggctatacctatactgtactgcactagtcactagatattagtaatggtaagaatagggcctcaaggtagtttgatgtacaattggttgctcctatagacataggaggctatagaagacaaggggtatgaaagcgttgtcagttgggctgtatatgcttccaataaaccgctcaatgtcacagctaccaaaagtgatatccaatgctgtgttaatataaaagagatggtcaggatttatgcttgcttagtatattgtagaataaaagcttcaaatggtttaatgccagggggggaagtaaaacctgtgaaagtatgtatccacttgaagctaagagtgacagcaggattgagcaggctgctaatacagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacctatcattgatgcctaggtaaaacaagagaattcatcatactgaacgcagctaacataagaaaatattaactgatcacgcactggacatagaacctaccatggtatcaccaatacccaagctgagaattccagcaaatggtgtaagaggtcggtcattgaatcctgatgacatccatttaggaagtgcacatcccagcaagagtgagaaatgactgaccaaaacaaatatagtattaggcctatccaagcactgaacatgtaaatgagttaaaatctggaaaacaacgaccattaatccagacctacctaacaattagaatttccgaatcgcgatgatcagtgagggcactcatgaactgatgcacaatatgcccaagagggtatatttcccaaacctgaggtcagagtgaaacatttcgtcggagaaattagcacatgtgggcatacaaactgccaaaaaacagaaagaggggggaaaagaaagggacataaataaacaaaatgcttactcgaaccatctccaatattaagaaaacggcaaatgctgcaccaaatgctaagtccaagaaatcaggctgcaaagagaaacaatttattgagagtgtgtttcaaacaatctgatggggatcgaatatcgaaaacatatattacctgaaatattactgcaggagagaaaattaggacagcaacgagatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtgaatataaaccattaagtgaaccaaaattcaatacgtacaaaaatgcacaaggtttagaagcaacacaggaagaaatttttcaatatttgactaacagagtgcatgcttttatgcccttccaatgaaatgcaaacttatatgctcaccaaacaaatggatgcacttcaaaaccttgaataagacgcgtccatgatggcactaacaacaatagtgctaccaacaatgaaacataaaatacaccacagtcaattctcttctgtgtgcattcctcaactgtttgtgttctttgactctccagttttctacagtaagccaaaacttgaagggagcttttgtataacaaggggagaagaaaaagaccaagcaaaaccccctgcagaaaagaaaaaaaagggaagggtattatgcactaagaaactgaagccagagaacgcaatagcttctacctgaataactgtgcctatctcgcttcgagttccaggtgcgcgaataaatgcttctgatgatacggagaactccatctgccagcagcacggttgcaaatgtgcaggcaacaaaataagtatcagatttgctaccattttgctggtaaaacatagttcgaggaataaatcacacctttgaaagagtatgagccagcatatcaccacagtaaagaacaagaccacttgagaccaaaatggcctcccctaagttcacagaaaatgtaaagataagttaaaaaaagcaatagcttcaagtcatgatgaaaaggagacatatacattgcatcggccaataggaaccacacaaattagctgaatttaaattttaaaaaatgaacagtgtagatataatgcactatgcctgcatggaaaactggtaggataactagcaatcgtatggatagctctaaagtctaaacatatgcagtcagatataaacaaaaaaataaagatctaactacatcttagacttcaggtacaaaccaaaagatgaacatgaagggaacttctctagaatatgctggattaagatcacagcagccactccatgacacagcaaatacaccaaattactcatcaccagcagacctgttaagacaacctagattagtttgtaattccttgcttctgatgaacttccaccagattttggaaagaaagggtgagattatgtttgcatgcagataaaatatgcatgtacctccatcagtcttcagtaaaaggtggaacaagtatgccaggggatataaaatgatgagcaacaagccgtatttcgaagctatagaatttccattgctgggagactgccgtagatgccaaacaaaaaatgataacatgccaaggcagctaacagatactgcccagtactgcatttcaaggtatgcatattctgacaatgaacacatatgtagttagtaaaccagatgcgtcaccgaaaatcttagtgtcaaacaagatttgaaatgttgatgaagatttagggaaatttccatttagcagtggatctgataaatttgacaaaatagaaaaatggataccttcacgtccattaggatctgctagtaagaccctataaagttgaattaaccgtgaaagcatgacactaggcagagtagtggcaccaagaagtatgcctgatgaagcacccggcctggagcatatacatatatcatcatcaagcacttaacaatcttttacagaaacatgcacaagagcatcaagccaccacaagaaggtgaagtcctcacaacacaagacgtgataaaatcttacagtaagcaactaggattgcacatcacagaacccatataaattttttgactaactcaccggggggggggggggggggg

SEQ ID NO: 8086 - DNA, 6594 bp, Oryza sativa
tccccacctgaattgtcattgcataaaagaacccatataaatgacagtgggagcaacgttttagctgaaaatgcaatggaacattattttggccatcaaaatgagagcaatattttgactggctgtatgatagaagcacctctgaatttaccatttgtgaaatgggtcaactaagaaatgctgaaacccaattattcaagagtgatatttgtcccttggattcttggaaccaccaaaacctgaccattttacacactactgaaccaaaagaaaattcagtaagcctcaagtacaagtaaaatcgcattcctgcggaatgctgaatccgactgatgtcgtttccccaattgcatgatcctcacagggaggcagccagcactgaaccaacaaatggatcaattcgcctcagattctacggctgcgccaacgaattttgcaaaacactgcacctcgcaggttccctgacatcacagggagctcctcgaacacttaattcgtggagtttgaaactcgaacactggtatcaagatcgcgcaatcccccgagctaaccaaatcgcgcgaactagcagcccagctccgtggagatgcggcggaagaagatacggataagagcgggggggaggatataacgtcgcacctggtcctgaaccggcggagcggcgatgaggacgcggaggcggagccatccacggcgagctcgacggcgagggcggccgcggcgaggaccgcgagcggggcggcgagctgggccggcgccgcgagcgcgacgcgggcgacgaagaggaacacgacgagcctctcgcccgagaccaccgccggcgccatcgccatcgccatcgccggcgaccgaggaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccagacatacataagtgacgttccaggcatagtaataacattaataatacagactctaataataagacaagttcacaatctcgatagtagcttataacatttttttgctaataatacagttattgggacagcagtaatactatgttgatcattttctcttcagagcggaggggatcatgcaacggcaacaaagtaaacattcaggacagatatcatctccttgggatctttaatctaagggaactcctcagcaaaccgggtcaaaataccctgaacacaaaaccagtaacaaaaacgtcagtacatcagaacaggtagcaatttatcattacattacacaagtaaaccagggggaaatatatcctaaacattgcacccccttcagaagcaacaagcctgcaaataaagaaaaaagaaatgcaacttcaatgaaaatgcatccatcacaagtaaacaccataaattgaatatcagctaactcaaataccaccgagttcaagcttcacagttcacacgcatatattggatgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatgggtcatatgataacaataaccaaggctttggcaccactgaaaaggagcaaaccgaacaaaatagctgttggtgcaacctagtccattcaatataggcagctcgtgatagatgttcactgaaaccaagtaaccaagaagaccatagaattctaacatatcaatgtaaatgtaaagtgagttataaaaagctgagctctatttttctaagttgtttcaagttaacattattccaacaggtcaaactgcctaaggcctaataacatacagtagcccaggctaaggatgcccatttgttgaggaacagtacaaactgataaaacacttgcaaggacagcagtaaaccaaaaggaatcatacatacgagtaatgcaatggttgctctttagaaaaagaaagcacctgaatgaacaaatatgaacccatgatacaatatcacaacttacttcgtaactaacagcagaagtttcaataatatatgccacaaaatttaagcaaaataataggaaagaaacaacacttacattgatcagacaaacatcgccagctctggacggctgtagatattatccccatcgtcatccagtgcaggataagcagcaacaagcgcatcttgtgcaccaatatatagtgagttgtagattttccaatatacttcacgtactttccttgctggatggaaaaggccttgaaggcagtaattcaagatcacagctggaccaagagcaactctcatcccctcaatcgcctccatgacagcattgatgacatggggagatgtctcaaatatgtttggccagacatagttaagcaaatggacaagagcatcctcacagcccaagccagcaacaccaagagccatgtgcttcacagcagaggcagcagtttgccggtgaacaagatctctgtccattagagcatcttcaagcaagggagtaacagcatatatgtaatccttgcccatctcaccaatatactcaaagaggaaagagagagacttcaggacaccattctgaacattgagttctgggactcggtactcattcatcagggcaggcagaaccgtaaaaggtgagcaggtttcagcaacaatggcaattgcgacagttgtgcagacacggttttgccgttcctgcaccttcaagttattcaacagagtagccaacacatcctgcggcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttctcatgcctattcttcaagataggagtcagccgaggaagaagatccttgattggcggtgtcatcttagtcataccaatgacattcacaatagctttcaatgctccaagaatcgaacccaacacctcagggtactcttctcccaaatactcatacagcacaacacccaaatgacccataagctgctcctcctgacactgtttcatcacaatagctatcctcgagatcagatcagcagcttgttgcctaacttttgcactcttgttgttcaaccgccacttaatggtaccacaaatctgaggaaggtaaggcttgaccctctgtcccagtgcattgacaacagctccaaaaccattaagcatgacatttgcatcatcacttgtctgctcttggaaagcatacaggatgccatcaataagcagctcctccaaacgagcatcaatatctgaagcacccaaattagccacaaccttctcaattgtttccatcaccattctcctgtaaggctcgctttcatctttcagatcctcaacaatcctcccaacaatatcagcaactccaaccttatttgccatctctaccgttgtttccacaagctgcttatagttcctgcggtccagaaccattctcctaacccagaagtgacggaaaaactcaggaaggatgtcattccggatataatcagcctctacaccctctgtactgacacactgtttaacaaccttcaggacaatcttcttcatctcttcatctggtgactggaactccctaatcaggatttgcatgacctccttcgtgtagtaactggcatacagcgcatccataagagggatgatgaaaccaatagctttcaagaaggcagcaagaacctttccacggtgagatctgatacccttccacagaggcttcaaaacagtatcaaaactttctataccatatggtgcagcagcctcagcaagtgcagcaagagaaagggcagtgattgtccgcactttctggttctcgtcactaagaccatgctcaatgatctcaactagggacttgagatgtggcagaacagcgcagcccataagaatagcaatctgctgaacaatcttgataccagtgtgccgagcttgccaggacttcttactctgacagacagcctttaagaatggcaggagagcagggatacccaaagcagaagccaccacgctaaatgctctagcagtggtatttctcacatactcatcaatgttatcaatatctggtctcatggcggcaatcatggtagcaagaccagcagctttgctaagatttgagataatctcccggccctcaacacgagcatagtagtcctcatcaatcagaagtggctcaatgaccacaagaatcttatgcacaaacggacggactagctcatccagcttatacagtaccctgtcaatgaccttcaccagaagatgccgctcctggtcctcaagtgttggctgcatgagcaagggtagaatcttgttgaacaatgggccagcaccaaattcccttgctttgtctgtcagttgtcgaagtgctgtcttccgctgtgggggtgtgccattcttcaccttgagcaggagcttcatgatcttcctctccttctgctcttctggagatagctgctcctcctcctcctcattcagcaatgttccaaagtactggtaatcctctggcttcatgaggggcaacccaccaggcaactccttgggcacatcaaactgctgcccacgattctcctcaggaatagcatacaatggtgtgcccaatggtgttggtgtagcgagcagctttcttgctggtgtgcgtatgggttggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaacgattccttctcaccgacggtgtcgcatccccgacacgaccaggggtggcatcccagcgcccaatcccaggagttgcatcaggagcatcccaatcggaggaggtcttcgccttcttggatccagcagcagcagaagcatcaccatcctgcgactgatcccatctattgcggcgcttcggcgctgccactggctgctgctcgggcacggccttcttctccttggccttctcctcctcttccttcttcttctgagctatgtcacgcagcagctgctccttctgcttctgcaggtcattttcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcgggcgcgtcgtcctcggaggcggggatggaggtgtcgtagccggcgaagcggttggggtcggagccgccgccgccgtagagatcggtgtcgaaggtgacggaggagacggccatgggcgcgccggcggcaagggcctcctccatcttcttgcgctcctcctgcgcccgcgcgagctccgcgtcgatggcgtccatggcgacggcgcggcggggggagaggcggttagggtttggggggtgcgggggggggggggggg

SEQ ID NO: 8087 - DNA, 1653 bp, Oryza sativa
aagagtaaaaattcgtgacacgttgtcacgttcatgtcaatctggcacgttacgaatagagtctcgggtccacgttacacgtttgatacatgggacccaccaaggaataataattaactaatttaccaaagtaactaagaatttaccacggggtccacatgtcatagacatgtaatgacccacatgtcatagatagccaaatcttcaaagtggcaaaaaaattaaatacccaaaacccccctccgttaaacccgaagaaaaaaaaccgcaccaccagcgtggcgccgatcggagccaccggataaatgtggaaggtcgccgccgacgcggcagaggggtggggcggctggatctgcgcgtcaatcctgctgccgaagacggcgtccgtcgtcgccaacctcgtgcgtcatcttcgaggtccaaagtcggcgacgccgccgacactcgcggcacctagaatgctcaacctcgttgtcgacgcggtgacggcgcagttggcttcgcgctccgccgacggcgtgccccactctcaccgcgaggccagtttcccctcctcctcagctgtcgtggaggacgtcgcctaaaaccctcaccttcaacgcgttggcggtgtggcgtcactggctgtcgacggaaaccctcgcctccgatgccgtagaggtggaggatcgagcgccactaacaaatccatggattccaccaacgaaggcaatggcctctatcgcggcgcctcctctgccagcgtcgcggactacacccgcaggcccggctaaggggcctcgggctgctacttggtcggcatcgacaactttctcacgtggctactcgacaaatcaattcatgaaggtccaccaacgatgacaagagtcacaagatagattctcaagtcctttttaggccctgtttagttcacaccaaacttcccccaaactccaaactttccatcacatcacatcacattacatccaaaactttcctactcacataaactcctaacttttttttttccaaactaccaaacttctccccaaacttcggaactaaacacagccttagtcaaatactagtacaatcttaggcctagctccattaggcaatttatcttatgttttcggtggcatgtcaaacaagcggagcgattagcaaatgactaatcgagtgttaattactattcctatcaatttaagaattaaattcatttaactatttgataaagatatttttatatagaaaatttttagacgaaatacactatttaatagtatggaaagcgtgatcacattaaacgagtgatttcttttagccaaaactccgttaagaactcaatgttgggctagattcgaaagtgagtttggattggaccactttttcattaaggcgttaaccatgagcacgtttacaaactatttaaacaatgtgtttttaagtacaagtttctaaaaaaaaatcaaacacatttttaagttctaaatcttaattaattgtgtgttaatgactacttttgttttgttttacgtgaattggaaatctcaatcaaatagtagtagagcacttcagaacttagcctaatattttttttggagtgcttcctatttttgaagtttaattttatacgagagatttaacagcccacctcgcaaaccccaaaccccc

SEQ ID NO: 8088 - DNA, 17840 bp, Oryza sativa
cccccccccccccccttacagaataccaaaaaaaaaaaaaaaacgatcaccccacaaaccccccgttccatctcaggaatccccaaaccaaaatcatcagttcatcagcgcgaaatgcggaaggcggcgaggttggcgagggttctcgccgccgcggtgtcggcgccggcggggcgtcgctccatcgtcgcgccggtgcaggtatcgccgtcatccacgtctagttctccccgtcgtttgtttccgcgctaatacgttctcatctacaggagtttttccggccatggctagggtggtcgtcttcgtcgtcggcggttcgtgcgctgcctcctcagttcgcattctccactacggtgccccatctccctcctcggagcgttgctcccgctacgtccgccgcgatcgttcccaccgttcgttcaagccccccttcgaggtctgccgggagcccgtggacaggaaggacggcgtctcggtggttcggaacgggagcatcatctaccgcggcgacgcctccttccctgcacacgatgaaaaccggcgagacttcgtctcctacctcaccgattgagagtttgagactgacgatgcagttccaccgtcgactacccctcctccgcccgtactcgacgagatgtcagattgcttttctccgccaacttctccgcaggatacagccgcttatctgcacgcgctggatccaacagtacagtaagtctccaaaagcaaaatttaccctgcttcgtggagagagttttttcattaagtggcgccgataattttatagtttttcattaagtagtgcccataattttatagtttttcattaagtggtgcccataattttttcttgaaccccataattctgtatgtcctccaattagtgaaatgtgaaaaaacaaatttgaaccccatagttttttatgtcctctaaatagtaaaatgtgaaaaaaaaaacaagttcatgactactctgagttgcgaagcagagctgggcatgcaggtgcagtgttgtgcagtcagtagagatgcaaccctgatatatatatatatttcagctaaaaaaatttttagaagcaaactagacatgtcttatttcagctaaaatatacagtataccatatatgtgccaaacatcagcatcattgaattttacactgggaacaccatcgactacccaatgaaatgcaaaatgataggaaatgcttttgcttgttgattcatatggtttgttccctttgtctgcaggtatagggataaacattctctagaaacatgctatgagcccttgttcttcttcagaaagcatcccgcagtggagtttcatcatccaatagatgcgcccgactccatgtttgatagagtgatattaacagaatgggctaaaccagctatgagaggggtgctggagaccatcagcagtcatcattctgcgaatctggaacttacagagttcagtctgaaagatctgaaaatattctgcaattaccagaccccggaattcaaaccaaggttcaagttagtttgcggcacaaggaatgctacatgtgaaggaatgagaatgaattatatccaagcaggacagattttcaaggagatagttaatgcatcgctgggaacaccaagttcgtgggatatcttaattgaggattttcaggacttactgcagatgttagaaaatcccatccttgaggaggcttatctgatgagaaaccaccctgctttgcttgcactgaaactgcactcacagtttttcatggcatgctatgaaacattgatgagggcatcacttcaatctgtgttcgaagtgttcaagatgctaccctatgggatgaatgattcaagtggtcactggaaggtacgtctagagcaacacccgtacctttggtggatgctccacagtcagtttacatcctatggagacagaaactctgagcagtgcagataccgtcggaactactcatgccacaagattatcatctcacaaaaaggactgaacgattcaaatggtattctgcaaatgatgttgacatgctgctttaccaatatctacccatgtcgcttcctggcttaatgagagcaatgtgggacgaaggactgcttgcccttttctgcttgggtctagatgagcttttcaccaagtgaaccggtcatatctcctggtggcaagtgaaacacccatttctggtaatcgacgatgtgacaaactcagtcttaactgtctggtaatagtttttctgctgctcacaattcatatgttttctctggagtacatttctctcaaacgcttcagatgatctcgttgagtgagggttgggctagtactgtagcttgctgttactagtacattacttctcatatccagtcctctgcagtgaggggtggggttattactttactgtcgcttgctgttactacataactactcgtgtaagtatatctagtactcctggattacggtttcgacagaatgtatagactacttttgtccccccggaggtgtgcttggaatttgtattccgtattgtataatgctcacaactatgaaacctcttgtatctagttagtagctagaaatttttcagataaatattcacacgataaacttgggagcacaatatttttgcccttgttatatatttccagttgtattataatacaaccgatccccccccccttctgcattgtacttgttttgggtaaatgctatgccggtgatctgtcaaaattatcaacagagtagtatagtgggtaaatctccaatctgtcattttattggaagcagtagcttgcacttcagtacaagcagtagggtttttcagcaagctccagtaaatctttatgtcctatcaagaggatcatcgattcgattcacaagggaatgtttgctacatggaatcaggaatgtttgcttcaaattagttttgtcatcttgagctgaaacaaagggttgatggaattttggccattaccaatctgcgcatgcttacagtctctgactgcctgtgctagtagaaatctgtcattgtttccactcatgactcatgtagcagtaattatttttttgccgggtcggtgaacaggaatcctactttactttattatgggaggaaaaaaatacagtaaaacaacaagcatggttattgccaacttgccacacagtgaaacctgtcattgtcttatctccactcatgtaactctaaacatagtacatacttgcggtgctgtactggttagagaatcagcgagtagaattatctctcgagcaccaatggaagttgcggtgtgagagattgctacagtctactggttcaagaaccagcgagcgagtagaattatctctcgaacaccaatggaagtcgcggtgtgagagattgctacgattttactgattcgagaaccagcgagtagaattatctctcgaacaccaatggaggcgctagagttggtttattacatgtgtatctcatgtggccagcatgacttacatacccaactcgtagcatatccggatgtctgtccgcgatcatgtcgggtgatcaagccgacattgttcgtgagcaattatccgttaacaaccttttctcgagtagtccagccatggccggtgtatgagataggtcgtcggtcttcgttggttggttgggcgcgacgactctgcatttgtcaagaacgttcttgataatgcagtgtactcgaccacatcctactcaagtgctcaattgttcctgaaaaatactttctagaaggcaagatatatagcagagaatatcgagtaggtactcaaagaactacatggatcttctagtattatcaggatgctacgagcagatgtaaatatcaggcattacgtaaaccgtaaacaagcatgattcatacagaagagaacagagcaagcccccagcgttagaccgtagtcggtttaacgtcggaaatactcgtgcaatagatattgtataaaagacatgctctaggtaaacataataaattatagatctgacaattctgtatgatctgaataggtatgataaattgcatataaaatattgcgtacctttgtagatacatgccggatgtatctacgaaattagtagattaatttaaaaaaccaatctaccaattactcttaccgcgtacttgtttgacatcatatgatctgacgtcttttggtacgccgcgtatcttgaggtttggtcgatctcgagagatcgagttgttgatgacgatggttccgatctcgtcgggagacatacttcggtcgggttggatcttcccacagcgaagtcgtcgaatagcttgttgtcagagaatccatcttttgaacccatctcgtcgaaaccttgaagtaccaaactccccctacctagcgcgccattgtcgacgtttgatgtcgcgattccggtatttgcatggtacggggatcgttggtactaggatatacgcgagactgagataaaagagatggagacggggatttttatacaagttcgggccccttatctgacaagtaatagccctacatcctgttggccaaagccggttattgatcttattcatcataaccacaccagtacaatgtttggagtagcctatctaactgttgtcgacatggcggtctgaagatctgactcgtagtcgacaacagagtagcctttctcctcgaatccgtgcccggcgagatcagagatagcgctttcgtctctcctgacagtatccgaagacaccgtaggggactagccgtgcttatcgctgaagtcgatatccggcggcttgtcttggcgtatgtaggcttgtggttttatggcgtctatgttgtccgtgtatgttgattgtctctatatcccctctcctcctagggggtcttgtatttatactcataggtgtcaccttgtccaagtagaactaaggaaaccaatatgaatacaatccgagtagtccttgtcgtttccatgtagaactctggttgtcttttcttatccggaacttcatccatatccgaggtcagattccgtataagacatggtatgtgacgggtcctgtcgagatttagtcaactattattagatatatggtatccataaccctgacaagattaatatgatttttttcaaacaactttcgtatagaaactttttgaaaaaaaacacaccgtttaacagtttgaaaagcatgcgcgcggaacacgagagagagatgttggtaactaagggtaccgaacacagcctgagtaaagtttgaggcagcaaaaacgtcggataggaatagttggatttatactgtttgcttgttgccgtgggatgcgttagttggttcggcatacgatgcgatgagaaggacggcgatttttttttacggaagaaggtagagcgcgctccaccttataatcatttcattaatagatcatttcattaatagaaatgaggttttcaggttacaagttagaggttatagttaacctagaacagaaaggaaaaaaacgaaaaggaagaagagaagaaacaaaaataaaaagaaaagagaacggggggtgggatttacaaagatataaacaagggttcttatactaggagagcctggtacaccaggattgaattttctgcatgtttgattcattggttctcatgctccaaagatcaagggtgtctgagacttgctgtgtgatgtgctgtaggttgtcaaactgaccttcaaacactctgttgttgcgggatttccatagcgtgtaggtgcaagcagcgaaccaaattggttctattccttttgaagaccgattgctgtctatgattgcttgaaggaaagccgtgcttgattctgagttgttgtctagctgcaataagtttagtttttcccatagattattggcatttttgcatcttaggagtatgtgatcagctgattctagtgtcaggcaaagggagcagtggggatcttcattccattttttgctgaccatattggctttggtgtttagcctgtctctgaatgctagccaaaggaaaatcttacaatttacctcagcgtactcagccgatggagcggcggatggaccagcggaggacgacatcgttgcgagcggaagtttgccggagctagaatcgctgtggagatcgcctttcttcgccgaggggatcgccggagagagagaagatagaatcgcttcggcggtgaaaacggaagtaacggtgtgaagtttctcgggggtgacggttagtatttaaagcggagcgataacggtcggaaaaacggcaatatgtgattttcttggggatcagatatggcaaatccgaaacattaccaaatattccggacttgggggtcatgtgttaatgatcaaatttggtaattcaaagtatcggagattaagataaaatcgaagcggaatccaagagatagatcgttccggaaatagagcaagaatcggctgaagtccgaatcggctgcgaccaggtcagtagagtttgagtcggacaaggtagccgattgagccgatttcgacaatgtgactcgatacacatcgtcgggttgagctaatgtgcttcatatggattgccacacatggattgagtcctaaaaatggcaattgtatctattaattaggatattttatgtaatttccttagagataagtttgggcaaaagtctgccgtaaagacttatggtatcttagagtttattagagataagagtcatgtccgacaaggacatatcttgtatctcgggtataaatatgacccgaacccatgtaatcaaataacacacgttctatacaatctcggcgcatcgccaccctttttactttcgtttcatctcgacgatttcttactttcgagttgagctgcatcgtttcgatcttcaactagaggtaaacttgtcatggcggcttgcgttctcgggattagtgcttacatctttatgacattctaatcttgtttatgcaagttgtcgatttatcatatatcctatataatctctggcaatattgctatttaaccctcagtcggctaacgtctatcactggagggcagccgattaagttaaatatcaacgttgacttagattatatagggtatccaccaccctatgaaatatccaacggcatgattgtctagatattgttattcttttcatacttatagctgcatcagttgagtttgaccatataagtcgtgattagaatctcaatctctagcctgcttttggctgccgattagggtttcatcagggtttcagccaatcttacctgatttaactactttatatcccatatgcttgattgatatgttaaatcttatgttaagatctcatcacatttaggtatattaagcttcttgtttggtatattttgcttgccttaatatcttaatatagagtggtatcggagtattagccgatacatgctagatctatcttatcggctatgctatgaatgcttataatctccttgttaatgtatatttcgatctaagtgatttatactgtctcggcatggcgaccgatctatcccaatcacttgatttaagtatatatcgacagaagtattatataccgttaatatctacagccgatcgagtagatttagttctttcttgtttatttatgactgccgatcgattcaaatatgacatcggctcagagataaatgatatgtcatcggcgactggccgatcggctatcatttatggatttaatcgcggtttctttgtatttatttcttgttgattgcaggatcaaatcaactggcacgctcacgaacctaaaggaaagatttttggacctgcactaaagttaagcagatcttccaggccactgtgtgtttttcgcatcaacaagtacaagtggcctaacttatagaattaattgctgtacccaatgctaatttaatctatggacttcaaagtactagacacactatttatatggactcatttttcgaatttactaaaattatgtgatggttctgcgttttgttttgttaacaaaattggtgatatttttgaattcaatgttcacctacagagattattgcaggtagtacagctgtgatcccttctattccccatgcaaataccactggtcaatggcagggagggtttgcgtggttcacaggatccagccaaatggttccccccatgcatacagaagctggaagctctcagttccaagtatcgttttccggtagttcaataaacacacattttaatgttcatcattttgtaatttactgagccacgcacatattttcttattttcgcaggtgtacctcaagttaacatgcccatgttttcaacgggtatgaatgattagtgccaaggagctccaacattcaacattggttcgtaaataatgtgtttcattttttcactatctttatattgtgatattaatttagctctccacctgcagggggatgtatcaaatgtccatgaatgaaaacacacaaccacaaggaccaagctttctcgaaatgttaggccatggagattggttgttcaatcaaccacctatcatgcaaccacaaacaacaggtacaacttataatttactagaaaataatttattttcagtatgtgtgcacgctacaactttgcattcaatgttttgtaggaatgtacaaccctgaacaaatgatgggatatgccggcagcatacagtcatacggagaaccatgtagctacggtgggggctcgtcaacagcacaacacgacataggaccattgcaacatgatgaaccaccaccaataactcagccagcccaagactacgacgatgttgatctccgcggtgttgaagtcgtccgtaggtctgtccgcgagcgatattcacctgaaagattatctttgtcagggcgcagacctccaactggtgctagaagaaagggaaagaaaaaggaaactggcacgtcccgaaatttcgatgatgaggcttaggaatagaacgattttatattgggctcattcgaactaatttgtaattttttgtgttcaaactttctaatatctcagctacatttctaaataaataaatttgaaatacttacctgccttaccatcacgaacacttacaaatatttacacttcagtgggtttgaacactttgcgaattcatggcattatcttatggtaagcccctaatatgcaccataaattatcgcgtactcagttcataccacaggatagggcctgcgaattcgcaaagtgcactaacctactgaagcttacacaagtgatacgctatacttgagtccgcatctttcgtttcgcaacgttccttttataggcactcaacaagtaacctctctaaccagacgacaacaaactttcggcggacagcacgcgaaaaaaatctagcatcactctctctttgtttgtggcgagcatgtgacatagagaagacaaataactttcggtggacaaaaaaactttcggtgcgatcccgcagaatggaggcacggagtagcagtgcattgttttccatacctaattttgatcgtctgtcttatttttttaaaaaataaattattaatcacacataatttactattcatgttttatcatctagtaataataaaaatactacttataacgaaaattaaataaaataaaccatctaggttagacattgaaatttatagttgcacttaaaattgttaacgagggagttcagtttacgggagaagggtgtgggaccggcatcacggtgccgcagactggcgctgcatgaccgctcggtcccgcgcctccactctgcgcaatcgagcggcactaattggggaggcgggcccgcaggagcgctatcggttccgcggattggggctgcgggaccgtctcggtcccacacctccggtccgcgcgatcgcctggccagctgactggtcccgctaccaccaccactcagcgcagccacgccgcgggaccgactcggtcccgcacatccattccacgcgaccgagtcggtcccgcacacccgttctgcgcgaccgcattcccgcactgccaatctgcgttgccatctcgttcccgcttccccagtccacggggaaagtatatttgcgcaaatatttgactccaacgtatataaatgcatattactaaaaaagaatatatattcaaatttaattcgataaaccacatgcatacaccagcaggcaggggcggagcccaatgggcctaggggggttcataggcacccggcccaattttcagttttagtaggtaataagttcaccggaggtccctcaacttaacagcgagattttttaaggtcccttaactacaaaaccagaaatgtgtacccttaaacttacacaaactgtgcacacaaggtcctatagcagtatatatgggtggtttcactgatatggtatcctagtcagcaaaaaaaattaaaaaaagtacgtgggacccatctgttagctacacatattttttttcttctccttctcctcttttctctcttctctcttcccttcttcgggccggtggtgggcggaatcggcgagcgcggcagcagagtggcggcaggctgcggacgactggcgagcgtgcggcgggctgcggcgcggagcggatggcgggcgagtgcaacggtggacctccgccattgctgccccttcctccgctcgccgctcatcgcgtgacggcaccaacgcggctggctgcggcgggagggaggtggaccgcgcgcttcttagttgatggcgatgccccggagcttcatgtgtgtacgccgatgggttcgtcgggctccagaccatgtcggtgtaggagagaggatggtgcccgcgtcgaacggcggccgtgcttagcaagaagacatcgaactactacttaaccgatagcttcgaatagagctgggttgggtcggctggctgaccccgccacggccaaggccagcgtcgccggccgctgtaatgatcaaatttgcacaagtctttcattgtcgatctgatcatcatccaccaagctcatgtacccagtttagcaaaagtaagcacaaggcttcacacatgtttcacagcaacttctgccgctgcgacctcctcccatgctgcgcccacgacaggaatggtggtaacgtgagcccagtcaggtcccaaggccgcccaccaacttcctcccgcgcaccacctgcatctcctctgcaattcatccaaccatgcattggagccactgagccagcattcacctccaccttctaatcaccaccgattgactccgcctcgccgttgcgcgatgctgattgcgctttactaggtttggacgcggcggcagctctcccgcagcccagagggtacctccgcacggcggaggcgaggcgcacgagcaccacctcggtagcagcgggtacctagctcgattccggccaccaacccattcccctcgccgcgattgggcccctcggtcgcgaccacgaggaatggctgccttgccagtttgggggatttcgtcaccgcgcgcgccgatgcgttcggaggtggtcggaggaggttggcgcgccgtccgcagcccgccgccgctctgctgccgcgctcgcccactgttgattgttatttcagctatggccccaaggtgatccaggtgatggcagttgcaacggctggatgaataattcagttttgagtttgttatgcatgcacgagagatgtggcgagctgcaggagtagacgaccgcgtcaggcgtgcgttgtgggcgtgagttttgcacggcattgtatccaggagttccggatcgtgggatggcgcgattgtaggcttggattcgttttttcttttattagagtataagtagcagtagctaaaatttccatttgtaagtttatcaattcagttgaatgaaagaacccagaaaattgtcccacaaattccttctctctcgtgattctctgaaactctgaaatactctgcttctctgttctgaatttcttcctgtgttcttcagtttttttttgtctgttgccgtgccggacgtgtgcagtgtgcgcacaaagtgttcgattgggtgattagcagctaacaagtggtatcagagcttctcaggttgagggcggatctggcactatggcgttggttccggcgacggcagacccggcgaggggggagctcaggaagtgctttcctttacccacagctcacgtcaaccaactacactagttgggtaatacgtgtgcaggctatgatggaggatcaaggcgtatgggaagcaatcgagccggcggccggggcggccgtcgacccgaggaaggacaagaaggcaaagtctcatcttctccagtcgctgccggaggatctcttgatgcaggttgcaaagaaatgctcggcaaaggaggtttgggattgcctcaagacgagattcgtcggggcggatcgggtgcgcgatgcgcgcctgcagacactcaagggagagttcaccaacatggtgatggaggccggggagacgctggaccagtacgccggccggatcaccacgatgggggtccggtactctgctctcggcgcgacgttgaatgacgccgccatggtgaagaagctgttcgacactgtcccggagaagttcatcagcctcgtcgcagggatcgagcaattttacgacgtcgacaccatgccgttcgaagaagtggtaggtcgcctcaaggcgtatgaagagcggatgcggaagaagaaggcgaccaccggcggagtgaccgcggacaggcaagttctcctcactcaggccgagtgggaggcgcgcttcaagaaaggcgggggagaaacctcgtcaccatagaagaacaagccctctggtgagggggcgaaccgcggccaggccgggcgtggtcgtggcaggggtcgcggacgcggcgggacgcagagcagcggtggcggctctggtggtggcggcggtggccgcgacaagagccacataaaatgtttcaactgtgaggagtttggccactactccacgcagtgtccacatcccaagaagaagaaggttgaagctcatcttgcgcaaacggaggatgctggcccagctttgttgctcgctgtgacagaggcggtgcagaacgcgccgcgccaggatgcgctctgcgggctggtcgtgcacgaggagcgtgtgtggcctcgcctgatgctggcagagaagggagcagctgctggtgatctgtggtacctggacaatggtgccagcaatcatatgtcaggagatcgtcggaaattccgggaactggacaagaccgtgacggggcaggtcaggttcggcgacgcctcgtcagtgcagataatggggaagggatccatccttttctcatgcaagaacggtgaccagtggttgcttgacgatgtctactacatccccagcctccgctgcaacatggtgagtttggggcagctaactgaaactggccaccgtgtcgtgatggatggagatgacctcgaggtgttcgacaaaaatccttggcgattggtgatgaaggtgcggcgatcctcaaatcggctgtaccgcatcgagctacagctggcgtcaccggtgtgcctgttggctagtctcgatgacccggcgtggctgtggcatgcctgactcggacacgtgaatttccatgcattgaagctattggtggacaaggagatggcggcaggagtgcccgcagtccaccacccaaaccagctgtgtcaagcatgtctggtggcgaaacaagtccggcagccgttcccaggaatggcaaactatcgagcagaggcgccgctcgagctgctccacatggatctgtgtgggccgatcactccatcgacgttcgccggtaatcgatactttatgtttatcgttgatgatttttctcgttggatgtgggtgtttgtgatcaagtcgaaggaccaagcgctcgcggccttcgagaagttcaagccgttggcggagaacacggcaggacgaacgatcaagacactccggacagaccgcggcggcgagttcttgtccggcgagttcgcgcgcgtctgcgatgcagccggcatcgagcgccacctgacggcaccgtattcaccgcagcagaatggcgtcgtggagcgtcgcaataggatggtgatggcaatggcgcggtctctcctcaaggggatgtccgtgcccggcaggatgtggggcgaggcagttcgtcacgccgtattcctcctaaatcggctgccgaccaaggcgatgggaaatcgcactccgttcgaggcatggacggggaagaaacctcacctgggcccctgcgggtgttcgggtgtacggcgcacgcgaaggtgactgcaccgcacttgaagaagctggacgaccggagcaatccggtcgtgtacctgggcgttgaagaagggagcaaggcccatcggctgtttgatccgcgtcgtcggcaaatcattgtaagtcgtgacgttgtttttgatgaaaacacaccttggcagtggagtgttgctgcaggagaggtgacttccactgagttcgaggtagaagaacccgtcggcgcagagcagccggcgccggcagagcaggcaggctcggtaccgtggtaccgggcgccgccggcaggaaggcgagccggcaaggagccagaagtggcagaacagcggggaacacctccggcaagcccggcgaggttctcaccaaccttgcctagcacgcctacactcggctcatcctcaacgcactctgccgaggtgcaggcgtcaccgcgcacggccgacagtgacgacgggccggtgtggtacagaagcttggcggagatcatgattgaagcacctcgggtggacctggtggaggatgatgatgacacagaagcgctgctcgcagagatggaggagccgacatcctatcgtgaagcagccggcgagccggcgtgggtgaacgcaatgaacaaggaactggaggctattgagaagaacaagacgtggtcgctgtgcatgctgccagccggtcacaaggcaatagggctcaagtgggtgttcaagctaaagaaaaacactgccggtgaagtgatcaaacacaaggcgcggctggtggcgaaggggtacttccagcggcaaggtgtggattttgatgaagtgtttgcgccggttgcaaggttggacatggtgcgagctatacttgcagttgcagctgatcgaaggtggcaggtgcatcaccttgacgtcaagtcggcattccttaatggtgatcttgaggaagaagtatatgtctctcagccagaaggttttgttgagaagggaaaggaacatcttgtgtacaaactgagcaaagctctctacgggctgagacaggcgccatgggcgtggaatacacagcttgatcggagcatgaaggagcttggtttcagccggtgtgcacaagaacaagcagtctacactagaggtacagggagtgccgggataattgttggagtatatgttgatgatctgatcgtgacaggagaaagcccaagcgagatcactgcattcaaacaacagatgatgggggagtttgagatgagtgatcttggactgctcacctattacttgggaattgaagtgttgcaaggcactgacgggatcgccatcaagcaggttgcttatgcaaggaagattctgacccagtttaggatgctagattgcaattctacctcaattcctattgaacatcgttcacagttgcacaaagatgctcaaggaagcacagttgatcccacggagtacaggcgagtgataggttgtcttcgttacttgttgcatactcggccggatttgtcctacacagtaggcgtggtgagcagattcatggaacgaccgacagtgatgcatttcaaggcggtgaagcaaattctcagatatctcaaggggacaatcaactgtggactcatgttttctggaggcaatggtgcagtggagattactggtttcacagattgtgatctggccggcgacagtgatgatcgtcggagtactagcggcatggcgttttacttcaacggcagtttggtctcatggagttcacaaaagcagaaaacagtggcactttcgtcctgtgaggctgagttcatggcagccactgcagcagcgtgtcacgctttgtggctgaggggattgttgattgagatgattggtgcagaagccaggccggtgaagctgtatgttgataacaaatcagcaattgcactcatgaagaaccctgtgtttcatgggagaagtaagcacatcgatacccggtatcattttattcgtgagtgtgttgaaagtgggaagattcagattgaattcgtccggactgaggagcagcgggcggatgcgttaacaaaagggttgccagcagcgagattggcgacagcacgacacctgctaggtgttcgtgattttgggccgtagcagaattaagggggagtttgttgactgttatttcagctatggccccaaggtgatccaggcgatggcagttgcaacggctggatgaataattcagttttgagtttgttatgcatgcacgagagatgtggcgagctgcaggagtagacgaccgcgtcaggcgtgcgttgtgggcgtgagttttgcacgacattggatccaggagttccggatcgtgggatggcgcgattgtaggcttggattcgttttttctgttattagagtataagtagccgtagctaaaatttccatttgtaagtttttcaattcagttgaatgaaagaacccagaaaattgtcccacaaattccttctctctcgtgattctctgaaactctgaaatactctgcttctctgttctgaatttcttcctgtgttcttcagtttttttttgtctgttgccgtgccggacgtgtgcagtgtgcgcacaaagtgttcgatcgggtgattagcagctaacacccactgccgcgctcgcggatccggcccgccgccggcccgaagaacggaagaaggaaagaaagaagagagaaaaagaggaggagaagaaaaaatatgtgtagctgacaagtgggccccatgtacttttttaatttattttgctgactaggatgccaagtcagcaaaaacacccatatatactgccataggaacttatgtgtacggtttgtgtaagtttaaggatacacatttctgattttgtggttaaaggatcttaaaaaatctcgctgttaagttgagggacctcctataaacttattccttttagtagttacccctcattttcacctggaaaaagtacactcaaagtcccttaacttgtcatcgagttacaaaatcgtcctccaaccgcaaaatcagatatccgacgtcccttaactaatcaaaactggtcacaatagatcattcggtggttttgataccggttttgtcctacgtgacagctgagtcagcgtgggacccatgtgggccccacctgtcagcatgccacgtgtatagatggccttttggcccgcccggcacggcccggcccaggcacggcccaccagacatcgggccggcacggcctgattggcacttcgtgccgggccgtgccggcccatgggctacgcctcccgcccaggcacggcccaccagccgtcgggccgtgccgggccggcccgaaggcgcgggtggtccatcgtgcctttttatataagtctatattccatccctcctctttgggccgtgaaatatatatagcgaaaataagtctattttccgtccctcttctttgggctgtggcatatatatagtgaaaataagtctattttctgtccctcctctttgggttgacatatatatagctaaaataagcctattttacgtccctattctttcgaccatggcatataatatgtctatttttactccctgttgtttatgtgtcgggcctagcctgaggcccatcgtgccgtgccggccc

SEQ ID NO: 8089 - DNA, 1535 bp, Oryza sativa
  unsure (1)..(1535): unsure at all n locations
acttgggtcgggcccgtgctggcccggcccgaccgtcgggccgtgcctgggcctccccgccggcacgctgggctggcccggcgggggcgccggcccggcacgatgggccggcaggccaggcccggtacataaagtatagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagcgcggcacgtgggctggcacggcacggcccggtgcgtcggtcgggccgtgccggcccgacaagcctcggcccaggcacggccgggcctgggccgtgccgtgccgggcggcccacatggccaactatatcttcacccttcctcctatctctctctcactcttcttttggcaagcccgtcggcggctggggaggaggccgtcggggcgaggcggaggccggtcgcgaatggcgtcggtgacgctgcgtcaccgccggcggagaagcggtcccgcgcgggcgggtgccacggccgttgggcgcggaggctgacgaggacgtgacgcggcgacgacgcttggcgtggccggcggcttacggggaagaactgacggcggcggcgggggaggagcttggcgcggccggcggccaacggggaagaaactggaaggcggcggtggcggaagaactgggcgacggtgtcggggagggcgcagagctggccggcctcagcgacggcccgacgcttccttggcgacggagaggctgttttgagcagctgttgggtgaggcccatgagcgtcttgatggagtgggattagttgaagatggtgtagttcttgccgtagatgcactgcacccacacagccgtcacgagccccagccacctcccccacctcgtcccaccattgcgtccagcgccgccgccagcgagagtttgcatggcccatgcatctcataaaaaccagcgagctagcttcttttataaatagtaatcttgtttgcttaacgtaaaatgacaaaatatcgtcaaacatccgtcacggagcagaacacgaagcggacgtccacatgcgcgggcatcgccggctgcagcgcgtacgctatcgagatgcacgatgttgcgacgctcgtaccgcttcggcgtcgtcagcgtccccacaagcgtgtaagtatatctgatgggagatgtgctgcaagctcaggccacaccccgtctggcccggcgagctccacgagaacttcataggcgagctcctgacgagggcagcgacgagctggtcgcggaggatgaaggcgcggcgggcgagcaagatccgaagaaggacgtcgagtcgaggcggcggnntncggttgcaaatggtgttggctgcgtcgccgccgccggc

SEQ ID NO: 8090 - DNA, 25778 bp, Oryza sativa
cccgcggccttcctcccagccgccgacgggctggccaaaacaagagtgagagagagagaggggaggaggagggagggagaaaaggggaaaagagagggtgctcacgtggcatgctgacaggtggggtcagcccacgctgactccgccgccacataagacaaaaccggtatcaaaactaccgaaagatctattgtgaccggttttgattagttaagggacgtcggatatctggttttgcggttggaggacgattttgtaagtcgatgacaagttgagggaccttcggtgcactttttccttttcacctcataggaaccccctcagcccaagagtgtgcaccaccctgacccatgagcgagcaagcaacggcccatttgcaacgccaggagacgccccccacgcccaggagcgatgcgccgacgcctcgagtatcacagccgcgcctcgtctccttttttttttttttcttttcccccaccgcgagtccaccgataccgcgtcgtctgttcgtcttcgtcatccgtcgcaccagcaggctgcagtctgcatcgctggcccgcgggctcgtcgagtcgccgtcctgccgctggtcgccctagccggccgccggtagtaaagcagcagtagctgccagctgaacgcctggactaggactacagaggcaaagggcgcagaacagtagggcaaccgagcagtgcacaggcaaactgaagagaggtattcatctaatgatctaattatctctctctaattctcttgattagtttcagattttcaatttatactcctctcttctcttctagttcactcttctttttaatccaattagtttgatttgtaacttgattctactttttcaattatccagatttatataagctagggttcaaagtttgaagaactgaaaggaagtttccattaaacatctctgcttgaagggactcctgttgtccttcatccattagtccatcagaccatcattagtaaaattgtaagcacactgtgacactttaagatggatggaaaattaagatgtcttcatcggatataaatttttagttcaaaattaaaatgtttctgacttttgttctagatttattgtgggctattaactatcgatgatgttgagattaacagctttgagcccgaggatgaattttgcatagattaatcgtcttctatgtattttttgatgttccatttcgcggtttcttttcgtcttatatttcggtaagcacttttgcttgctactcaatgattttgtctcaatagttatccataaatgaacgaatagcattatttatagtaattgccgctctctatatagcaaagtagtgcaccacccttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttagaagttttagtcccatctaaacagggccactgccagcaggcacgagcagtagcggtagctaacgctacaacgagtacctggcaacaaaatagatgaaaccggatcgccccatgcctgtgcgaacatccgccaatcccctcgaataaaggaaaatatttggagcagaacaatgcatgaaccggtacgaatggaaagtaaacctgaccatttcaataagcagttaagtacacaccatgcctgtcaatgactgcccacaagagctattaattaagactatcgctgaagaaataatcggaggtagaactgggggtgtgtgtcggcactgatccccaccttcccatacatgacgctgaacgtagctggaatcggacgtgctcggtcgctgtttctgctgctgcttgcatcccacaaatcctggaaggaaaacagaagcagatcaacataatggctcataacgtcacagaaattcctcaacaaaaccatcgtctttgccctgtcctgcaggaacccaccctgaaaaggccgtccagctccaccggcaacacgaccgtgtgtactgttctagcaccgccagcccagagataccggtgactcctccatggccgagctcaaacaaggagggaatgcacaacattcatcagcacaaacggtggaagaacagaaagaaactgccgtttacctctggcacacagacatggaaggatatgcgggcgtcggcggcagcaaggtcggcgaacggtggctcccatccaaggaagaagcaatcgtcgccgcagccacttcaacgaccgctaccgacatcccagctagatagcaccacattacaaaacaaagagataagtatgcttgtcacattttgacaaataacagattgatcagggaacttcctgctacctaaccaaccaaccttcacttatctgacattctgaactgataatcgtggagcacaacaaaccaaatcaaggcaagccgcactgccactgccacattctggaatcgctggatgaacaggtgaatgtatagaaataggtggcaattagggccagtcacaaagttaaaaaagaaagccattcactcaccgtccatccagacaagatacttcatggagtcaccggccgctgttggtgtgaggaccacccgcagccatggtcaacaaatgcacacgccctcgaaaccctcatagagtccaacccaaccctgcataattgaaggcagcacaacaacccaccaatgtccatcttggtgaagaagatgaagttgatggcgtccgcctgtgccagcaaccgcatcagcgtgtagtcgctgttccgcctaaacaaaaatcaccagaaatctccgtagagaggaagaagctaactcacatatcgttggcaaggttgaccctggtgttggcgaagaagccgcagcctgggctgtcatcgagggtagcggatttgagaatgaactcgtaacacaccaagcttctccacctccaaatcacgttgtgatcgagggcggcggccggtggcgtggatctgctgcaggggagggcagcgacggttgtggccgatggacgtcttgcggcatggatctgctgcgtgggagggcggcggcggcgcggtggcggcgcgtcggccgacgatggcaaggggagggatgacgtcgacggagtcgggcggcgcgaggggtcggctgttaggggaatcgatgacccacgatggtgaggggagggacgaagtcggcgtcggctgcagccaccacaggtgctcgaacagcaacgcgtccacggcgaacgccaccgcgggtccgccgcccggccgccgcgaggaggcgccgcaccggcccggcctcgagcacggccaggtcgacgggggaacaagttcctctctcccttcgtcgtccccacctccaccctgaccacatgcgccgccgcggacgcggaggcggaggagtcgaggcgccagtgcccgccgcggcgagacgcggagcggaggaaggtgtagcagccggcggaggacggacgcggcgacggggcctcctcctcctcctcgccgtcgccatcggcgggcgcagcggcgtggctcccgatgccaggatctgggccgtcagctctttgcgccgcctgtggcgtggtcgtcggagctacgacctcgtcgctgatgaaggctgcgcccgccttcaccgttgctcggcggagacggctgcgctcggcgacggcgcgaggcggaggcggacgagctccgacctccgagacggcgatgcgacggcggtggcggaggaggtggaggaggcggcggtggcacgatggcgacggcggagggagagggtgagacgaaggggaggaggggagaatgacaggaattttttttacaaataatacgattttaatggagcaaaaatattggtcggttaaatgaaatcgcaagtctagcacctatagaacagccgttgttcgcctatcgataggtacttgttgaactgccagttcgacgagtgataaaatatcttaaaaaaaaaagaaaaacactgtagtgacactgtaacagcgcagcctatcaaactttgcccgtttaataaatctggactattcgatatgtccatgtgggggcactgtagcaaagtactatttttttttcttagaccaactaccctgtggtacctgttgaatttgttcgataggtacccctaaacgtaaaattttgcctatatttttgcgatttttcattaaatcgtattatttgtaaaaaaaaagctagggctggggtgggtgggttagtgtgagtcatttttcgaaaaagcccctcttcttttaatttttacaacacagtcctaattcacgatttttcttttctttgcacggaatatctgggcctccatgaaaataaacacctcataggcacggttctcaagggaccttgatcgaattacccggaaatcaaagggttttttcacaaaaataccaccccatgcactgttcatactgtatcaaaatcctgacgtgacacacctcctcgcccgcccaacctgcgccccttcaggctatgttcggttactagggatttaatccccaaggagaatcaatccagggaggaattaagtgaatccctctcatatcacttaatccctgttggggatgaatcccttgcttttcctaatccctctctagaaaccctgtgtttggttttggctgggattttggctagaaaaatctaaaaactgctgaccaacgtgaatatatgaatgctgatgctcaataataaccgaatactccctccgccccaaagaaaattccaatcctgggtttgaacctggacaccctccgtccaaaaaaacccaatcctgggtttgaacctatctaggaaaaaaaaacccaatcctgataggttcaaacacaagattgggttttttttgggacggagggtgtacatattagtccattgtcaataaactgaaaaacagttatgactgaaagtatgaaccaatgaaaatggaaacatcacaaattaaacaagtccaagatgagtggagagctgacgagcagcaggagacgacctgacaaattaaataaattaaacaagtctgaacatttgttctattcaaaggttgcatcaacaatatacatattcaaaggttcagggatcaacatttgctgatgccgcaaaaaagcagtatccttgcagacttccttcttcccaaagcctgcagagaaaaaagttccctttagtttctgactgaaactgcataatttaaggaacacttctgtgcaatgagcaattgtttcgaattggtggttgtgatctcaatctatgatgtagaaaagagaaatttttatgtgcatttttcataattttggctgtgtttagttcacgccaaaattagaaatttggttgaaattggaacgatgtgacggaaaagttgaaagtttgtgtgtgtagaaaagttttgatgtgatagaaaagtttgaagtttgaagaaaaactttgaaactaaacacggcctttaactaccaaaaatgaaatttaaaataatggacggccctctgtaggttgttgcttgctgcttgcacatctcaaccaagaatctatctttcagcaaaatataacaggtgtgtgtgattgatgataaaaaatcagaaaaaaatatacttgcttaattgctgatggccaagaacattgatgcatatatcaaatcaatactatactattgaaaagttcacatgtaggaaatagaataacattaagacaaaaaaatgacataggaaatatttgctgactgtaagttggatggctaacaaaaataaaacagtgacttgccttttcttttcctgctcctaaagttctaatacaagagcatgcatatgaataggacaatatcaagtacttctgaattgggggaaagaatcatatgtgcctgtaatcgtcctcctaactagtatatcaagaaacaatgagagtacatatggatatggagcgtgcacatatataggtctaaaaaccagtaatagttagagcagtatatagtactactaaagtttccagttcatatagttgtaccaattttaaagcaaattactagcaggtcaattagggctgtgtttagttcctgaaattggggagaagtttggggaaagttggtagtttggaaaaaaagttaggagtttatgtgtgtaggaaagttttggatgtgatgtgatgttatggaaagttgggagttgagaggaagtttgagtggaactaaacacggtctatatgagcatatggttggctcctagattacctgtacatgtacaaagaaatttttatgtgcattttttatattgcgtggcttttcaaattctgacactagcaataatataagttctgtaggagtctagagaaatcaaatgcaagggtctaacataatatcagtgcacacattttgcatatattatcttaataaaaaaaacatcaggacttcctcccattccccacaaagtcagcaatgcattgcatttcctttatttcaccccatacgcagcaacaatagatctagcattcctgaagatgaactatagaaaaataaccaaggaaagtactataataaaacaaataatgcatattccatttatattataaattgaagtaatatggtaattagtccaagggaccttcatttgtggtttttaccaaagaaaaaagcattggaagtattattggtgatttgtcaatagagttttatggcacacaaaataatcattggtgattcatcaaaatagaagaacatatgcacaatagagttctactgagccgtcacagaatcacctccctaataacaacatcagcatgctgagaaacatacaagtagaaatggtgattcttgaagattggaaccaactatactagttgacattaaagagaatctgtggattcctgattcatacgcataacaagcagaattaagcagcgaaagatgaaaaggaattttgcgaaaaaacaaaaaagaacaggcatcagccgcggagttcgaggggacggcggatatgacggcgacctccaagacggcgaggacggcgacggaggcggcgacagaatcctaggtaggagacggtccggtgagaaccaagaaccctaggcttcaagaaccaagatccaaagttccaaaccctaggtagtacagggagaagagaggggaatgaagagatactcaccggtgggaaggtggccagcggaggggagagcgccgccgccggggagagcgcagtgttgccgtcgcgccgtcacgcggttgacactcgcactcgcgcttgcgtcgccgccgctgccttctcgtctcctccatgcgagatgtatttttccacgcctccacagtagatgattttttcccgggcctggacaatagggaaccccgtgatgggccggattaaaatcagcgacagggcttaaccgaacgcaattttttgcctgggccgggattattttcacaccgggatgacccccgtgggttgggccacattcccggccaaccccgggctaaccgaacaggcccttatatattacccggaaatcgaagggtttttttcacaaaaaataccaccccgcgcaccgtgcatactatagcaaaattctgacgtggcacacctcctcgcccgcccaacccgcgcccctttatatattccgatgggagaaggcaggtggcgtagaaacgattccctgactcgagccgagcgccacgccgtctcgtctccatgatgcgtagcagagcggtgcctcgtcgtcaacttgccggtccagcggagggagtagccacaacctcaactcaatgtcattccccaattaaatttgaaaatatactgttcatttaattttttctcagaaatattcgtgattcaaaagtttttgtggaaatataccgtcgatatcgcataacctttgtgcaaaaatgatgtggacatgacgtcacggacggtatcacgtgataaaagtgcgagaccgcgcggtctcacgtagcaacggtgcgagaccgcgcggtatcgcggaatgaaagggcgacaccattcagtctcgctagagcaaagagcgataccgctgccgtgatgatttaattagtgattataattaattgctaatcaggataattaattactaattattattagttaatttttatttgagtaattaattacaaatcaagtggagatattgcacggtgtcgctgtttggtttcgcgagagcgttcgctctccctctttcattctgcgagaccgcgctttcaccgcgcgataccgatatcgacggtatattttcacaaaaacttttaaatcacgaatatttctaagaaaaaattgaatgatcagtgtattttcaaatttaattcggtcattccctgatctgaggcggcgagctcgatggtttggcggagggtgttcatggaggagggtgttgacagagccctagcctgcactgccacggcggggcgggaggcaggtgcagctgtcctgtccgaggcggagatccggcagctctacgtcgaggtcaagcgggtgctcctatcgcagcccaagtgcacaacctcctgcgcatccacgcccccgtcaagatctgcggtgagcgacacccctcccctctctagctgagcgccttgccctgatccgcgagggttttgcgtatttcggggtggaattgcacgattcctattgccgatgttgggtttgttttttcggtttttgcgtctgagctgccgcgttcagggggtgattaagggcaaatgctgggtacctgcctctctggttcgctagcaaatttgctgtcctcctacgaaggctagtacaagtatttttattcatcaaaagtaaatttgaaggaaataacctgctgaattgatgcactatatgagtatatattttgagatgcaaacaagatttgggaattgcattttatgtacaataagttgttcgagcgagtccaatctttgtgtgatgttctgtgttacatcactctttggagtgttatatcgttgttcttcagattaaggcggaagtagtctgacatgaggttcctttttccttaaatttaatttgctcactgccacttagctatccaaggtgaagaatgaaatgcaaaattaccgaatgaaagcaatttgtgcttgcttgcatagtgtggatatggcccaagctctttggactgttgtcctggaaaattaattaattaccaatcttaagggattaggttaaatgcctccttacataaagggtaatggttactgtttgtggctttttaagttccacatattatttagatgttctatagttcaggacctttaggtgttttttttagactggtcaccggggggggggggggggagagcttccccacctgaattttcattaaaagggaggaacagtacagtagcttaagttacattagagtgaggggggatgataagataagtttccaagactctacaacagccctgtcagcgtggctcaatctttcagcccacaaggttgcatcctctttacattttgcgataagacaatcaattgaaggtgatgcacccctaaaaactacatcatgtcgatggttccagagtccccagagacaaaggaagaagaaaactttgaagtgttttgcaggcagaggaccttcaggtgttagagtaatgggatgaaagtttagggtgactcggattaatttttcctctactagagcacactttctaagatagttccacgctgcatcctttattttcatttttcatgcaacccagtttaacagccaatttaagaaaagtcgtaaagttaatttggtttcaaaatgttctgtacaaaacttttttaacagtaattaatgtagtcttgctcacaaccaaaagctatgttagcccactttgaggcacaatttgtacccctcgccttaattttaaatgctgagtttcattctagacaaatgaagttgcataaacactcatcgagtcatggattgtcatagtttacatctttgagatttggcaatagcttgtgtagctcaatcagtaatgttgtaccatagcgatggtgaatacaaatgttaaattggaaaaactgaccctctgacaatatacgacatctaattagctatgtttccatctacgcagttcctttagatatttagtaagtttattatgttctcagctgttctgttctgatattccatatcgtttgctttgaagacttcactcaagtgatctggaattatgcatgcttacatatggttgaattcactgtgtttttggacactggcaccctgttttgatgcgttgcaacggatcccaactaaagatacaaataagtctaaaatgtaaaatgcattaattaattagatatcctcaaatatgtgcttgtatacatgattatatgaggtgtctaagcaaccacttttcctcgctcacctgggccatctcgtctatgatgttgcctctttttctctgcccttcatccccagcagctatagagcgagctcaagccgctgtagttgcaagctcccgagggaggagatgctaggagccggcctcaagggaatcgttattgccgctgcttcctcacggtttgcattgtcttgcatgcacatctttgttgccacagaaaaaaaaggtcatgttacatgacattgtttctgtgtttacaacaggtgggagaagaggatttgaggaagaaaaaataattacatttcttatcggtcatagttttgtagaggaaaatagaaaacacgtactttgggcaatctattgtggacgatagtaaagggagagtttctcttacagtcttactagactaaacagtttccaatttactacttcctccatttcaggttataagacttcctagcattgctcatattcatatagatgttaatgaatctaggcacacatatatgtctagatgcattaacatatatatgaatatgagcaatgctagaaagtcttataatatgaaacggaggtagtattattattcagcaatataaactgacaataacttgggtttactttcaagtaaaaaaatcttgtgctcaatgtatctgaaattttcatcttttatcttatttgacagttcaacatctggtgggatactcgatagagctatagatgcagaaaataggaaacatggtggattctttagattggtaattaccataggctgtagtacaatagaacttactttaactggtagagtacagtattaatggtctgttatttgtctgtaacagcgaaatatcttggaatatctgtcgattgctcaggatcatgttgaaagaatatctggagttggttgcaaagacaatcattttttgtgaaatccttgtccaggttggctgcagagtgctacattaaagtggatgttgatctacatgtaaatataggtgtacgaactactgccctatgatctaacatcatcttccttctttaagtcttaattctttcctgcttaaatttgacctattcagacatttcatttgtattaaatttcttctaagtatttgatgcaaactatacattctaagttcatgaaatctcatatatacatagtcttcagagatgttgcttctgaagctaaagctgaaaacttaggctgtaaaattttacctcaactttagcgacactgtactaataatattgcaaatattgcagcaactcttggaaacatgctaagcattggtcgaaacctcgagcttacattggctgcatgaaatctggtccagtcctggctcagaagtaagttcccctgtttttgtcatgccttggctgatattttaaactgctgaccaaatgctagatcgtttttcattctcggggtgtaagatactatcctgagcctgagtattggcaatttggtgaatggggggaacaaatactttaggcatgcaaccgttcagttctatgcaatctccaaggatctggtttcttacatatcaatcaaccagtaagcaatttcttcagacacggtttctgtttatctacatcataaatttgttttttatctaattcttacccatcattaggagcctggttcaatggcctagatgtctagcacattgatgattgcgactacacaaccaggtatagataaatccttcccatcttttaaactgatttccttcctcttacatatccctatttggagtactgggactgaatacagcttggttgatctgtattgaatcatttggtgaaacagttcagtttttcaaaaacgtatacttaacttattacttcctccgtttcatattataagactttctagcattgctcacattcatatatatatgttaatgaatctagacactaacatctatatgaatgtggacaatactagaaagtcttataacctgaaacggagggagtacctatgtattattagcttattactgcaatgcataactcatgtatttcagcattgcatttctccttgcttttcaccaaataatgtatagttttcccttgaactgtgtagtttccccttcaagtcttgaatttgaaaagaatctatacttctatactaatataaaaaggaggagttgtacccctccaatcctacaggtgaaatcatcccctctaatctcatccgtctatccaccatctgatctaatctcatccgtccactatcctctacgccatttatgagcgattccaccgattcctctgcctcgcgatgactcggtcgcataaatccccgccgcgctgactcctccccgcgaatccccgccgccctcctcgctcctactcgattcgcgcgcatcctccctcctcgtgacaggccaacgaagccgcacagccggagacgagatcttccccatccgccatcgccgctgcagtccaccgctgcccccgaggtcgtcccttcccccgccgccaccgatttctccacccatccgctgcgaccaccgccctgccgatcgcgcccccatcactgtttcgcctgtatcttgccatccaccgctcctacagccatctccaccgcgccgccagttcctcatgcttgttgctgagtccgagacgatccggttggttccgccgtcgaggttgccgccaccagggaagcccagccgatccggcatctgctccatctgctgccccctccctgttctctgctcctgaaaccgtcagacatcaaccaccggccaaccagccctattccccctaaaccctaaggtaataccaatttctcctattttacatgtttttgtgatgtgtcaatttgtggatcaccatttgttttcttgatcattcacaattgccaatcagaaattggccatagagtttgaagattttaacatattgtctcctccttgcgtgatcatatatgtcttggatcaggagaagctcttccaggaattaggtagccaaagtcgattaataggctagccttaaggatggcagctttggaaggcgtctatccatattcttagttgatcctgtgcagcccctatcaatggatttgcatccattctttcttctgaactttacaaaggaaaattttgtctggttctattattattatttctttgtttggaggtaatgtgatgttttcagatcactggaggctctaaattttgcttgtaatacagatgattaccactaatcactgtgaagccatcctattgttcttgttagtagttattgagaaatatataacatttgtcttgatccctggagaatacccaacttcttgaagagaaaaaccatatatataggagaatctaatcctaaactaatcttttgctctactacttttcaggccgtatatgcatatcttgggagtaatagatgttccatgtgtcaatgcatcaactaaaatacctgatgaacatgtatacgattcttaggaaattacatctgcaacaaccaacttcaatttttttttctcagcatctcagggcattattttcatcaagatttttggcctacgctaatgaccgatgttgtgaccttaggtcacgaacaagatcggggataggccggaaagaagtgttttcccgcctatccttagaaacgagctcgaacagcaaacacaacttttgaggattacttttgtattaaagatgtcttgtcctgctacaggtttttgactggcttttataaccggtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggaccccacggaatcttcccttggcatcttctcttgttcgaggagtgctcttcctcgaactcttgggaaaaatgcattttccgtcctggaccgtcttcttcctcctgggaattcgaattcccctttgccttctctttcatccttggaaaccacctgtgaaattgtaacttgtccaaaatatgtgtagttgcattagcgattatggaatgtccctaaaaaaggtgttcttcacccgaagaggtattttctattcgaatgagtgttcttcctctgggaaggtattttccttttgggaaaggtgttcttcctcttggaaaggtagtttccactcaaaatgagtgttttcccctctggatacttaggtcttgcaaaacctcgtagtgttttgaccaaattggaggaaaaggtgtttgtaccctgctacaacaagcccctcacgggtaagggcgatgtgtgttttcggccgaaaccgtgcttgagtttatggaaaaagggggaaaaccgccgtcctcctattcggtcgaaacacactattcaaatatgcatatatgccacgtttactattcattatttttatttttattcttattatttttcatttttatttatttatttattattttttaaatgttttttatgccacgtgccggtatttcattggtgcgcttaaggggtcgcgtcgcttcgggtttcgtgtccgctcgtaaacccgcgacccttaccaccctgcgctatataaggccaggaggggtcgctatcacgcgacctacgccaccactcgttttttctgccatcaactcgaaatcacaaaagactcgaactaaatctctttcttccttcttccattcgagttttggtgctttgcttgatttcttcctttctcactacacaacatggggaaaaacaagaaaactgcggaaaagtcgaagtccaagaaatcaaaaaaccacgaaaatacttcttgtggtattggtgcctcttcgattaaggacaaaaacttaaacgatcttgttgatgttggttggatatctggtcgaaacgttgtaatttgaccagtgggagaatcaaggccttctcccaagctgggatacactcttgtgtttgaggatttcttctacgccgggtttaaattcccgtgcagcacttttttggtcgaggtcctgaaattgttcaaacttgagtttcctcaattgactccgaatgctttagttcgaattgggcttttcgaatggatggttcgaagctgcggtgagaccccccaagctgaagactttgcatacttccattgtactcggcactacaccaaacagaactcgaagtttgggtgtgtaaactttgctcctcatccgaagcgcggaagtccatggccagctatgtctgctattcgagcaaaatgggggaacaagtggcagtcgaagtggttttatcatcaaatccctgttagcctgctgaatgataaggattgtcctttttcgttctctgggaagaaaccaaaagctgtctccgagccatcagtctctttgtcgccggagttcactgccatacaacctcgaatcgaagaacttgtttcgaactttagctgccgagacctggtggaagagtttgttcttctcaaaattagacctctttcgagcggctgggatatcactcttggagaaatcccagaagattgcccttccagtcttcctccatttgtggtttcgtctgatcgtaagtttccttttcgaacttgatttttttttgcgaaccttgtttttcttgaaaaagtgatttagttaagaagatttattttctccctttgttatcttcttccttgtagttgtgattccagaggatatggtccgcccagttcggaaatttcttggcccttataccaaggatgagcatttgaaatttttgacacttcaaaacgggaaaaggcaaaatcgggtctttgcctctctaggctccgatatccctgtccgggtttatcctgaaattgtccccaaactaaagaaaaagaaatctgtgaagccttcttcttctgatgatgatgatgatgttgaagtggaagatgttgacgaagaaattggtgaagaaaatgctgaagaagaagaagaagaggaaggagctgatgaagaagagaacgactcgagtgatgatagcgactcgagtaacagttcgagcgacaactcgagcgactcgtctgaatctgatgatagcaaaacagttcctcctcctactgttttagctgatttgaaaaggaagaaaactgccagcagtcctccgcctgaaccgagttctaaacgagtgcagtttgttattgacagtgatgaagagttggatgaagatgatatccgtattgatctttctgccatccatgtcaccccaattcaagctgatgctagttttgccctttcggcaaaagaagtagcttcactgtatgttgttgccccagccaacacggttgtcgatgaagattgttcgacccaagtgggtgatactgttgagacaacaaactctcttcgagctgatagagacttggttgcaaaaaaggcaaaaacgcccgtcaatgcggccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgtgcaaaagatggacattggcttatgggtcttcctaatttcaatgaactcggggaaagtagccatcatggcccaaacttgtgtttgaatgacctaaagtatcgccaccccctgagttcgattggtgatgaactcgagaatgttctgattactcctgatcttgaaaaggagtttttggaagaaaatgatcttatgtcctcttgggcagcacttgatgtatctgctgcacaggtatttttatttttattttttttattatttatttatttttattatattatattatatttttttttgacttaaaacctattttctgatgcgcagactgcgagccttgctcgtcttcaacgtggtgttgctcggaaagctcttcgagctatttgcacgcgacggaagaaatcacttgatcgcatcgctaaactcgaaaaggatcgggattatcttcgctgcaaacttgatcgaatggccgacgagaagaaaattaccaccgatctcgtgcgcaagttaagcggcgaaaagaaagagctttccgaggaaaagaagttgcttactgaggaaaagaagaaattactcgctcgtgaaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagaacgaaagttgccgccaacttcttctgaaaagttgcgagaccgttcgaatcgcgttgcgaagtctaggggctgacatcagcttgctatcggaagaaaatactttagcagctgtgggaaaatggttcgaggaattttccattgggctaaaagatagcgttactccctttgcatctcgctgctcgaaaactgctgtggagagcctttcggcctgtctgctttcaaatgggtgtgaacactttaccacccttaaagctgatatacaaggtatgcttaatgatgaggccaaatttgcacagcttcgagatgcagctcaacccgtcgtaaaggctttccaagtgctttactggaagaagaaaggatatgaagataccctgaggtctctccgagcatctcttgcctcaagatcaaagtcacagccggccagttcgagccaacaagataaagacagtagtactccgaggtcgagcgcacaggtgtgacgttcgtgaaaagaatagttaaggatgcttcgtatgttcgaaaacaatgctattttgctgcttcaaaaccgttatggttgagagcctttattgtaaaaatttatagtgtagctgactataatgcttttctcttattgcatgcttttcacggaaattccctttctttggggggctgcaggttaactcgaatcgaaaacttgtgattcgacgcaacaacactttgcctactcgaaatgtgaagcacttagcatttcgagaccctgcaaagctttcttctagcaggaccgccatctccgatgacgaactcgaagcctattatgataatacttgtatatttgcttttaagtttttccgatggcaacgaagccatcgacatgacagtttacgtgactttgtacttgagtttagggaacggcgttcgaacaataatcttgctagtaaagccttttggcaaaacttccaaccatccgaacgccaacgtagaatatggaaaaggcgttattcaatagttccatatacagaatgccttctcctctcaacattgtttatcccgactcttttctctcttctttgtagagtttgtatgtaacttgttataccttcttaacatcaaataaacccttcctttcttcttttctttataaatgctctttatttcaattgttcaagcacccttaggtctgtcttcggagtaaagcgaaaaaaaaactacgtcctccttatctttggaagaagttacgaaatcgaaacgtactttatctcgtcacgtgcattttccgtcttttgagctcgagcgaggggaaaatagagttcgagcattctttagttggttttttggactaaggcaaaatagttcgaaaaccgccgtcctcctcacctttcgaaggagtgatgaggtcgaaacgtattttacctcgtcatgcggattttccgctttttgagctcgaacgagaatagagttcgagcattcctgagctggttttaggactaagccaaaatagttcgaaaaccgccatcctcctcacctttcgaaggagtgacgaggtcggaacgtgttttacctcgtcacgcggattttccgctttttgagctcgaacgagaatagagttcgagcattcctgagctggttttaggactaaggcaaaatagttcgaaaaccgccgtcctcctcacctttcgaaggagtgatgaggtcgaaacgtgttttacctcgtcacgcggattttccgctttttaagtaatcgagctgtattcttcctccgaaccgtgcgaagttatgagttttctttgattgagtaatcaaggtgtatttgactcggagcgtgcggagttcaaatttatcgactttgctagtcgagagtatttgactccgagcgcgcggacttctattttgtcgactttgttagtcgaatgtatttgactccgagcgtgcggagttctattttgtcgactttgctagtcgagagtatttgactccgagcgtgcggagttctattttgtcgactttgttagtcgaatgtatttgactccgagcgtgcggagttctattttgtcgactttgctagtcgagagtatttgactccgagcgtgcggagttctattttgtcgactttgttagtcgagagtatttgactccgagcgtgcggagttctattttgtcgactttgttagtcgactccgagcgtgcggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctcttttttttcttttttttaggcataaaatttctttaaagaaatagcattccaagtatgctttaactcatcaccatcaagatatgctaacttgaatgctcctgtttctgtcttctttttgactatgaatggtccttcccactttgactcgagttttccaacagctacctcattgagcactttcttcaagactaaatctccttcttcaatcggccttgtctttactttttggttctaatagctctttgttccttctgtgtatgatgccatcttctccaaagcttcaacccttatttcatctagcatttcaagagttatctctcttccttcttcatctttttggtcaaatatcattcttggagaatgtgcccctacttcgcttggagtcattgcttcatcgccataaaccaatctgaaaggggtcatgccagtcgaccttactaccgtagttcttagtgtccaaagcactgatagcaaatcctccggccattttccttttgctgatccttctaacctcttcttgatagcttccatgattttaccatttgccctttccacagctccatttgtctgaggatggcctacagaggcaaagttgatttgcaaattaaggcctttacacatgtcttgaaattttccagattcgaatttctttccattgtcacatactatttgctttgggattccaaatcgacatattatgttcttccaaacaaacttttgtactgctgcagaagttattcttgccactgcttctgcctcaatccatcttgaaaagtattcaattgcaacaatgacaaagcgcaaatctcccttcgctcttggaagaggacctactatatctattccccatctgtaaaaaggccagactggcgggattggttgcagttctttgggtggtgcttttgtcattggaccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccatcttcccttgttacacactttaacaaaggagcagtaactccacttttatacaactgtccctctaccaccttgtattttttggacgttagttgtattctctttgcttcttcttccttttctggaagttgtgcactgacaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaattgcagcggctcctgctccggcggcattgcatgctccatcggagaatactatccatggtttttcgacttcttcctgttgttctacctcattgggagtccattctgccacaaaatctgctagtacttgtgactttatggctgttcttaatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgtttttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcatcgaaagcttgttggcattcagcagtccactcgaaggtgtttgcccccctcaaagtcttgaagaagggtaatcccttttctgctgtttagatagaaatctactcaaagatgccattcggcctgtcaacctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatatttcttgcaaatctttgccatgggtaaatgcttgtttactctttaccacaatgtcatctacgtatgcctcgacattccgtcctaactgcttagccaaaacttttcctatcagcctggcaaaagtcgctcctacattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactggtctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctgtagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttgaagctcatactttcttgctgcaagctgttcttcctcggaccgttattactccccttggtcctgggagcttcatacatatgtagttgtggtgtattatggcctcaaaaatattgattgttgaccttccaagaattgcattgtactgatatggcatatcgaccacatcaaatagtatctcttcttttctcacattagtgccttttccaaagaccacttgtaaagatatttttccaattgcatgtacttgttgtccaccaaaaccttgtaaaggtactcctgcgtttgttaacctatcttctcgtatttgcattttcttgaaagcatcataaaacagcacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaactcctaatgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatggcctcccggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtcctcgaccttttccgatcctccccatcaaatccggtggagctcgcacggtcacgtgaccatacgatgacagagccaatcctcccccatcaaatccggtctaatctttctcgatctccaaaggtctaatctttctcgatctccaaaatttgtgatagcttttgatccactcgatctcctctttccgttttctagtcaaaatcgaagcaatcagagataaaaacaacgacgttaaatggtgggcgttggcaataaagaaaaccagaacaacatgaacaggtcgggcaacgacgtagtcctgatagagagaaacaacaacaacgagctttgttgatgaacacgaccagatgagtgcatcaaaacatgtttccggatgagaggattccgttttccttaaatgcgcaggaagaacaaaagatgaagaaaaaacgaataatattgttcattgtcttccctagccaacacaacaaatagaagaggagggaagatgggcaacggtgctccagcgaccaaacgggggtgagtaaggtggtcggacgtgtcccacgatgtggctcgtcatagattgtggtggttggcaacgaagaaaaccagaataatgggaacgtggctaacaacaacatggtaccgatagagagagaaacggcaacggggagttctagtggtgaacatggccggatgagtacgtcaaaacgtgttcccgaatgaggaggttccgtttttcttgaacgcacaagagggtaggaacgcaggggagaggagggatgccaagaagaagagatgtcacgggagagggggagagcgtgccgcaagggatagatgtggggtgccgtgagggagggagggaggcgggagaggaggggcgctagggagaagaaggccgcgggtaggggaagcgtgtggagatcgggacaccgggaggggggagagagagagacgaaaacggatggggagtcgcggtggggggggggggttgacggacgaagggggggagcggaaaccttacgtattttttaattaggtatatatatatggtcaaataggttaaataagcaacggtaagatagagcagaattgtattctgctaggagagtttataaactcaattttcaatctctccatcctccaagatcttttatctggttgtgaaaaaccagatgtgtcatgaagatcaaggtttttgcttgacttttgctcaatgacaggtttaatactcaagatatgctagatcgccggcactgtgctaaggacaatgatgatctttcatgcgtgctttgtcatggagggaaaagagaaacaagattgcacccttttttttttgggtttagggttggcgtcacctgggtattgagat

SEQ ID NO: 8091 - DNA, 11898 bp, Oryza sativa
ggagcagagggggtcaccaaacccggaataaaagaggaagataaactattaaccaacttttccagaagctccttcctgaggaaaaattcttgaatccttccttgtgtttcatcagaaataaaatataaagggccttcttcagcaacagtgaacacaacctccaaagcaggatcaaccaaagggacaaaaggcactatctgcatattaccattagaatctgaattctgattctgattctgattctgctgactcactccagaatcccctatcacatgctgatcctgattctccccttgctgctcccaatctccccaaccaccagcatgattatcaagatgctcctcctgaaccggcccattgctatgattattttcaagatcaggatctagggcacccattggtggtaaatcttcatccggagcctgaatgccggcaaaatcattgttgaggacaaaaacagagaaagtccaagactccccctgaccaccctgattgggtatttgcttgatcactattgttctaggaaccatatcaacatcatcataaaaagctcgcagcataactcttcccgggactacatccatctactgccaataatcaagcctcccaaaaagactaataacacggctgacatagctttgggtacgaaaatccaaagggaacccaagaaacataatccaacccactctagcataagcgaagtggaggcctgtcgccggtatggaaattactagagaccgaaattctggtttgttttttcttagtcagcaaagttacattaagaaggttcttcatcatttcaacatgcatgatgcaaagtctgttagtacttagattgcacctcattttaaattatcagctttacaatgtgctagtactgatgaggaggttgaattcatgtcaagggttccatattcctgtgctgttggttctttgatgtatgccatggtttgctctcatccggatttatctcatgctatgagtttggtcagtagatacatggctaatcctgtcaaagaacattggaaggctgttcagtggattttctgatacctttgaggcacaacatatgcttgtttgaaatttggcagggctgctaagggacttattggctatgtggattcagattttattgctgatttagataagcgaaggtcactcataggttatgtgtttactattggtagttgtgctgtaagttggaaggcaacattgcagcctgttgttgcccagtctaccactgaagcaggatacatggctattgctgaagcatgtaaggaatcagtttggctgaaaggattgtttgctgagatttgtggagttgattcttgcattaacctattttgtgacaatcaaagtgccatatacctgttaacgccaaaattaggtaagcccaaaatcatcatcggcctagagtcaatatcggcttcagagtctcggaatcggtcgatgtgagttgtcaagtcaccagcagttgtgttcttggtggagtcggatcaattaaaggaagcttatctagaagagtccaacagttgtgttcttggtggagtcggatcaattaaaggaagcttatctagaagagtccaagttcaagaaggatacaacatggcagtttatctattaattaggcagggtttagtttccttttatttttaggaaagtgtgtttagtgtccggtaaggactttatgttttccttttatttttaggaaagtttctttctagtcctacaaggactagtatctacccatgggtataaatatgtacacccggggtcattgtaatcaatatcacaatcaataaaactactctcggcgcgtcgccaccctctttcctgaggtttttacttatcaaccgacggaatttggcacctgacgtggggctgcatcggttcagttcgatctccggcgaaagggtaagtcctacgttccgccggccctggtgaatctgtcggctacattggtgttgttcaaggctgcatcgcttcgatctcttggatcgcgctctggttcggttgatatatttgcctacctgatatcttaattctatctctagttgcattgcgtttagagacgcattggtttagttgggactatctcggttaggtccgatcttctgtcttagccaatatatctctacaattataatgctgttctaaatagatttgttatatccatcacattagacagatctatcggctcatcgagtattagattatcatatacaatctcgtgctgcatcggttaggttcgacgtactagattgttgttgataatataaatcttgctaagccgataggttcatgctaatgttttattggggtgctaactgataaggtatctagacgttgcatcggcttataaggattggatatacatataagtcggatttagccaatgacaacaaaggtttcattgatctatctaatcttgtggattttatgacatcggacctccagccgatgtatgctttaaccttcagatcaatacttgttctattatatcatattgttagccgattggtttctactggattatattattgttatttatcattattagctgattgcctttatattgttattcacatcaagtatcagaatctacattggacatacaaccgatagctcaaaaccctatcgctatcggctggtatcggcatcggctggaattgctccatcggcttgtcagccgatcggttcattgatctgctattttcatatcttgtcagttgcaggatcaaactgactagcacgcctgcatcttaccaacctttggacctgcactggagctaagcagatcttccaggccagcgtgtgttttttgcatcaacaatacctcactaaagatcagatgttccatcagaggacaaaacacactgatatcaagtaccattatggtcgtgatgtagtcgcacaaggtaagctaaaggtatgcaagataaacactcatgataatcctgctgatatgatgacaaagccagttcccgttgctaaggttgagctttgcccaagcttagttggtataatggtttagcccaagaggctatttggcgccgaaagtgttttcttgtgttcagggtgaaggtttgatttatgctacaagaaggaatcaataagtatgattcatataggtaaatcctatgtataacatataataatcttggatgataatatatagatttcaacgtggaggtaaaatcaaataacaagtcaaagttatagcaaaccaccgctacgttacttgccttctccgatggcgagatgaactctagttgcgttcggaagtggcaccacttgaataaacaccgactcagcctcaaacaacacacatataatcattcaagaatcacacattcactttctacgctgggaacccaccccaaacaacataaagaaaattaccgataatcttcctataaaagcagcatagattaacaactcgatacctccaattctacatcacataacatagcaaaatatatcatttctgacatctacagaacaagagttataactttcatttagataacaaaactgaattcttccatttagctggcctaaaacatggcacaaaacagaaaagtgcatctgcccagaaaactgtgcaacaaccattcaaaagagcactgacaacaaactacaagataaaagctaacaatttttatgtaggaggtagatcacaacatatgctacaacttctgtaaatacaagattctcggattccatcattaagatcctctaaaatccctctgaacctcgactacagataaatgcatcgacattcagacagccaacttcagaaattgatacctcctaaaccacttgatataaaatcatgccatttggtcagaagatagatctacacgttatttacaacttttgtatagagacttttcgaaggaaatcctattatcttggccgaaaaggcatccaaaacagaactgcgcagggggcagatcagcgaaaacctggctgaggaataaatcggtggatcccaaacttactcgcttccaacacttgatctaaaccctaatagaaaaccaaaacagggggaaagcctccatgggcagcggtaatcaaacccttcatttccatcttcacctcgattccctccgcttccttctttccctttcttctccttcccttcttcttcttcccaggtctgcagtagggcaggcatgggggaggtcgaccagagggggaggtaggggtgggcattcggtctaaccgaaaatttcggttaggttcttcagtcttttgaaaaattcggtctttacgatcacaagactgatcggtcttcaagaaaactcaagatagagtatttcggtcttcggttaattcggtttggtctcggtcaaagaccgaactcagcccaaaaaataattgcaaaaaaagaactctgtacatgatgaatgaaaaagcaactgggatgaaggactaaaatttgatgatgccacaacaagtagcaagtagagcatgattcatggaaaaaaaatcaaatcaagcaaatcaatccagccattgatcccgtcgatctcaaccactccacggtccagatcccatccatcttgtgtctcccattagccttccgtcatcgaggcctcaggagtcaggtcgtgggcgcgcagatgtgtgggtagagggtggcgacatggcgcgaggaggagaaggcggcacggcgcgaggagaagacggagaggcacggtgcgaggaaggcggcggcgcgacgcgagaagaaggcggagaggagcggtgcgaggaggagaaagcggagaggaggcggggaggaggaggagaaagagcgagtaagaggcggtgcatctgcacgcgcatgtggggttgtggggactgggaaggatcgtgtgatgtgggaaggaaggttagggttttctctagctaatgggctattgggctggtattgggcctttacagtgattcggccagttcggttatttcggttaaccgagcgagatgaccgaaaagactgtataaaattcggttagttacaactgatgaccgaatttgtgaccgaatttttcggtctcggtctcggttagttcggttcggtctttttctgcccacccctagggggaggtgggcgcccagggtaccaaatgacggctagggggaggtgaggggatcttctagggttttgagggggtgtggagggggcacctgggccttgggctggccgaaagctagcccagctagcgtataactattgtttttcttctaatttcaaacaccaaaaccttagggacttccaatatatcctctacggtattctactttttttctagggcattacatcacattgttgggtattttagtggttgccgatttgagatatttttataaaaacggaacctacatgacatgagcattccatttttgaggtgatctaattttagttttgcacttagcatttaagtacctgtaatattcatatttacatttgagaccctgtttgaggtcaatggtcagttcttgttgaaaaaaatagtaaaaaataaaaaaaagaaagaaaaggcagaaaggtgcaaagaaaaggaaagaaaaaactgcaccttagaaaaagaaaaaaaaggcagaaatgtgcttaaaaaaagccgcaccaagaaagaaaaaaaaatcattcatcctttgagtatgttttcagagtgtagagttgtgcattgattcatatctagtccttagtgttgtcgggtgcttccttgagctagagttgagtctaagctaggccagcacattgactagtactttgaattattattcaactttgcattttctgattagcacaattgcgttcctttgctactatatattgtgcctcctaagcttcacatatatacttctggtcagcaccactttgatccttgcaatcgccacatcacgtccttcaaggtgtcacgaaccagccaccggttgtaccgtccttagcagtgctggtaagacacttgtaagagcttggtaaggtgctccatttggctgagttgttgagaggcaccactacaccgcgtagcagattattagggataaccttcactgtttgctgttgtttttgtgtttgcaatgacaagtatgagtggtgctcaaaatcaacgataccaacaaggtaacaataatcgcgtgcctgatgatccttattctaaggttaagtttaaaataccatctgttttgggttattatgatgctgagaaatactttgattgggagatgacagtagagcaaaagtttagtgcccaccttgtgcctgagcagcatagagttcgacaagctactagtaagtttaaagatttttcttatatttggtggactgggttagatgtgggagagctttacctactacttggaaagaacttaaggtagctatgcgtgatagatttgttcctccatcttatcttagagatttaagcaagaaacttatgtgtttagaacaagaggataaatctgtacatgattactatggcgagctacaaaagggattgatgcgatgtagcatagtggagggaaccgaagattctatttgtcgtttttactcgagattgaggcgcgatattcaggacatagttgattatatggaatttaacactgtgaaccagttgtttcagtttgctatgtttggagagaaggaattgcaggggcgtgatcaacaggtcaagaacaaggcaagcacgtacacgccgcgggcgaagccatctccggggctgcccaagcccacctatttctgggcgcccccaccaacgagcaagtgaccagttgcgtatggagtttctgcagcgccaaaaccaccttcctcacgacctgtagattcaggtaaaggttcttcacaggtatccaccaagagtgcctcatctgttgcttcaacgggacgcacgcccaggattcagtgccaccgctgccatggatttgaccatgtgcagaaggtttgccctagtcaacgggcatacgctgctacggaagatggctacatcagcacctccgatgttgaagatgatgaggaggaagagaagaaagacgaagagcaaaaagacctatccatagctccatgcatgcttgaagaatgttcaattggccaagcacctataatttatgaagatgagaataaaggtaatggtgatggtgctacaactaatcaaggtatgcatatttatgatgtgccaactatgtccactacttgcgctacattagagcaacccatagtggaaacaattgttgaaatacctttgtcacaaaacaagttgcttaatgtttcttgtgataaagaagagttgtgcgatgcttcacttatatccatgccacaactagtgaataaacatgttagttatgttgttgaattgccatgtgttgagtttaaacatgttattcacattgctagcaagaatgaagagcataaatttctatcttctttaaatacttgagaatgtaatgtgcatcgagtatatatttgttcgaatttaactatacctccttttcatgatgaaatgtattgtctagaggaacacatgcgtataagtaattctctatctagttcctctagtggtttaaatgagttacatgttggtttgcaagaaggggaatgttgtggttttcgactataaagatttcaggatccaaccatatggccatcaataaatgttcctcaccggatgttgtgatagataaagataaattcaatacgctccatgacaaggtgaaaccgaggacggtttccaatcaagaaggggaggatgatgagaacacaactagctcggatataaccatgactagcttatgtattaatcaaccaaaggcgcatatgttctaccaaaggaggaagggttaaggatttacccggtgtgagatcacattattcgaggagccctagatgctgtctcagtaaagaatcgtcaacaagggcgttctagtgcgttgtagattcttatccaagacttgtatcatttgatgatgtcatgtgaatcactagaaacatgtgaagtgtatggctaacccaataacaacccaataacgaaagtttcgtaaggggactggagcaggctatcatgataagtgggggaagatgttttcttccccaaattctttgttcaattctgaacaaaaaagaaaggaaagaaacgaatttttgatgaggatcaggaagggagttcgcttggtaggacagggaaaggtgatttcactgttgcattgcaaaaatacgaaggctgctacggatcggacgtccgatcctgtgaaaatcatcggacggtgttgcaccatgttgttgagaaatgtttcacatgtttcatctcttgttaaaaattgtttcaataaaaaagttccaaatgtttcactagcagagaacaatgtttcagtgtttagcaaaattgtttcaactaaatcaacatattgattgcaacaccaaaaatcgatgcatgcaacaatgagtccaaagttccactagcagagaaaaaaatgtttcggtgcttgagcaaaatttgtttcaacaaaatcaataattgaacatactgattgcaacaccaaaaatcaatgtatgcaataatgaatcaaaacggaacgaaacaacttcatagaacaaagtgcaacaaaaatgcaaataatctgcaacttcactaaaattcccaacgaaacccacctctgtctttttctactccggctggccgagcggatcggcgagggaggaaggttgcgcgaccaaggcgtgcccgctacagagatggagagggaggggcccgaggagacgcgggcctggtcgtcgtcatagaaggagggagccgcgccgcctctcgccgccaccgctgcgggaggagccgacccctcccactcccgcccccccacagcggaagccatggcgacggcagcggcgacgggggtcaggttagggaaggtgggatcggaggggttgatgagggcgtcgatgaagtcgctgtcgtcagactcgtcgtccgcgtcagggaagaacatggttgggcagatggatagtcgccgacggagggcatttggatcgaggaggaaatgggattagggttagttggttgcaggattagaggagggaggtaaagaatgggttaaatcaatagtaggccccaccagacattttggttcgatattttgtttcactccggacgctcgatgtgaagcgtttccccaaaaataccattgggacttaaaatcatgaagcaactttcctttatgaggctttattaaacctgttcatatatatgcttgtcccataagctaacatataaacattgacgggacaacgaaaatcaaatgaaaaaatattgatattgtactgatatctgttccaagtaacatataaatgagctgagtctaggaagaaaagaataggactgaaattgtattgggatctagttctgccagtgaaatatactgcttgagaaatcagagaataaaaaatgtgactactcttctcaccttagatctggagtatagcatattttcatcccaaacaaagacaattttcctgagagtaaccgcatatacagctacacgcatggcaggaaataccagataaatcattgtcagggcaaattaattcactatttttcttgttagagaagtatccataagaaaatttggtatgaatatccccttgcaaaaacagataagataatctatgcaacgttgtccatgtacactactataaccattaaccaacttttggtatcatcaagacttttaggtgaatagaactgcttggcaaacattaatccaccaaatgcataggtgttgctgaaaatagcaccaacaaatatattctcatcagaataatatatgtgctatttttcacctaagacacaaacctatgcctgttccacaaagatcaccacatcatgttagacataccactactgaggatcctaaacggagatcatgtgtggcgttcggtatagtatgcacttgtagattggaggaactactgatccatctctccgctccatcctgttctcattgttgatcctgcactgttgtccatcacctcatcaaccccttgtttccttgatatcctagcctgctgcatgtaccaattgaaaaaaaaggggagccaacgcaaactttaggaatggtagctacagaattgaatcacactaaagaaaacgaataactaagataaggcagaagctgaaacaactgcaaatctaggccagagcaaagaacaaacttatacctggaatacaccaacagaatatgtgccgtatatggagttgcaggaatctggaggcaatggaagcagaactcccgccgtagtgtctagaagcggctcagggtcagaaccaactgtacagatctgggaaggatttgttcacctcctcatcttccagcaagctagctatataagatggaaattcactgatgtatagtggttttgagattgccactatggctagtgggatcttatgaattgaataagtggtggcaaatgctggtacaagtgcaaaaactatcttgcctgagatataaacagccatgtaaaagacattacacattgaccttaaatatgaaacatgagtactgaaggttgacaaaacacacctcagtcagaagtgacttcgatgtcataatatgaggtccgtcgcccacctagctcgtgtttgtaatagcccctaagcaaagtcttgagatcgcgtggatagaaaataaccacattgaactccagtaagcattagatgatctgatcccaactcagctgtgcacaacttctcgctcccgcaacacatataatttgtacagttcatcagttaggacttgtattgatcagttcatcagttagtacatctctctctatctcctctctcttacagtgaggtagaacttgacaaatttacaggggagaagaaaaaggagctcatatgataggaggccaaaaaggtacccaaaagtttctcacggcttgaaaggacttttctctttgtgctcaaagagagttttgtttcttgagctattactgtcccaggctatctcatgtattacatacaatttttttactaaaacaactgcttgagacaaaatacaatccattaggagcattggaatgggaaatatgcatttgaagcagaaagttaaaggagctgaaaattttatttctaaaaattccattaatatgcatattaggatatctgaagtcttccttgtttggatagagcagaagaagtccacaacttgcactcttctgatatcctagtcatccatgatgcaacaagttcccttaatgatgcaaaagccgtctgtaaatgttcacaagatcatcgagtggtcctcttgccaggtttgctgacagtgccggcaagcaccatcaagcgacgcgcaccacgcctgatgcctcagctctgctctcgccgctgcatgaccatatttgtagctaaacgcctacaccaatacttccttttcctctcgaataaggcagggaaccggaataactgacctttcttttgttttttcatggcaggtgaaatcgattgttgacagtggcgcaggcgcagcagcaggtcagatgttgccggattcgacgccacttcctcatcgacaactgcggcgagctgctcgaggagaacttggcgcagcagtcgtcagccatggcggcgaaggatgcatcggtggcgctcggcgatagcgacagaaatggaggacggcgctccggcggtgctcggcaacggcggcagctgcggcgcggtgctaggtatgggcggagcgaggcgaaagcggaagtggcagcactcggcgacagcgacggcagtggcggaggcggagacggttgcgctcgggcgacggcgcgaggaagaggcggacacggaggggcgaggagacagcaacacgacggcggcggaagtggaggcggcggcggcgcgagagggtgagacgacgaggaggagggtaggc

SEQ ID NO: 8092 - DNA, 13199 bp, Oryza sativa
  unsure (1)..(13199): unsure at all n locations
aggggagagggaatgcggggagtgacggctagcgtttgacanntggggcgggggggagtggattagtgcgcgtatttttgcgaaaaagcccctcctcttccacattttagagccattttagatcgcagccctaattcgcgatttttccctcctttgcatgaaatatccggctttatgcaggccctacacgtaaaataccacctcagagaaactgttcgggagggaccttgatcaaattatacaaaagcaaaggaattttttgcaaaatttccaccctgcgtactgtagctatcctacgtgtacagcacgagaggcggcctgaggcgccggccttaaagaggtaaattgtgttttgatattaggatcaaattacttatctaaccttccactaaaattttagattaatacctggcccacattttaactactcctaattggtaccttttatcattgaccattagattagaagtgaacaacggatctcatatataatactccaagcacattaaaaagactctgaagtaggatgttcagttaagcctaagttagaataaagctgaagaacaaaccttcaaagagttgattgttatcaaatccattgtgtttgccaaacgtatcgagtatgacaacggtgactaactttataactatcatcaaaaagaaaagattactggataaaggatttgagccagacaaataccagtagactttcttcaagttaagcacatggacaatggtgacaacatgtttttggactgccataatcaacagagcataaaacgattcaccagagattatatttttattttatttccaactgatttttacatgaggagggggtttaacagtgtaggctatgttaacagataaaaagtgcatagttttatttgcagcaatctgggttattcactgtaatgcacatttatgcaatgatgattgaagcaataggttattctcgttgcctgagatgattcaatgctgtatgcgcttatgcggactgttaaaggaatgaaaattatagagacacacgagctaaaccacataagcagatcctaaagtaccattcctgattaacaaaaaggaagctgacttgttggtctcatgcttatctgttatggttactgtcatatgttgtctccagtaccataggttctgccactttgaacactatgttgtgatgattattcaggttagaaatgttatatttttatttcaggtgcttcaaaatataattaattgattccttcaaatcatgcatgtacaataaaagagtttacaagaaaaacagcaggattaaccaaataaaggtttattaaaacagtaggtaggagtactctactagttagagtagataaatggggatgtagtgttcaccaaagctataacggcaggacttgtgcttgatgatgtcaaccttgtcgccattgcagcgcaccacctccacaccggtgagaatggcgaagtaccttttatcactgtcaaagtcgcaacaagaatggctgcaggtctcccggtggtgagcgaccatgaacagcttagcaacgcacagtttgccggcgccaaggtgcacgacgtgtgaggcgtatggcacctccggcaccgcaaagcccttacacccgtggtgggccaccggcggcggctgctggtggtggatggtggaggacaggtcccacgcgccgaggacgccgtcgtccgcgacggagaggccgagccagaggccgtgctcggggacgaactcggcgcggccgcagaagggcagcgcccagtcgccgaccttgctccaagcggcgctcgccgtgtcgaaggagtaggcgccgtagctgtgggtggacaccaagatgtgggactcgccgaccaccgcgtacccgcagatctggccgtcggttcttatgccggcggcgtgcacgtacggaggcggcggcagtggtcgccagtagcactcgtcctctatcctgtcgccatcgacggggcgtggttcacggtggatgagcgcctcgaaagaacggcccggccgtgcatcgcggccgagatccaccttgtcaggcagcggtatcgtctccatgacgtagagatcgtcgccgacggcgaacgacttggtccagaacttgtactccaccatggagggcaagacgcggacggtgtgctcggcggggtcgtagaggatggcgcggcgagtagtcctgtcgacgctgacgatcttgtcgtcgctcctacgcatgaactcagtcgacccgcagaaggtcatgtctattggaggcaggggggcgtcctccaccaccgtcgccgacgacgacgattggggcacgggcagtgcatcattggggtagaagagatgtgatgggttgatgcggcgtagcctgcgggagatagggccgtgtgatttgtcgaagatgtcgaccatatacaggaatcgccggatcatcgccttcccaaagccgtcagctttacggagagatggtgggggggtgggaatctgggaggctgcttcctttccaccactccttcgtctaggtctttaacgccgtaattattggactgcggtgggcggtggcccagtcccaagtccagcataatgcgcctttccctagcctagcaggaataagtttattttaccaccctcaactcttgcttcgaatctatccctcaactacaaaacaaaaccgggtataacgtctgttccatctttgaaaaccggtgtaaatgatctccttccgtggtttaggaggcggtttcgtccgacatggcagtttttgccattctttttttttacaaattgacccttttgaaaaacttattacgaaattagcccgcgcaaagaactttaaccaaaaataggccatgggctcagcgccaagcctcctggcgcggagcttggccatatccgtgccaaccgctttggcgctgagcgctgccagcatggcccagccaacgtggcaggggtctcatcgccaaggagcttggcgctgacatctacagctcagcgccactttccttggcgctgacattcggcacttagccgctgccgcccggctcgccaaacaaccctgttgcggggtccctggctgggcacttagcgctagctaaaatggcgctgaggtttatgaaagggtcaattaggcctggggaataggctaattcaaaaactcaagtaaatacggaagtagggattttcggaatttccgaaaatagcagagtatgcgcaaaacaaagtaaattctagatttagctgcctacaacaagaatatgctatcacgaaaagcaactagacctttagcgacacaatcaagcaaagctagaggagagggggaagtaatatcaccaaagttgttgcacgatgagttgttccctgagttcaaatccttgaggggattctactctacgttgacgagctcacaaagagtcgggtatccactaaccctttgctcaagaggttgcacaaagcactcctcctttcactagtggtatctcttccctttcggaggtgagatccgatcttcacaaacttctcctggcctaccacacgtagatcggtgactcgagactgacacctagccgcctaggagtcctcaacctccaagagtaataaataatcaaaggaactcccggagatgatgcaagtgctcacaaatcttcacgaagcctacaacaagcacacacacaaactcgaatccacaactctcaaacacagaccaaaatccgaatcaaacacaagtgagagggaaacaagaaagcaagactcaaaagtgaatctgaagatgaacaagccaagggcatgaaaatatccaatgtgaccagcagccctcacaagtaaggggagtgggctatttatagccacaactccagatttgcctgttatgcccaataattgcatttttcgaaaattctgaaaattaatttcggacatatccgaaaatttccagaacagcaaaacagtgaagtcaaccgaagatttttaggagattccgaaaatgtttcggacaaatccgaaaatttccagaagcgtttttgggttcacagtcatttttgaaaattgttgacggtcgttattgaccaattccgactgtcaatatagctaaaataaaggagaactagctatgcttgcaatgtatattttgttttagaataatctatttccatttgtacatgaattctatctaccttagagaaagaggtacaaaatggaggagaaccgacagcaaaacactcggacaatcaatcagacgctgtcaagaatcagacttgtggagagataggccagaaactcagaattgacacgatcaaataggcccataattcactgatctggattgaggagcccacgaggagacggcctgctgaagagcggggccggttgggccattggttcggccgaaccccctttgcgccgctggatgaaagatttcaatctgacggtggggattcactcccaatggtcgttggagggtattacagacctttccaaccgtcgcaaccgtcattcctcatgctataaaaagccgtcaccttgttaacggccaaatttggtaatgtcagcatcggaaaagaagattagatcgaagcagaatcaaagatgaagagtgtcgcgaaaacagagtaagaattggctgaagtctgaatcggctacagctaagaccggcagagttcgagtcggacagtgttagccgattgagccgaatccgacaatatgatgcagcaaacgttgtcggtttaggttgatgtgcttcatgatgattgccgcgtatggatagagtcctgagaagtcaattgtatctattaattaggatattttatgtaatttccttagagataagtttgggcaaaagtctgccgcgaagacttatggtatcttagagtttgttagagataagagtcgtgtctggtatggacatatcttgtaattctcgggtataaatagacccgaaccccatgtaatcgaataaacacacgttcaatacaatctcggcgcatcgccacccttttactttcgttttgtttcgacgagttcttgctttcgggttgagctgcatcggtttcgatcttcaacaagaggtaaaacttgttatggcggcttgtgttctcgggattagtgcttccatctttatgacactctaatcttgtttatgtaattcgtcgagttatcatataccatacataatctctggcgatatcgatatctaacctacaatcggctaacatctgtcgatagaaggcagccgattaggttaaatacctatgttgacttagattatataagatatccaccactctatgacacatccaacggcttgattgtttagatattgtccttcttttcatatttatagctgcatcagttgagtttgatcttatgagtcgtgattagaatctcaatctcttgcctgcttcttggttatcgattagggtagcatcggggtttcagccgatcttacctgatttaactatatttcccttatatgcttcattgatatgttgaatctgccatttatattaagatcttgtttcatttaagtatattaggcttttgtttagtatattctacttgctctaatatcttaatatagagtagtatcggagtattggccgatacatgctagatctatctgatcggctatgctatgaacatatatagtcttattattaatatatatttcgatctaagtgatttatactgtctcggcatggcgactgatctatcccaatcacttgatttaagtatatatcgatgtaaggactatatatcgttaatatctacagccgatcgaataagatttagttccttcttatttattaatgaccgtcgatcgatgcatatatgacatcggctcaaatataaatgatatgtcatcggcacctagccgatcggctatcgtttatggatttaaccgcggtttctttgtctttgtttcttgttgattacaggatcaaatcaactggcacgctagcatacccgaaggcgagttttgaacctgcactggagttaagcagatgtcccaggcctcgtgttttacatcaacacgcttttggcacgcctggtgggattcattaagaagttagaatcacaatagcagttttctccatggccgagaagccgccagcatcgccgtcctcggctagtccaggttctcttaaagaaaagatccagcagctaggcttatctgagattaatgaaggcaacatcgtgaccattactccagacaagttgacacctgatcaacagaaggattttgactcaatgatgcagcaagcacggaaccagttcttaaactcattcatgcagacccgcaaggggacagtggtgcagaagtataaggtgaaggtagttgctgatattcccggaacaggttcttctaaggatggagaagtacagcaagttccagatggcacaacccaaccgtgtgataaaggtgttgcagatggttttcaaggaattcaaggtgatggctctcaaggggtccaaggtgttggagttcaaggtgatggttcccagggagttcaaggcggtaatcttaaccaagatggtaacgcagcacagttacagtttaacaacttccaagatcaggttgactatgttgtgcaccatgctttgatcaatcaatctggaatattagtcaacactttgtcgaatatggtgaaaaaaatggttgatggttcaatggctgagtatcaagctacagggtcggtttatctactgggaggagtattccaaaattatcggccattaattactgataatcagccagctgctcagtcaattcctcctaatgcaccatcggctcagtcgacggcaccggtatcggctcctgcacctgctgcattgccatcagcaccgggtcaattggtcaatcctcggttgttggtatgagagcaaccacagcatagtggacaaaatgtgaatcggctaacgcaagatcaggttgtagctatgttcttacctcttcaacctaatgttgacccgacccagcagcagccgattcagcagacaccaccaaggcagcaggttgcacagccgattcaacaaacacccccaaccagcaagttgtgtagtcaattcagcagatccctccaagacggcaggttttgcaaccaattcagcaaacaccgttaagacaacaggagattgttcagccgattcaacagcaaggtttgatgaatgcatcggctgggtttgcaacatctaacaatcagctaggacagcacgctgtgaatcgagttgtcccagagcacctagttcatcatgtacagccagatcaaacggtgatacctcaagttgttcccgagcatttggtacgcaatattaagccaaatttccagagttaccagggaggcaatttgaattatcagtatcagcctccatcaccacaagttcaatatcagtaggggggatcggctcaaccttagtttgttcctcaatacaatcaattcgagcccatgacacaacagcctcaaggaacacctcagcaacaaccatgggccgatatgattgcgggtgtaatgaaggaacagttcgggcttaggccgaaagatgctggaaatttataccgacagccttaccctgaatggtttgagagagttcctttacctaaccggttcaaagttccagatttctcaaaattctcggggcaggatagtacatcgacttatgaacacatcagccgatttttggcccagtgcggtgaagcatcggctgtggacgctttaagggttagattgttccgactgtctttgtctggatcggcctttacttggttttcttctttaccatatggatcaattaacagttgggccgatttggagaagcatttttatagctatttctacaatggggtacatgagatgaaattgtccgatttaacagcaatcaagcaaagacatgatgagcctgtgcatgagtatattcagagatttagagagatgaggaataagtgttatagcttgagtttgactgatgcccagttagacgatttggcttttcagggtatgattcctccgattagggagaaattctcgtctaaagactttgatagcttgtcacatcttacacagaaggtaaccctgcatgaacagaggtttgcagagtccaggaaaaactctagaaaggttaatcacgtttgtccttacatgtatggattggatgatgatggtgatgactctgagatagcaacagccgaatgggtgagaagcaaaaaggttatactatgccaatgggtaaagaactctgggaaagaggagaggtatgactttgatattaccaaggctgacaagatttttgatttgttactccgagagaaacagattcaacttcctgctggtcatacaattccatcggccaaagagttgggcaagaaaaggtattgcaagtagcataattccgggtctcatactaccaatgattgcaaggtcatcaggcagcaaatccaagcagctattgaggacggtaaaattaggtttgatgattctaagaggccgatgaaggttgatggcaatccttttcctgttaatatggtgcatacaactggtcaaacagccaatggaggacgtgcaagaggttttcagtcaaattcggctaaaattattaggaagtatcagaaaagatatgacaggcagcaggagaaacattatgaggaaaacgatgacggctttgatcctcattggggttgtgagttttttcgattttgttggaatgaaggtatgaggctgccatctattgaggactgtcctggatgcagtgatataacaaagagttcaagccgatcatgtaatagaggcaatcggctgaggcagaaaagagttcctgttcatcaaagattgggtccagtaaaccaagatcgtagccaggaggacaatgaaaacaggaaaactcaatggtgtccttctggtatttttacaaagaatcaaaagagagggttcaaagattgaggagtcgggagcattttcaggaggtcgaacaggaaatcgatcatcggttaaagaaaacaaagccaaagcaggagtggcgtgttatgaattaggttcctgcagccgatgaagccacagctgatgaagcaaaaagattggccaaaggaaaaagtgttgtaattgcatcggttaacatggttttcacgttgcctgcacagtttggggtcaagcaggccgatgttgatgaagttgaagaagaatcggctaaattgacattgtcaccagaacaggcagtcttcgagaagccagagggtacagaaaatcggcatctcaagccgttgtatataaatggttatatcaatgggaagccgatgtccaagatgatggtcgatggtggggctgtagtgaatttgatgtcttatgctacattcagaaagttgggcagagacgctaaggatctcatcaagacaaatatggtgcttaaggattttggtggcaatccatcagaaaccaaaggagttttgaatgtggagctgaccgtcggcaacaaaactatccgtacaactttctttgtcatcgatgggaagggttcttacagcatgttgctcggaagggattggattcatgctaattgttatattccttcaaccatgcatcaatgcttgattcagtggcaaggcgacaagattgagattgtaccagctgacaggtcagtcaacgttgccagtgccgatttagctctttgggagatggatgatttggattgtttgtctggaaaagtttgggatggagattttctaaaagtgtccgattctgatatacaaccaattgaagatggagaacccaagctattattttgagggcatcgtggagggttcaaaggtctacaccaaggacatagtagatgatctcgataacaagcaaggacagggtttcatgtcggccgatgatttggaagaaattgtcataggtccaggtgatcgaccaaggccgacatttattagcaagaatttatcttcagaattcagaaccaagttgataaagctgttaaaggaattcagagattgcttcgcttgggaatattatgagatgcccggactcagccgatcaattgttgaacatcggttacctatcaaaccgggggttagaccacatcaacaacctccgagaagatgcaaagccgatatgcttgaacctgtcaaggctgagtttaaacgtctatatgatgctggttttattcgtacttgccgatatgccgagtgggtttctagtatagttcctgttatcaagaaaaatggtaaggtaagggtgtgtattgactttagagatttaaataacgctaccccaaaggatgaatatccaatgccagttgccgatcagctagttgatgctgcttcagggcacaagattttaagctttatggatggtaatacgggatacaatcaaatctttatggccgaagaagatatccataaaacggcttttaggtgtcctggtgcaatcggcttatttgtgtgggttgtaatgacttttggcttaaaaagtgctggagctacttatcaacgggctatggattatatatatcatgatctaatcggctggttggttgaggtctacattgatgatgtggttgttaagtctaaggaaatagaggaccacatagccgatctgagaaaggtttttgagagaacaaggaaatatggcttgaaaatgaatccgacaaagtgtgcttttggcgtatcggctggtcagtttttgggatttcttgttcatgagaggaggattgagataactcagaggagtgttaatgcaatcaagaaaattcagcctccagaaaataaaaccaagttgcaagagatgatcgacaagataaattttgtcagaaggtttatttctaatttgtctggacggttagagccttttacaccattattgaggttgaaagccgatcaacagtttacttggggggtagagcaatagaaagctttggatgacattaaggaatatcttagctctcctccggttttgattcctccacagaagggaataccttttagattatatctgtcggccggagagaagtcaatcggctcggttctgattcaggagcttgaaggaaaggagagggttgtattttacttaagtcgtcggcttttggatgcagaaaccagatactctcctgtggagaagttgtgcttgtgcttgtatttttcctgtacaaggttaatgcattatctactgtccaacgaatgcactgtcatatgcaaggccgatgttgtcaaatacatgttatcggctccaattttgaaagtaagggttggaaaatggatattttctttaactgagtttgatcttcggtatgagtcaccgaaggcggtcaaagggcaagctatagccgatttcatagttgatcatcgtgatgattcaatcgactcagtggagattgtgccatggactttattctttgatggatccatatgtactcatggttgtggtatcggcttagttataattttccctcgaggggtatgttttgagtttgcttatactattaaaccttatgcgaccaataatcaagctgagtatgaggcagttctcaaagggttgcagttattcaagaaagttgaagccgatgctatcgagattatgggggattctttgctagtaattagtcaattggcaggagaatatgagtgcaagaatgatacgttaatagtttataatgaaaagtgccaagaactgatgaaggaatttcggctggtgactttgaagcatgtatctcgcgagcaaaatattgaagctaatgatttggcccaaggggcatcgggatataagccgatgatcaaggatgttaaaattgaggttgttgtgttgacatccgatgattggaggtatgatgtacatcaatatttacaaaatccatctcaatcggcttctcgcaagttgcgatataaggcgttgaagtatactttattggacaatgagctctattatcggacaattgatggggtgttgcttaagtgtttggatgccgatcaggccaaggtcgcaatcggagaagttcatgaggggatttgtggcactcatcaatcggctcataagatgaagtggttgcttcgacgtgcagggtatttttggccgacaatgctagaggattatttcaaatattataaggggtgtcaagattgttagaaatttggggcgattcaaagggcaccggcatcggctatgaatcctatcattaaaccatggccatttagaggttggggaattgatatgatcggtatgattaatccaccgtcgagtaaaggacataagtttatattggtggcaaccgattattttaccaagtgggtagaggcgattcctttgaagacggttgattctggggacgctatacaatttgttcaagaacatataatctatcgatttggtatccctcaaaccattacaaccgatcaaggttcaattttcgtgtccgatgagtttgttcagtttgccgatagcatgggtatcagattgttgaattcctcaccatattatgcacaagctaatgagtaggccgaggcgtctaacaagagtttgatcaagttgattaagaggaagatttccgattatcttcggcaatggcatacttggttggccgaagcattgttgtcttatcggatggcttgtcatggatcgatccaagtcccgccttataagcttgtttatggacataaggctgttttgccatgggaagttagaatccgctcaaggagaacggaattgcaaaatgatttaacagccgatgagtattataacctcatggccgatgaaagggaagacttgttcagtctagattaagggcccttgcaaaggtaccagggataaggaacgaattgctcggcattacaacaagaaagtggtgcctaagactttttcggaaggtgaacttgtatggaagttttttttaccgattgggactcgggataataaattcggcaagtggtcgccgaattgggaaggaccgtttcagattcataaggttgtgtctaagggagcatacatgctgcaaggactcgatggagaagtatatggacgagcgctaaatggaaaatatttgaagaaatattacccaagtgtttgggttaatgcatgatcggttagtgttgccgatacgtgatagccgatgtgtttgcatcgccttgagatggccgatattgttatatcacccttagttgtttttttatgttgtaatcggttatggtttgccgatctacagtggccgatattgttatatcgcccttagttgtttttcatat

SEQ ID NO: 8093 - DNA, 3436 bp, Oryza sativa
acaagttgcaaatttggaaaatttttgagcaagttaagaagttatattaatcggcacaaaggatcgtcaagacagttgaatatagtaccaaagcatcttagccgattacaaaaatttcctaaggcctattacacaagaagtcactgagacaaatattgctggatagcgatatagccctttgcctaatttgttctacctcctcaatagcttgggcatcttgagcatcgattccagggatgattttcaaggacttggtcatatcagcaacgttttttatgaccgatttcagccttgtcttgtgttcttcaataactcgcgggagatcggctagcttcttgtgttccaggtccagttcggcattacattcttgaagttgagccaagagctcaatcttgcgggcttcgagccgatcaatattggacttgatcggaccttcagacagttgatcaagcttgaatttttcttcatgtacaagttgccgattggcttggatagtggcttcaatgtcttttcgctcccatcgatcggctatccgttgcttagctttctccagcttgaattgatgttgctcaaggtacgcagctggagtgatggtgttcgctagatcatctgggattaaagcttggatttctgcaaatcgtgcctggattgaaccacaatcggccaccagactgtccagtgatgaccctagccgatgacatatgtcttcaaggattttcttgacatcttcatttagaggggctagagttttgcttgatgtttcttcttttgcttcctcatcaaagtaatccttgatgtcaaaagagaataaatcggctaaatctgcaggaggaaatttgaagacagttgattatcaagatgagttgttcagccgattcaagatttttatagacaagacttactgggatgacaggagtggttggttgtacttcttcttcaacatggtgactccctgcagccgatggggtttgatcgcttgatagttgctgaacaggaggagaaggaggaggaggaggctgcaaaaagataagtattaggaaaaatcagctgggatcaactactaaaagaattaagaatatctcactggtggagccgatttgggaaatggtgctgccgatttcttctttacagcggttttctttttttgcaactataaaatctgtgagcaatcggctataagtgagaaagttgcaaaaagaatcagaggcggttgcttacccttgaaaaatgggctagagcagaaggagttggaggagtttgcttaggagaaaccgatggagttctcccggtagctgtcccattccgaactgtctggcagagctcatcggatagtagaattcataagaaacttgtatatttcttccttgatgaatgccaacaggaaggatacatgggctgattgaagttgagaaaacttctatagatttttggtatctctcatgattgatgtcttcgaatctaaagtccgatgggagatccaagtcggctgaattctcatagaagaaccaaacacgtgcatctttttgaaagctttcataaaagctgcagaaccagtccttgagcagctcagccgataactttgctcctgcattggctggtgtggatgcatattccccataggacatacacctgcggtgggtgcgttcttctccatcatcatctgcaatcggctctagtcttggaaattcagcttctgtcacagatggccgattaacggctttcataactaccagatttagccaagattgcaataaccaccatggtcctcctgctccaaccactgagccgatagctattttggccgatgcattgttcaacatttggtataagtagccgagaagggttttacccaaagggaattgcctttttgtttcaagggcttcggctaagaattgccagttggtggtgggaccacaacctggtccgcagaagaggaatttttctaaccacatgagcaggaaagccacatgttccctaggagtgacagatccttggcccatatatgctgccacataaccagaccaaccacctatgcttttggttttgaaatcaaactggttcttggtgttcaaactcatagggttagccgatgaagtcacatctaatctagtgatcatggtgatgtcgatcacagttggggtcatcagcccttggttgaacaaaaaggcattaatggcactagaccagaagtaagaggcagctgccattaggggctcatccttagctgaattggctatagtgagggcgagtacctggccgattccaatttcatcccaatgaacctgcttgctagccgatacgcgcttataccatgtggtccagcttttctcaggggaggttttctcgagggatggccaagacttgaaggtgttcttccaatcgctcagattagggttcgctaatctaaaggggattctgttggttttggcaatgatgaattcagtagggtcggaatcaccaattggaccaaggaaatagtggttgtcatgcgacagacttggaattgcaacaagattggacagatgctacggatgcaatcaggaatagagaagaagaaaacaatataaggcaggagaaaactaatctgttgcaaaagagagagatctagccgatgagaacttacctcagtgtactcggctaatggcgcggcagatgggctggcggaacaagacatcgccgcaggcggagatctggccggagatgaagtcgcctgggaatcgccttgtgtgtcggagaaatcgccggagagagagaaagcatagttggtttcggcggtgaaaacgggagaagacggtgtgatttctcgggggtaacggttagtatttaaagcgctggaataacggtcgggaaaaggcaagagcggatttctctcggaatcgacatatggcaaatccgaaacattatccaatattccggacttggggggcatgtgttaacgaccaaatttggtaatgtcagcatcgaaaaagaagattagatcaaagcggaatcaaagatgaagagcgtcgcgaaaacagagtaagaatcggctgaagtttgaatcggctacggctaagaccggcagagttcgagtcggacagtgttagccgattgagccgaatccgacaatatgatgcagcaaacgttgtcggtttaggttgatgtgcttcatgatgattgcggcgtatggatagagtcctgagaagtcaattgtatctattaattaggatattttatgtaatttccttagagataagtttgggcaaaagtctgccgcgaagacttatggtatcttagagtttgttacagataagagtcgtgtctggtatggacatattttgtaattctcgggtataaatagacccgaaccccatgtaatcgaataaacacacgttcaatacaatctcggcgcatcgccacccttttactttcgttttgtttcgacgagttcttgctt

SEQ ID NO: 8094 - DNA, 719 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcatcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagat

SEQ ID NO: 8095 - DNA, 45815 bp, Oryza sativa
cctcccccctccccccctccacctggtttccttttttggcaccacattactttcctattttagtaaatttatgcacctaaagtttatacacctcaagtttacacatctaaagtttagagacccaaagtttataagtcaaaagtttatatatccgattcaaatttgaatttgaattcaaatatttttcatatatagtatttctatacatctgaagtttatatacccatttcaaattttaatttgaatcatatctgattcaaatttgaatttgaattcaaatattttctatatatagtatttctatacgcctaaagtttatagacccaaagtttataagtcaaaagtttacatacccgtttcaaagttgaatttgaattatatctgattcaaatttgaatttgaattcaaatattttctatatatagtatttttatgcatctaaagtatatacacctaaagtttatagacctaaagtttataagtcaaaagtttacatacccgattcaaatttgaagttgaaatcaaatattttctatatatagtatttctatacatctaaagtttatacacctaaagtttatagacccaaaatttaaaagtcaaaagtttaaatacccgattcaaatttgaatttaaattcaaatattttctatatatagtatttctatacatctaaagtttatacacctaaagtttatagacccaaagtttataagccaaaagtttacatacccgattcaaatttgaatttaaattcaaatattttctatatatagtatttctatacatctaaagtttatacacctaacgtttatagacccaaaatttataagtcaaaagtttaaatacccgattcaaatttgaatagaattcaaatattttctatatatagtatttctatacatctaaagtttatacacctaaagtttatagacccaaagtttataagccaaagtttacatagccgattcaaatttgaatttgaattcaaatttttatatattgtatttctatacataaatttttctaactttttgttttttttacaaaatttttgtggtgtactgtagtaggaagagaagaaggggtggagaaaggggggagaggagggaggagtgtatcgagtataggggatgggcggacgggtgatcgctgggcggacgggggagcgatcacccgcccattagcatttccgtgttcaaagggtctttggtcaaggacgcaacggggtcatttgcattgtagtcgggggctactgtcagtgtcatagataaggcatactcgatagtcttggttaggctcagcggggcctaccatataaaaattcttatacagaattatgcctcatgtacggagggtgttccggatgaggaaggaaaaacataattctactcgggcactacaaggactactcggatcgtatccacacttgtctccctagttctgcttggacaaggggacatgcaagggtataaatgcaagacaccctaggacgagaggggacacgccaacaagaccaacataagggacaagcatagacaaaacccaatgttggcgatacagaggccaacaaaagggatctagcactacccccaatctggccgagtttgtatttgaggaagaagactgcactagctgtcgactacgtgttggaaatccatgtcgtcaagccgacagagactagattgggtcatcccaaatattgtactcatttgatattgatatataaatgcaacaccggcttcggccagcaggagtagggctattacctatcagttaaggggctcgaacctgtataaaaatccatgtctcctatctttttacctcagtctcgcgtataccttaataccatcgtatcccgatacttctgaatactgtagtaatagcataacccatcgacaacttcatcgacaaaatccagactcgagtacccatcacaagcacactcatgagcaatcggctcttgaatctcaacggtccagatcttggccccttcatcgattgggacaaccaccaattttgtccaccaactagcataatgaataaaggggaaattaacatttcttacacgtatatcaataataaataatttaattgtattaggattggagaactaatgtggatgcagagaatatacattaaagtggaggagaaatgaagctggcatgcgaagaaacacagttccgccgaatcatgtctgagcacgagattgatgggcccacaagtcagtgcaaaccgacttaaagaggggccaaaccaccaggaaccatcatatgggcccaggtgccatcctctcatcaaaggcggtggtgaaagacggtggccatggtttggctgaactaggcttggcgcctccaacaccgagcttccacatggcgattccttcttcactcctaatggcagttatgtccgtttcccggcctacaactagggatgaaaacggatcgaatacgatcggaaactagctctatcatatttgctttcatattttttttcggaatcgaaatcggaaacccagatatgaaagcggaatcgaatcttatcggatataaatagggagtgaatacgaagcgaaacgaatacggtgacgaatattaatcagaatataaaaacccctcaatactcacaaacgatttttgatattgtgtttctaaaatcatgctatatcatgttattgtgtttttactatattattttggctattttttgtgactttgttttatcaattaaaaatttgaatttcaaaacttcaaatgatatttgaaacagtaaataaattcagctgaaaaagtcatgaacataaaagttgtagaactcatcaagacatacaacttttattttagtcatttcttcatccgacaaagtgataataacattgttcataaaatttacatctctctcttctagtttataaaaacaaatgatagagatgtaaattttgtgaacaatgttactatcactttgtcggatgtagaaatgaccaaaataaaagttatagattttgatgagttatacaattttgttgtcgatgactttttcagttgaaatcatttagtatttgaaaacattgtttgaagttgtcatatttttaaattcaaattcaaactgttcaaacaaagtcatatagcaaaataacaaaaataaaagttatagatcttgatatgttatacaactttgtttttgacaatttttccatttgaaatcatttactacccgaaaaaattatttgaatttcttatattttaaaattcaaattttatatagttcaatcaaacttggatggagaaatgaccaaaataaaattggtagatctcaatgagttctacaactttgtttttaacaactttttcatatgagttcatttagtatcataaaatttaatttgaagttcatttttgggttgggctagcttatgggtctgatgtgtaagtcggatatccgatggaaaatactggataatatccgacggatatccgattccgacggatatcacctatatcatattcgctttcatatctgacaaaaaatccgaattcatttccgaattcaaaaatttccagatatatccgaccgaaactatctgaatccgaaaaaaggtccggtcggacggaaattatccgaatcactttcaaccctacctacaactgacttcactactgtcattaggaggctataaaaggagaagcttacttcacttcacaacacacacttcaaggaggaaattccccctttcactttgtattctctatagtttctagtaggaataaagcttaggagctttaatactatagtcttcatggagttttggttatgtctctagtactttactcttctgataagtctatagtccaattaatagaattatcttctctatttatttattctcatggtttatatatttctttgttgagtataagttctatgagtagtatatactttgtatatccgcttcatcctaggctagtcgatctgttctacggtgatggtcaaatgacctttataggttgctctagctccaacttgttcatccgtagggtgagagttccggaggagttagtgatattatttgttggaataagcatggtgcataggctaaataaatgtcgttggatgcgggtgtgccccacagtaagtgaggtagccagcaggtggtgacagcccggtcagtcctttgtattcctccgcatttggatatgacgtaatagtgcgtaaatgccataaccatgctggcagaccagcagagagtggtctcttgctggtgcctgggtgcctgcaactaaatcctatgttgtaagcttgtatatgttaagtgtatactagacatgattagtatagaagtacagatgaattgtagtttcctaaagctaatttcctactacatattcttatagaggtggatctcctgtgtgtatccactaccttattaattattatcctaacccttgtttagactatggtgaattaattataggctgattaaggagatacagaaaaacatatctttatgtcaccactttccctgtggaaatataactacaatactcttgggaatatttatgtgtgaaatgctatagcggtatccatacgattgcggatttatctgagcccgaagtagaagacgacctccccgacattaacctagaagtggaacaagtccttgtcgaggaagtcgcaaatgaggaaattgatgatgctgccaatggttctgcagatgaggagcctgccttgccgttacgaaaatatatctacagccgtttacattgcataaaaacaagtaagcgatgcaagtgtccatcgaaaatctcctccacatcatcaatcccctccagcattgtaaacttaatcctcgttttctttcattcctagtcatataactttattttaatcatgaattgctacttgcagctggccgctcaacctcctttcctcattggcagacctcaagcgaacatgctccttcccactcgattcgattgtcgatagccatcacaccgatgaaggcccaaccccagactgctgctccaagaatcctggtataaactatctccattaactccaaaatttacctttcacgcttcacctctaatacaacccttgtttatacagaatatcaccgatatcttttctttcgatgttcgccaattcattgatgacagtgaagacgacatcatgagcaaaggctaccttcccacctctagacactatcagaagcgctctcctcgacattaccaaccagctaaatgcatcgcttgatgccttggtcgagaactgcgtgccgatctggggtcgtatcgaagaagttcaaaaccttcttcccgacgaagtcatcaatgacttggcgccaacagcctacctcgagacctatcggatcaaagtcttcagggctcgatagcgtatggctgaccgcgtcgtcttgagaactgaagaagctactatcgaatctgatagacaattagccagagcagaaaaaaaccaagctcagtgagttagccgcggccctgagacaacccaaaagcaaaccaaagaattggacaagggagaagccgatctgcttgctgcgctggagagcacacggcaagagctagaacaaagccactatccgcaagccagctgatcggcgtaaatctattaagccgataccaaggtctgatgccgaagacgcaaaaatcatcgacgatgttgatcaaatacgcccgcgtgtggtatcgacaatccagaaatatctgggttgatgtaaaacttctgagttccaaaacacttaaactattttgttacacaacactcttttgcttacaagctaattttctcctttattccttctaaattttctcctttataattttgctttataagctttgtacaatagcttcatgtccgtaaaccagttgatacggaggcacttgaatagctctatgacacgccatctgataagtccataacgaattggctagtgtagtatgccatttttgtgttgttctgcaatcttcctctttatcaacttaatcaaacatttattagatgttgcagcttgtctgttatgttgcacataataagaaaaagaattcaacaaaccgaataaattcaactgatagaaaacaaatagaataattattttcgttgcgcactatataaatatacttagcaaatggttgaattcaacaagaaagaatgaaacagagtgaaaaatagtgaaaactaatcttgtagcagttaatctccaacaatcccaaaaatttagagcaaagcctcccctcctctagctggtcgaacaaaacctagaggtgccgctatgttctttactcgatcacctcgacgagtgaggatgatgggctatatactgcgagctcataggtgccagttcataaatagaattggcacatatatatgtctgacagcctcgaaggtgttgtttagtaaaatgagcactcatagtggctactcgcgcagggtaggccttaaaggtgacggcacctttccctgataaccttaagggcccctttgaatcataggattgaaaaaatgtagaaataggaaaaacgcttgattttgatatgaatgtaagtgtaaaacagaggattgcaaagcacatgaaaaacataggaatgatcatttgattggaccacaggaaaaacacaagaattagaggagagttaaagactcataggaaagttttcatgaagtagaacctcatgctagatttcctctaaaacttgcatggcattaggccggcaatgggaaggggggagggcaaagggcaccaccacggagcccctcgacagccttgcgcgcacccgcgggtgcacgcgcgtgccagcgagggggcccgcagcggcgctgtcatctcctacggccgccgctctctctctcacttggtggggtagactgtgggggagaagagaaaagaggacgccggccatggggcggtggcacgagggccgccggcggcggcgacgctgctccgcgtggctgcacgtggaagtaaatggctagggttttcaggcggctggggacgggctagggcttttgatcgcccgatctctccgctcgaccgtccgatcgaaaccttggcgatcggacggccggtgtcggccggccgaattgagcacaagagggaggcgcgtggcggcagctttcccggcctaggaataggttgcggcctagggggaagggggcgcgcgcgcgcgctcggccgtgggccgcctttttccaatgggccgaaagtgacgggcaatgaacaatagcgcttttccttttttatttgtctattttcatgcatatttcaatagaatttgaatagattttgcatgttttacctctgtttaaaatttgaaccaaaggggtaattttttacacagagtaaataacagaatttcttactgttcatatgtattttatatagatcttccgctacaaatagatgaaattgataaaaattcgtgtttctaaaattaaatttcgaaccaacgggagaatttaattttaagaacattaattttgtgctatgatgttgtaattttctgacaaacgttgttaatttcaatgttatagttatggctttatgtgttatgtctattttgcccaacggtgatttaggtttaatgcataatattttaatgttaattttgttctcacagtacatgattatttcaggtggctactccttgatgggttgaataaaagatattctgaccctaaagggagataactacggagagtggaaaagaaaactcgaccttgcttttatcttgggagtggtggattgggtcttgaccaccccatgtcctatagaacctgctacacttgtcagaggtgaaaaagagtcggatgctgactggcgaaagagagagagggacaatgctcccctcacaatgtcgtatgacattgagcatgcgaaatggtccttagccagcaagaaatgttttgctgtggtaaaaaaacacaattgagccaaccatattgggctcaatcccaaagtgtgaagccgtctctgactaccttgaaagaataaagagccagtttactggttcttcaaagacttatgctacatagctgataaagcagcttgtgacagagagtaccatagaggtggtgtaagagaccacattcttaggatgagcaacatggcttccaagttgaagccaatagatttgggcatctcagatgactttctggtccatctggttatggtctcattgccaaagcactttaacaacttttttgtcaactacaatataagtccagagaaatggaactttgaaaagctcatcgctaattgtgtgcaagaggaggaaagaatcaaagagtccaatggtggctctattaactatgttaaagataacaagaaaaagaactacaagtcaccctcctcaaaagtataacagcctcagcatctgcctcagcaacaacagttcactgttgaaaaggatcagtgtctctactgcaagaagacaggacattacaagaaagattgtcctggcttcctgaaaatgatcatggtgttgacagaaaacacgaagcctgggagatctgcttaactccagtccaggtccaaagctcgccttcgggtgtgctagcgtgccagttgatttgatcctgtaatcaacaagaaatagaagcaaagaaaccgtggttaaatctataaatgatagccgatcggctaggtgcgatgacatatcatttatctttgagccgatgtcatatgtgaatcgatcggcagtcatgaataaataagaaggaactaaatctactcaattggctgtagatattaacaatatatactccttatatcaatatatacttaaatcaagtgattaggatagatcggttgtcacgcccggaaattcactagtaatttccgaacttatttgtgcataaaatcctcgtctaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaacaggggtataagccaaacgtcttctccttcgcaacttgtcttcaactgaggttgattgattattgcaaggtgagcatatgacatactcagcaagccacacagcaaatatgcaagtgcacaaggataccaaaggatggcataatataggctcatttgcaaaagcagcacttagcaaatcatttaagagatgtaaaacagtggagtaattaatcagaaattttaatcaacactgaacaacacgcccatgctgctcaggcccagccattctgaaacaaccatacccggctgtacagatctaatctccaaaccaggagctaagcaaattattactagttataacatcaataattattgtgagaggtgtgggactaatcacgaaaaacattgctcaacccgcccataaccgcgggcacggctattcgaatagttttactctggccagaggtgtaccactatacccacaagacacagccccacaacatgtcaccatgtgcctcagtaccaccacggtacctcggaaaggggctgtgacattaccccttgcataacacaacccaccacagtgcaccgttcctggatcataatcaccccctcaaaaaccagaggcatggactccccagcgacccccgtgggcttatctccaccacttctcagtctggtgctccgcaatgaatcatgttatacaaaaggtaaagtcgttgcccacgctggcttgtggttggcacgattaatgtttcacaatagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaactagtcaagttaataataacccaaggtatcaaggaataaaataatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattctgacttcaaataaatttattatgaatttttaaagattaaatcggattaaaacacttatatggattttaattgaattatgacacagtaatgaattatttttgaaaaggaaaagaaggattattgcgtcagcggctagggtttgcggtggaccgggcgcacggcggcggttcacggaaacggacggccgagatcgatccattcaaaacgaacggccgagatcgatcggtccacgaccggctcacgggagagggcgacgatgacgtcagcgatgacgtcaccaccggcggcgacggctcggcggctcgacagctcggacggcgcacgctcaccggcgaacggcggcgcggcggcgcgaacggaaggcaccaacgggtagaacgcgacgcggcgaactcaccggtgaccaaaggagcggcggaagaccaatggacggcgacggcgacgaggaagaagcggcggcggagatcggatcgacgacgacggtggtgctccggcggtcttcggcggcggcaaaggggcagacgaggacggcgacgcgacggcgaccacgacggcggtcttcccgagcgacggcgacgtctggaacggcggcggcgcgcggctgaagcgacggcggcgacggcggcgctagagcacacggcgctagggcgctacggacgacgagaggcgaaggcgaaggtggcggcgggtagagaagagctcgggggtccttttaaaggggctcggaggcggcggcgaaggcccacggcggccggcgacgagaaggaaacttcggggttcggaggaaagaggccgatccaaatcgaactcgattccacgaacttccaaaacgaattagccgatgtttcccctctatcaattcagccggaaacggaaaggatcgatcgaatttggaagggaatggcggcggcgcgaaactagggtttcgggcagcggcggcctgaggttgacgacgaccctgacagaaggggcccacctgtcagcggctgagagagagaggagagcggcggctcggtggactgggccggactgggccgagggaaagagagaagagaggttttgggccggctttcggcccaaagccaaaagagacttttaaaaacctttttcaatttaaattatttatgaaatgcaattccatttattaaaaatacttccttagctcaaataaatcccagaaaaatctaggaattatagaattaagcaaagtatttaacaaaattttatctagctcaattttatattgagatttagcaaattaaaattagatcttctcttttaagcttttaaaatcatttctaataattccttttaaacaacaatttataatttaaggatttttaaacaagaaaagctcttaacaaatataattagattattaatgatcaagtaattactgaactgttctttgtatcatttaggaattgagctctgaaaaatccgagaaaatttcagagagttgacttaatcatggagaatttaataaaaattaaatccatccatgctttatttttaggaaattctatttcccacaattaacttcacttgaaaattaaagaacatttaatataaattttattaataatttattaaataatttataaatcctgaaacaaaaatcaggatgtgacatcggtcatcatgccgagacaatataaatcacttagttcgaaatatatattaataacaggactatatatgtttatagcatagcccgatcagatagatctagtatgtatcggctaatactccgatgctgctctatatcaggatatttaaaataggtataaagtatcaaacaaaggcctaatacgcttgaatacagcaatatcttgacataaagggcagatttaacatgtcaatgaagcatatagagcaaatgtggctaaatcagataagatcggctgaaactccgatgctaccctaatcggcaaccagaaggcaggctagagcttgatattctaagcacgacttaatagatcaaactcaactgatgcagcattaagtatgaaaagaagaacaatatctagacaatcaagccgctagaagtttcataaagtggtaaatatcttatataatctgagtcaacgtcagaatctaacctaatcggctgccttcttcgatagatgttagccgattgtaggttagatagcgatattgccagggattatgtaagatatatgataactcgaagaatcacataaactagattagagtatcataaagatggaagcactaatctcaagaacgcaagccgtcataacaagttttacctcttattgaagatcgaaaccgatgcagcttaacccgaaagcaagaactcgtcgaaacaaaactaaaataaaaagggtggcgatgcaccgaaattgtattgaacgtgtgtgttaaaagttacatagggctcggatctatttataccagagaattacaagatatgtccataacggacacgactattatctctaacaaactctaagataccataagtctttgcggcagacttttgcccaaacatatctctaaggaaattacttaaaacatcctaattaatagatacaattgcctcctcaggactctatccatgtgcggcaattaccttgaagcacctcaatccaacccaacatcacacatcaagttgtactaccgggatcggctacatcggcttacctagtccgactcaaactcagccgatcttatcgtagccgatctggactccagccgattcctgctctgttttcgaactcgatctccgcctccgacttcgcttcgatctaatcttcttttccgatgccgatattaccaaatttggttgttaacacatgccccccaagtccggaatatttgataatgtttcggatttgctgtaaatcgactccgagcaagtttcgcactttgccgttttcccgaccgttactgccgtgctttaaatattaaccgtcaccctcgagaaatctcacaccgtgacttccgttttcaccgctcaagcaaaactttgtcttctctctctccggctattcctccgacgcaaaagcgacttccaggcgacttcatctccggcgagatctccgcccgcagcaatgtcatcctccaccaacccatctgatgcgccatcagccgattacgctgaggtaagtccccataggctagatcccctttcatagcagcagatcgattttctcttatcttacatcgctctcttttcctcggttgttttggatttgtagcatctctccaaccaagtcgcgattcccaacctttcgcacaaaaaccactattttcttgtcccaatcggcaatctcgaccccactaatttcattattggtgaaaccaaccggatcccctttaggctagccaaccctaacctgggtcactggaagaatatcttcatgtcttggccatctcttgaaaaacccacacctgataagagctggaccacctggtaccaacgcgtatcggctagtaagaaggttcactgggatgagattggaatcggccaagcgcttgctctcaccatagccaattctgctaaagatgaacctctgatggctgccgccacctacttctggtccaacaccatcaatgctttcttattcaaccaaggggactccaaccttaatcgacatcaccatgattactggattagatgtaacttcattggctaaccctatgagtatgaataccaagaaccaatttgatttcaagaccaagagcataggaggctggtctggctatgtggcggcatatatgggccaaggatctattacccctcgagagcatatagctttcttgctcatgtggatcctcttctgtggatccagctgtggccctacaaccaactggcagtttttagccgaagccctagaatcaaagaaagaatttcctttgggcaaaatccttctcggctatctgtaccaaatgttgaacaatgcatcggctaaaatagccatcggctcaatagttggagcaggtggaccatggtggctgctacaaacttggttaaacttgatagtcatgaaagttgtcaatcggccctctgtaacagaagctgaattcccactacagaacctgattgtggaagatgacggagaagaacgcacccatcgcagatgcatgtcatatggagaatatgcatccacaccatccgatgctggagcgaagctatcggctgagctgctcaaggactggttctgcagcttctacgaaggttttaagaaagatgcacgaatctggtttcattatgaagactcaggagaccttgaacttccatcagactttagatttgaagacattaatcatgagaaattccaaaaatccagagaagttcttatggctgccatcagcccatgcatccttcttgtcggcattcatcaagggagaaacatccaagtctcctacgagttttatcacccaatgagctcagccagacaacttggattgggctaactcctaatcggcttattttttaccgacaagattcagtgccgaggacaaatcacatctactctaatgatggatcggctacttaacctcccaggaccccctctgggcagcattgataatattgaattggcaggatttagaagcaaaaactttgacagatggtggggtgaatagaagctgcatctatttcatcaatcggcttcaatgtatatgacagatctattccttgacgtcataccccaggtaaactttgtcattactaatttgcataatcagttagccgattccttacttgactaatctttggctcctgttttgcagacaatagagtcctcccctcctcatcaaagtaacagtggcaaaaacattgaatatgctcaaggtctaattccgaatagaggtggactatctccccctgttatcggctaccatgcccccaagacttcaactctccttcatggcctaaccagggaaccagccgatgcagacaagaaaaggaaaaccagatcatcggccgtgagtaccttgaccttagttccaaagaaaaagtccaaattcaagaaaactaagccgactgataagccggctgatgatctacccgccttggatccgtctattgaacaagctttagatgaagaggaaattggcaaagatgttgaccaggctgtagccgaaatgagtgacacagaaagaacaccatcggcttcacccaagcagacgcctccaactccttctacccccgttcattttacaagggtaagtatctctctttgacttcttctaaaattacttctctcttcggctaattactcatagactttgtggttgcaaaaaaagaaaactgctgtgaagaaaaaaccggcaacaacgattgccaagtcggctccaccagtaagatgtctttaattcttttactctacagcctcctcctgcttctcctcctgtacagaaatcgtcaagtgaccagactccatcggctgtggggagtcatctcatcgaggaagaagaacaaccagctgctcctgctatcccagtaaattttcctttgtctcaacaattagatcggctataatctaccaagctgtggggagtcatctcatcgaggaagaagaacaaccagctgctcctgctatcccagtaaattttcctttgtctcaacaattagatcggctataatctaccaagctcttactttttccgaaattgtttctgcaggttctagtcgatctcttctcttttgatatcagagattacctcgatgaagcagaggaagatacttcaagcaaagctctagctcctctatccgatgatgtgagaaaaacacatgaagacatctctcatcggctagaagcctcttctttagatagcttggtagttgactgcgagtcaattagggcacggcttcatgaagttcaagctttgattcccgaagatttggccgatgtcctaactccagttgcttatctcgagcaacatcagttcaagctggaaaaagccaagctaagactagccgaacgccgtgagcgcaaagaaattgaagccacaatccaggctaatcggcagctcgtgcatgaagaaaaaaccaaacttgatcagctatccgaaggtccgatcaaatctaatattgatcagctcgaagctcgcaagattgagctcttggcacaacttgaagaatgcaatgccgaattagatctggagcacaagaaactagccgatctcccgcggtctgtcgaagagtaaaaagcaagactcaaatcggctatcaagaatgttgctgaactgactaagtctttgaagatcattcctggaactgatgctcaagatgctcaagctattgaagaagtcgaacaaattaggcaaaaagctatttcagctatccagcaatacttgtctcaataacttttgtgtaataggacttagaaattttttgtaatcggctaagacgctctaatgctttactgtcttgacaatcctctgtgccgattaatatgactttgaaatttgcgcaaaacttcgctcaaaaaatttgcattgcattttgatatatatgtgcccccctaattttacaacgtcaaaaacattgataaaattataaaacaactaagggcgatataacaatatcggccattggacatcggcaaaccacaaccgattaccatgaaaaaaaattaagggcaatataaccaattcggccatctcaaggcgatgtaaacacatcggctgtcatgcatcggcaatacaagctgatcatgcattaacccaaacacttgggtaatatttcttcaaatatttgccattgagcgctcgcccatagacttcaccatcaagcccttgcaacatatatgctcccttagacgcaagcttataaattcggaacggtccttcccaattcggtgaccacttgccgaatttactatcacgagtaccaatcgacaaaatcaacttccatacaagctctccttccgaaaaatctttaggtaccactttcttattataatgccgagcaacacgttccttatccttggtaacctttgcaagggcacgcaatcgtgactgaaccagatcctccctctcatcagccataaggttgtaatacttatcggctgttaaatcgttttgtaattccattcttcgagagccgattctaacctcccatggcaaaacagcctcatgcccataaacaagtttgtaaggagggacttggattgatcgatgacaacccatcctatacgaccacaacgcttcagccaaccgagtatgccattgccgaggataatcagaaattttacgcttaatcaatttgatcaaacttttattagatgcctcggcttgtccattagcttgtgcataataaggtgaagaattcaacaatttgatatccatgttatcagcaaactgaacaaactcatcggacacaaagattgaaccctgatcggtagtaatagtttgaggaataccaaatcggtatattatatgttcttgaacgaattgaatggcatccccagaatcaactttcttcaaaggaatcacctccacccacttggtgaaataatcagttgccaccaatataaacttgtgtcctttactcgatggtgggtttatcataccgatcatatcaattccccaacctctgaatggccatggcttaataataggattcatagccgacgccggcgctcgctgaattgctccaaacttctgacaatcttgacaccccttataatatctgaaacaatcctccagcattgtcggccaaaaataccctgcacgccgaagtaaccacttcatcatatgagccgattgatgagtaccacaaattccttcatgaacttcgccgattgcaactttagcttgatcagcactcaagcacttaagtaacactccatcaatcgtccgataatagagctcatcatccaacaatgtatactttaatgccttatgccttaatttccgagaagccgattgagttggattactcaaatattgatgcacatcatacctccaatcatcggctgttattgttgcaatttcaaccttaacatctttgaccatcggcttataccccgatgccccttgggctaaatcattagcttcaaaattctgttctcgagagacatgctttaaagtaaccagccgaaactctttcattagttcttggcacttctcattataaaccatcaatgtatcattcttgcattcatactctcctgccaattggctgattactagcaaagaatcccccatgatttcaatggtatcggcttcaacttccctgagtagttgcaaccctttgagcactgcctcatactcagcttgattattagtcgcatacggtttaatagtataagcaaactcgaaacatgccccctaggggaaattatgaccaagccgataccacaaccatgagtacacaccgatccatcaaagaataaagtacatggcactatttcaaccgagccgattgaatcatcacgatgttccacaataaaatcggctacagcttgtcccttaatcgcctttggtgactcataccgaagatcaaactcagttaaggaaaatatccattttccaacccttcctttcagtattggagccgataacatgtacttgacaacgtcggccttgcatctaacagtacactcgttggatagtagataattcctcaaccttgtacacgaaaaatacagacacaaacataacttctccataggggaatatctagtttcagcatccaagagccgacaactgagatagaatacgacttgttccttcccttccaactcgtaaacggtattcctttctgtggaggaatcaaaataggaggagagctaagatattccttaatatcatccaaaaccttttgctgctctgcctcccaagtaaattgctgatcggctttcaatctcataaaaggtataaaaggttctaaccttccagacaaattagaaataaacctcctaacaaaatttatcttgccgatcatctcttgtaattctgtcttattctccagaggctgaatcttcttgatcgcattaacactcctttgagttacctcgatccccctttcatgaataagaaatcccaaaaactgtccagccgatacaccaaaagcacattttatcggattcatctttaggccatattttctggttctctcaaaaaccttcctcaaatcagctatgtgatcctctatttctctggacttaacaaccacatcatcgatgtagacttcaaccaaccagccgattagatcatgatatatgtaattcatggctctttgatatgtagctccagcactcttcaagccgaaagtcatgacaacccattcaaataagccgattgcaccaggacacctaaaagctgtcttatgaatgtcttcttcggccataaaaatttgattgtatcctgtgtttccatccataaaactcaaaattttgttccctgatacagcatcaaccagctgatcggctactggcattaggtattcgtccttcggtgtagctttattcagatctcggaaatcaatgcacaccctgatcttgcagttcttcttaataactggaactatactagaaacccattcagcgtatcgacaaggacgaataaaaccagcatcatacaatcgcttaatctcagccttgaccggttcaagcatatcggctttacatcttctcgggggttgctggcgtggtctaacccctggtttgataggtagccgatgttcaacaatcgatcggctgagtccaggcatctcataatactcccaagcgaagcagtctctaaaatctttttaagagctctatcagcttggttctaaactctggagataagttcttactaataaatgtcggccttggccgatcgcctggacctatgtctatttcttccaaatcatcggccgacatgaaaccttaaccttgcttgtcatcgagatcatctactgtatccttagtgtagacatttgaaccctccgcgacgccctcaaaataatagcttgggttctccatcttcaattggttgtatatcagaatcggacacttttagaaaatctccatcccagacttttccagataaacaatccaggccatccatctcccaaagagctaaatcggcactggcaacattaactgacctgtcagctggcacgatctctatcttgtcgccttgccattgaatcaaacattgatgcatagtcgaaggaatgcaacaattagcatgaatccaatcccttccaagcaacaagctgtaagaacccttcccatcgctgacaaaaaacgtagtaggaatagttttgctgccgactgtcagctccacattcagaacacctttggtttccgatggattaccaccaaagcctttaagcaccatgtttgtcttgatgagatcctcggcatttctacccaacttcctgaacgtagcataaggcatcaaatttaccgtggccccaccatcaaccatcattttagacatcggcttcccattgacgtagccatttatatacaatggtttaagatgtcaattctctgtcccctcgggtttctcgaacactgcctgttctggtgacaaaaccaacttggccgattcctcttccacctcgtcaacatcagcttgatcaatcccgaattcggctggcaaaggtaaagaccatgttaatcggtgccgtcacaacactcttcccttttgtcaacctctttgcctcatcggctgcaacatcatcggctacaggaacctgactcttaacacgccactcctgtcttggctttgctttcttcagccgatgattaatttcttgttcaacctcctgaaggcgctccctattcctcaatctttgaacccttctcttttgattcttcatgaaaataccagaaggacaccattgattcttcctgattacattgtcctcctggccatgaccttggttcactggacccaatctttgatgaacagaaactcttgtctgccttagccgattacccctattatatgaccggcttgagctcccgacgatatcactgcacccagggcagttttcaatagatggcaacctcataccatcattccagcagaacctaaagaactcacaaccccaatgagggtcaaaaccatcatcgtattcttcataatgcttctcctgctccttgtcatacttcctctgatatttgttgataatcttagctgaattcacctgagaaccctttgcacggaccctatcggctgtttggccagctgtatgcaccatattaacaggaaaaggattaccatcaaccttcatcggctttttggaatcatcaaacctaatcttgcccccctcaatggccacctgaatctgctgtctaaaaaccttgcaatcgttagtagaatgagacccagaattatgccattcgcaatacctcttttttcctaattcctcagccgatgcgattgtatgaccagcaggaagttgaatttgcttctctcggaattgcagatcaaagatcttatcagctttactaatatcaaagtcatacttctccacttttccagaactttttacacattggcatggtatgacctttttactcctcacccattcggctgcagctatttcagaatcgtcctcgtcatcatccgacccatacatgtatggacaaacatgattaaccttcttagagcttttcctaacttccgcagacctatgttcatgcaaggttaccttctgtatcagatgtgacaagctatcaaagtcttcagacgagaatttctccctgatcggagtaatcataccctgaaaggccagatcggctaactcggcatcagttaaactcaagctgaagcatttgttcctcatctccctgaatctctgaatatactcgtgcacaggttcatcatgccgctgcttaatcgctgtcaagtcagataatttcatctcatgaaccccaccgtagaaatagctgtggaattgcttctccaaatcggcccaactattgattgaccaatacggcaaagaggaaaaccaagtaaaagccgatccagataaagacaacctgaataacctaaccttcagaacgtctacagtcgatgcttcaccacactgagccaagaatcggctaatgtgctcataagtcgacacaccatcttgtcccgaaaatttggagaagtccggaactttgaaccgattgggaagaggaactctctcaacaaactcagggtaaggctgccgatacaagcttccagtctcttttggtttgagcccaaactattccctcattacatcagcaatcacatcggcccacggtcgttgttgagttgccccttgcgactgttgcttcatgggctcgaactgaccgtatgcaaactgaggttgagccaatccccctaactaatattgggcttgtggggaaggaggctgatattggtaactcaagttacccccttggtaattgtgaaggttcggctggatattgcgcatcaagtgctcaggaacaacttgaggcattactgtgccattcggctatacatggtgaaccaaatgttctgggacaacttgatttaaaaattgttgtacaggctgaccaccaggcgttgcaaacccggccgatgcacttattgacccctggtgctgaatcggctgaacgatttgctatcttaatggcgtctgttaattcggctgcaaaggctgctgccttggtggtgtttgctgaatcggctgcagaggctgctgccttggtggtgtttgctgaactggttgcacgacctgttgttggtttggttgtacaacctgttgaatttggggtgtctgctgaatcggctgttgctgaatcggctgctgctgtattggatcaacaataggttgaggtggcagaaacatggcagcaacctgatcttgggttggccaactcgaaacctgcccgctatgttgtggatgctctctcattaacacccgagggttcatcggctggcccggcgccatagatgatgtagcaggtagaggagttgatgccggcgccgtcggctgagttgtgggtgcaacggagggaaccgcctgaatagatggctgaacatcggtgatcaaagaccgataatttgggaagacacctccttgcaaataaaccgggcctgcagcctgatgttcagctattgaaccatcgctattgacttcatcatgtttgatagggtattgactaacaccccagactgattgatcaaagcatgatgcacagcgtaatcaacccgatcttggaagttattgaaaaagtcctgtgccacatcactattaagatttcctccctgcagcccctgagcaccgtcaacttgaactccattcaccccatcaccttgtactccatggacttcttgagaattttcgccttgatttcctagagagccgtcggtagcacccttgatactcggctgagccgagccgtctagagcttgtttcccatctccatccttagaagaactggtcccaggatcattagcaaccacttttattttgtacttctgaacaagtgtccccttgcgggtctgcatgaatgagttcaagaactgatcccgtgcttgctgcaacattgcttcaaaccgacgccgtaatctggaattcgcagtgtacgattttgtgtatcttcgggtcatgccattacggggcgtacacaagtttcagacaaaagggaagctcgcacctaggtttgtggggccttttcgcatcatcgctcgacgcggagaagttgcttaccagttggagctgcccgcatccttgggcaatgtgcacgatgtgttccacgtgtcgcagctcaagaaatgtcttcgagtgccgtccgagcaggccgattcagagcagattgaagttcgcgaagacttgacctacgtggagaagccagcgaagattctggacacaatggagcgcaggaccaggaattgggtaatccgtttttgcaaggtccaatggagcaaccacgccgaggaagaagctacatgggagcgtgaagacgagctaaaggcagcccatcccgatatcttcgctagttcttccgaatctcggggtcgagattctgtttaagaggggtaggtttgtcacgtcccaaaacgatcttaaaatataccctttaatttatgcctagaataattaaaatcctagtgaaagcctccaaaaattaaaatgtgcaaacttaaaagtcaaataaggcttggaggatttttgtatatttcctcaaagcctaaaatgtgtaaataaattttgtggaattttcagagcacaaataataattatcaagaaataaacaaagttaaaaaggttttataaaaagaaaaaccctaaaaatcctccttccctctcttaggccgaatccggcccatctccctccccctctctctcctctccccacggcccactcggcctctccccgcgcacgcgccgctgacgggcgcgcccaccgccaccctcgctgacaggtggggcccacccatcatccccttcctcccgccgcatgcgccgctccctccgcccgcgcctagcgccgccgccgccgccaaatccgccgcgctccgccgcccccgttcaaaattgaatgggggaaatattccctccgattccctctctctttccccccattttcccctctctctctctttatttcggatggaaacccccctaatcccgccggcgccattaatggcggccgggtctcccgcaccggtttccttccccgccggctgccctctctcactcccaagcctatataaaccctccccgcacctcccttgtccatttccgccactcgccgccctttctcccagccggaatcgagctcgcgccgtcgtcctctctctccgccgtcgccgtcgacctccggccgggcctacccgctcgccgggaccgtcccccgcctcggcgtcgtctcctccagcttcgctgcaccgccgccgaccccgtccactgcctcgccgagctcgccgaccgccggaacgccgccgtcccagtcaacccgagccgcgccaccgcctccctccactccgaccgcctcctccgtcgccgccgtcgacccggggtgagccgtggaccgccgcctctttcccccttcccttcccctctcttggccgacgctccgccgtgccaatggccgccgccggcgaccataggggcgcgggcgccgcctcccgccggccgcgccaacgtggccacctccaagtgcgccgtgtggccgccgagtggggcccggccgtcagccgcccgtgcctccgggtgcggctgacacgtggggcccacggtgccggttggtgagcccgtgggtgcacccggtccaccgtggaccgaggggctgccgcgtggggcccgccactcccgtggacccggcccgcgcgccccctccccccggctcacgcaataaacccttttttttaattaaaatttaaatgaagaaattcgcaaatattcacttaaagagcacataaacttcaaatggccataacttggtcatttgaactcggaattggaccgttcaagtctctaagttttccttaagaagtcaagaacccatttttgtgctttgttcctgcttgttatatggagtttattagagtaaaagcctttttcttcccgttgctcgtgtagacgctgcagcttcggaagatccgctctacgtggatgtcgaagccgacgtttgggaaagcgagcaaggcaagtcacatcatccttgaacatattgaatcccagtttataaaattattttggtttaaattactgcattatcgctttatttaaattcacgcgttatcactgttttatttagccatgcctatttacctttgttatgaccttattatcattgctattgttattatcaccttgcttaccctaggaaaaataaaaccccaactagtgggtactctattcatggttccactagtatgaatttaggtagatgcttcgctgattaattaggcaacattaggtggtttcataaccttagactttaggaatgctcatataatttggacattatggaatggttggactatgtggaaatggacacacacctcccactctattcaaaaccctcaaaatggttttaggctgggctcgaggtgcatggtcttcgggcctctgttgcaaagcactaccgtacttccatatgtctagtgggtaaggcttagtttgtggctcagtctggtcataaacaaaggtacagggatggagatggatgaagtcggggctcgatggacatctctaggacaaatgaaggctacacgagctgcagcccggtagtcgagatgtcatggcacagggccggtgtcctgctgctaggggttcaaccttggttacctgtctcgggaatcccggccgtagccagggttgggtcggtactcttgtttatggctaggatgggttgggaactatgtcacgtcttctgtccatatgccgtggtggtatgtggcgcgtggttacacgtgaggaagacgtgtcttgtgggtaaagatgtacacctctgatcagagtataatctattcgaattgccgtgccctcggttatgggcaagcctagcaatgtacccaagttagtgttttaaattcttaaaacctgcttaacaactaaaatgtggaatggttagcctgggttggcttgggacgagctgggacctgggtctggttgccagttcggtctgaatcttcgtaggccttgggttaaggcaggttcgtgcgggtttacggccttgattaataatattgtgtagctctagcatcatgtttacaaaatggccctgagcaactaaaagtcttttaaatgctatttactgtgaaccctaacctctttattataactcccttgtactcgtttgcatttattctgcatccgtgggtgtgtcttgctgagtactgtggttgtactcaatcttgctcaatttttccccaacctagaagaggagttcctataagatgaaggctttggtgtctagcttgtgcctgccgcaaagtgcctgtggtcgtcgccctagtcttccgctgttttccgtttatcttcgtgtgtgctgggccttcgccgcccatgtaataaattatctatttacgcttccgcttgtaaaactctgaattgtatcaacttttggtgtaccttgcctcccgggacaaggaataatacacgcacgagtagaatgcccgttgggttaattccggtcgtgacatgtcataacaagttttacctgttgttgaagatcgaaaccgatgcagctcaacccgaaagcaagaactcgtcgaaacaaaactaaactaaaaagggtggcgatgcgccgaaattgtattgaacgtgtgtgttaaaagttacatagggcttgggtctatttatacccgagaattacaagataagtccataatgaacacgactattatctctaccaaactctaagataccataagtctttgcggcagacttttacccaaacatatctctaagaaaattacttaaaacatcctaattaatagatacaattgcctcctcaggactctgcccatgtgcggcaatcaccttgaagcacctcaatccaacccaacatcacacatcaagttgtactgccaggatcggctacatcagcttacctagtccgactcaaactcagccgatcttaccgtagccgatctagactctagccgattcctgctctgttttcgaactcgatctccgcctccgacatcgcttcgatctaatcttcttttccgatgccgatattaccaaatttggttgttaacacatggcaaagaaagttgagaacattattacatttgtaaatgaatctcattatgttggttattctagatccacatggtggattgattctggagcaactattcatgcgtgtaattgtttaaagggtttccgttcgacgaggactacgcaaagaagcgaaagctccattagagtcgccaatggagttgaaggcaaaagttgaagctgttggagatcttctcctagagctcgcgaatggcttcacacttttacttcgagttgttttttatgtcccttctttgcaaagaaatttaataagtgtatcgaaattggattttgatggatatgattaccattttggaaatgtcaaatgtgaactatggtataataatgcatgtaatggtcttgctgtgttgcaagacgagctttatttgttatctctttatgagaatgtgaatgttgtgtcctcgttgacaaaagaaaacaagaaaagaaagagaactcctgatgtctcatcgaaattatggcactttcgtttatgccatatttcgagggggagaattgagagactagttaagaatgacattcttcctccattggagttctcagatttagaacaatgcatagaatgcattaaaggaaagtttgtaaagagcatcaaaaagggtgcaaaacgaagcgcaggaattttggaaatcattcacacagatatttgtgatccatttcctgtgaaaagtatggatggctatgactcattcataacattcacacacaattactcccgttatggttatatttatccaattaaagaaagatcagaagcattggataaatttaagatattcaaagctgaggttgaaaatcagcatgatgtaaagattaaaatagtatgatctgaccgtgggggggagtactatggtcggcatacgccttatgggcaagtccctagaccttttgcaaggttcttgcttgtcacgtcctgataaattcatcccaaaataaaaatcattttctaaaaggaataatagaattaattaaaattcgaaaagaaattgacaaacactaaaatacgtgccagaaaaatacgaatgtggtccggagaatttttgttgaattctccttggtctaaaaggagccctcaaattttacttaaattttcagagcaccaaaaatatttattaaacaacaacaacaattatcaaagtttaataaaaagaaaacctaaaaataatcctccttttcctatgggccaagtctagcccaaagtctccctctctcccccccggcccgcggccgaagtccttccctcctccctttctttttccctccccctctctctcctctccccgcggcccactcggcctctctccacgcgcgcgccgctgacgggcgggcccgcccgccaccctcgatgacgggtgggcccacccgtcatccccttcctcctgccgctcccgccgcctcccccgcgccctagcgccgccgccgccgcggattccgccgcatcccgccgtccccgcgtgcaataaagtgggggaaatcattccccgtgattccctctccctttccccccatttttccctctctctctcgtgttcaaacgggcggatttgccaccgcaaatctcgccggcgccattgatggtggccagacctcccgcgccggtttcctcccttccccggccaccctctctcgacccggctctatttaaaccctccccgctcctcctccgtccgtttccgcctctcgccgcccttcgtcctcgccggaatcgagctcgcgccgtcgctctctctctccgccgtcgccgtcgagctccggtccgccgccgtcgtcgccccgggccacctcccacctcggtgccgcctccttcggcttcgccgcatcctcgccgaccgccggaacgccgtcgaccccgtcgacccgagctgcgccgccgccttcctccgctccggccgcctcctccgtcgccgccgtcgccccggggtgagccgtggaccgtcgcctcctttcccctttccctcccctctctcggccgccgctccgccgcgccggtggtcgccggcggcgaccatcggggcgcgggcgcgccgcctcccgccgaccgcgtcggcgtggccgccctcgggagcgccaagtggccgccgcgtggggcccggccgtcagccgcccgcgcccttgggtgcggctgacgcgtggggcccacggcgccggccggtgcaagcccgggtgcacccggtccaccgtggaccgtgagtttgccgcgtgggccccactcccgtggacccggtccgcgcgcccctccccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccattttcgtgctttgttcctgcttgttatatggagtttattagagtaaaagccttttcttttccgttggtcgtgtagacgctgcagcttcgaaagatccgctcttcgtggaggttgaagccgacgtttgggaaagcaagcaaggcaagacacatcatccttgagcatattgaatcccagtttataaaattattttgatttaaattattgcattatcgctttacttaaattcccgcgttatcactgttttatctagccatacctattttcctttgttatgaccttattattgttattgttattattaccttgttcaccctaggataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagtaccccggccaatataaggattaagctcgggcctctgttgcaaagcactaccgtacttccacatgtctagtaggtaaggcttagtttgtggctcagtctggttataaacaaaagtacacggatggagatggacgaagtcgggggtcgatggacatctctaggacaaatgaaggctacacgagctgcggcccggtagtcgagatgtcatgacacagggccggtgtcctgctgctgggggctcagtcctgcctacctgtcccgggggttccgactgtaggtggggttgggtcggtactcttgtttatggctaggatgggttgggaactatgtcacgtcttctgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttaatgttttaattcttaaaatttgcgtaacaactaaaatgtggaatggttggcctgggttggcttgggacgagctaggacccagggtcgggttgctagttcggtctgaatcatcgtaggccttgggttaaggcaggttcgtgagggttcacggccttgattaataacactatgtaactctaggatcgtctttataaaatggctttgggcaactaagtgacttttaaatgctgttttctgcaaaacttaacccctatatcattaccccttgtacccccttgcattaatcatgcatctgccggtgtggcttgctgagtactgtggttgtactcattcttgctcaatctttccccccttcagtaagagaagctttggagaagaggtcttaggtggagtcctggcttataccccagttgagcgcctgtgaagatggagccgtaggcccgctagtccgctgctgtttattttttattgtcaggccttaagtgcctttgtaataatgtaaatattatcgatataataaagatgtgccttttgtatcatgtttgtgtggtgtaccccggcttttcctgggacggggattaatacactagcgttcgggaaaatgcaaaattttctcggtcgcgacattgctagagaatggaatagtagcgcagtattcaacaccgggcgaacctcgacagaatggggtagctgaaaggcgtaaccgtacccttatggatatggtgcgcagcatgatgagctactccactctaccattgggtttatggatagaggcattaaaaaccgccattcatatccttaacagagttccaagcaaatcggtgcccaaacactgtatgagctatggacgggaagagtaccctcgctagctcacctccatgtgtgggggagtcctgcagaggctaaaatatttaacccaaaccttggaaattggatcccaaaatagtcagctgtcattttattcgctatcctgaaagatcaaaaggttatcgtttctattatccaaacaattatacaaagtttgtagaaacgagacacgccgtcttcttggaagacgaaatgattagggggagctcggtagttcgagaaattgatcttgaggagaggcgggtgtttgtacccgctccgtcgactcaggagcctttcttctctctacctgctgctattgtacgtgcaatgcatgacgttgcggtaccagcacctgttgttacccctcctgtggcaacaatgaatgaaagtgaggaaccctttctacaggattcaacagaaattattgccacaccagaggaggagctgcaacagcctcaaacatataatgtgcctgaactggtgttgacgaccaaatttggtaaattatgaaccaggttcgacattgagatcgaggcgaattcgacaaagaagttgatttgaagaacatagtatgcatcggctgcaaaggcatcgactgtagtctgcatcggctgaaatggatcggacaaaggacagccgacacagctgatagaggtgatgcagccgattctgatgatgacggtttcgaagatgtttctagaatcaatcaaggtgcttcatgaagatttccacgacggagatagggctctcggataggcaactgtatctattaattaggatattttatgtaatttccttagagatatgtttgggcaaaagtctgccgcaaagaattatggtatcttagagtttgttagagataaatgtcgtgtccggcaaggacatatcttgtatctcgggtataaatagaacccgaacccatgtaatcaattaacaatcgttcaatacaatctcggcgcatcgccaccctttttactttcgtttatttcgacgagttcttgctttcgagttgagctgcatcgattcgatcttcaactagaggtaaagcttgttatggcggcttgcattatcggggttaatgcttccatcttcatgatactttaaccctgcttatgtaatccgtcgagttatcatatacatgttacaatctaggctagttgcgttatataacttgttatcgactggttcttattgtttgggaacaattggtagagttatattctgttattaatctagattgtatcatgtatctaccatcttttgtagattttcatcatcttgtttagatctcatacttgtctttatgcttaatgttgcatcggttgagttcgatctattaagtaatatttataattatgatatctagcttgttttatgatcatcgagggagatagtatcggggtttcagtcgatcttacctgacttagctttttgttttatatgcttaattgatttgttaggtctgccctttatattaagatcttatcgcaataaagtatattaggcttctgtttgatatattctatttgttttaggatcttaacatagagtggtatcggagtactagctgatacatgctagatctatctgatcggctatgctacaagtgtttataatctttatgttaatgtatacttctatctaagtgatttatactgtctcggcatggcgaccgatctatctcaatcacttggtttaaatatacatcgacagaaggattatatagcattagtatctacagccgatcgagtagatttagtcttatcttacttattcataactatcgatcgatttacatataacatcggctcaaaaataaatgatatgtcattagcgaccggccgatcggctatcgtttatggatttaaccgcggtttttcttgtttttctttctcgttgattgcaggatcaaatcaactagcacgctcacgaacctaaaagcaagattttggacctgcaacaaagttaagcagatcttccaggctagtgtgtgtttttcgcatcaacaacaggaggctcaacaagagcctcaggtacagaatgtgctaaatgaggaggcccctagaaggtctgaaagagtcagaagatcagctatccgtgatgactatgaagttcataatatagaagagtcgcatatggaggatgatcccacctcatatgaagaggccatgagaagcgctcgctcatccgaatggttggaagccatgaaagatgaaatgaagtcaatgaaaataaacgatgtctgggatttagaagaacttcctaaaggaaccaaaatagtaggctgtaaatgggtctacaaaaccaaatatgactccagagggaatacagaaaagtttaaggcgcgacttgtggcaaaaggcttcatgcaaagagaaaggattgattacaatgagacattttctccagtctcttgtaaagattctttcaggattataatggcactggtggcacattatgatttggaaatgtaaaaacgacacttctaaatgtttggaggaaaaagtatacatggcacaaccgaaaggttttgtcgtgaaaggaaacgaaaatataggatgccgttaaagagatccatttatggattaaagcaagcttcgagacaatggtacttgtagtttgatgggacaataaagaaatttgggtttcaagagaatattgaggacaactatatttatacaaagtttaagaatgggagattcattttcctaattctgtatgtagatgacattctactggctagtagtgatgtcagtctattacaggaaacaaagaaattattgtcctcaaactttgacatgaaagacctcgttgaggcttcatatgttttgggcatagagatttaccgagatagaacaaagtatacattgggactttctcaaaaggcatatatagcaaaggtgttgaaaggcatatatagcaaaggtgttgaagaaattcaacatgtacagatgcagtgcgacacttggtcctatggtcaaagggttaaagtatggggcatgacaatgtcccagaaatcagtatgagctccacgaaatgaaaacaaagccataagcgtcagctgtgggaagcgtacagtatgcgcaagtgtgcacacgccctgacttggcatttatcacagggttacttggcagatttcagagtaattcaggcccagagcactggaaattggtaaagaaagttttgcgttatttgcaaggtacaaaaggcctcatgttgtcctacagaagatcagaatcgctctagatagtggggtatttagattccgattttgcaaaagataatacaaagtcaacattgggatacatgttcacctttgcaggaggagctatttcatggaaaagcttcaaacagactatcactgcagggtctactatgtatgccgagtttatagcatgctatgaggccacggggcaggtgaactggctaaaaatgttcgtatccagtttaaaggtggttgacagtattgagaaaccactaaagttatactgcgataatgaacccgcagtaatatacgctcacaacaatcagtcaagtggtgctgccaaacacattgacatgaagtactatgttgtgaaggataaagtccgagatcaaacaatcaatctcgagcacattagaacaaaaaggatggtcgtggatccgctcacgaaaggcctaccacccaacgtgtccaaggaacatgtagccggcataggtttaagggaagccttatgaatcctagacccaaaagttaaagtatctgtttctgaatagagatgtgtatagtggctgtcaaatccgtcggcgattaaccgtgacgatgaaacatgttctatgtgcaaatctgtgatggaatagaaaaatgctaaaagaaatagtgagatcaatggggagaatgttagatagatctcttccccattgggcccaacagcacaacggggaccttgaccgcactatgattgggggcgcccagcccattggctggtgggcccccatcaccctgcgccacataaatagagggtggaggctagggcggcacacgatacgaggttcgtcgccgccgccaactccacccacaaaaaccctaaccgatcgagggggcgcagctagtgacgggaaaaccatcaccgccgcgccacgccttgccgtgaccgcctacgatcgacgttgccacgaccaccgtcgccgtcatgaccaccgtcgccgctgtctacgtcaagcgcacgacgacaacgatgatggccggcatttcctcctcctcctccaacgcgtcaaccggtgacatcccttaaccctctctgttcctctctgttcatccatccaaatcgtgcaacccgactagatctatggctaggtgaactcactaacaggttttagcgttttcggatctatatagtgccgttcttttttacgcatttatgtagcagtgctaggtaacattccgtcaacatgacccctgtttggttgaggactttaatcatcagtgcttattttatttttcagcgcaaaacgatttcataatcttcggacacgtaatcgaccgggaagtaattttagcgcggatctcacggtgaagaaataatctgcgagaaaagcgcccccagcaaatccatttccattcgtaaaatatatttagagaggcctttcgtttttgtcgtaaccagcgacgcctaaatatggagaaaacgtggagtctactacatcgtactacatgcatgcatgccctttttcctcttcaaacaaagttttctctcaaattacttatccaatatacaatccgattacaccatgtgttcgttacaattaaatcttcacaacaacaagatcttacatgattatattataacgaaaaatatttatatttgtaaattacttttatcatatatatatatacatatatatatatatatataaaagttacttttagatttaactaaattacgtcttagacatttaaaagtaaattcaataaagtctaaaagtaatttgcatctctactattataaaaattgaagatgtttttgtcggtattttggtacgtcatccgtgtatgagtcgattttcaagttcttttggaaatacatattcatatttgagttagtttttaagttcgttcgcttttgagaagtagtcatattagaaatctcttaaaaaaaactcacatgctaacttaatacgatcagactccttattgttactcataattttctaaagaaaaaatatatatccaagcgaattctcacagtgaattttatcttaactaaattgtataacaacatggttaaaatagccttcacccgttgtaacgcacggacatttttttctagtattaaaacaaaacggaagtaactttgtcacaacattagaagtaaattcgttgtaggaataaaaatatgacttcacgtccaatgaaaaaaggcattcattaaagttactttctttttgttataagttacttctataatatatgtaaattacttttacgctttattgaatttacttttatatgtctaagaagtaatttaatgaaatctaaaagtaatttagatatattataaaagcaatttatattttttatcaaaatataatcatgtaagatcttgttataaagatttaattgttacgaacataacggtacaatcagatcgtagatcggatgagtagtttaagagaaaattgtatttaaagtataggtagatagtgttttctagagtaaccaactggcactagctatgttacatccatttccattatgtaccttgtaccgaatgtctgtctccccgtcctccatggctgtagctgcacagttgattatactgtacatcaatataattcccacataacacgacttggcgtaaaacatttgattcttttcgtgacgtttcacgtgtcgatcagcagttgcccaacatcaacactgctattaattcccgcccggcccagccaaacaacgtagtaactgcttcgcccagctcgagtcgtagcaccaaaagaagcaagcacgcctagctcgttatcgatcatggcggccacgtcgccactgccacggtgggcgccgacgccaagtccgtcgcggccgctctggcgctggggctggggcggcggcgccacgccggacgcccgggcggacggaggtgtcaccggttggacctcgtcgttcttcgccgccgtcttcccgtggacgaggagacgacgtgtcgatgacagatgggcgccgtcggccggcggcggagtggggacgttcgacggcgtcgaggtgccgctgccggcggcgcaggcagtttcgcttccacgggcggcagcggacgtcgtcgacgaccccgcggtgttcctgacgtgggaggacgtgcgcgtgacggtgcccggccgcactcgcggctcgccgccggcgaggatcctcgacgggatcaccgggcacgcgcggccgggggaggttctggcgatcatggggccgtcggggtgcgggaagacgacgcttcttgacactctcgcaggttcgttttcgggctcatcactgttacacgtgcatactgtgataccgttaaataaagtagtattagtagttgtgtatttgaggctttcttcttcttttttttattttgaaattgaagtggagaattatcgggggaagcacgagtagcgtgatgatggagtcccattatgatttcaatcttgtagccaacgaatattatacatatgtaggtgggcttttaacatgatttaatttattgtgatcaagatatatcactagttttcatctctgagagtgtgttagcggacatattcataggggtatgattgtgatattacgtctgtagtggtgcgtgcatatgcgtctgttggataatctcaagaaaataatatagagaaatataacaaacttttaacattaaccaacctatcaaaattttatttgtgaaactaaattgttttcttgggacaatgaatagggtattgatttccttgggttttttttttttgcaccagtaatttcctccattgattttttgagactttcatgcgaatcaatgggcatggcatctattcctacgtattgttgcgtttctctgttttcaaaaatcttgtgttcaagggaagccttaatttgtccccaaatagaatcaaccttcaaaatattgtgtgattaacgaagacaattctctcccaacaaaacattttgtttcaaagtccaagtacatataaaaatttaagatgcgcaatttatatttatatttatgtctatctttacggaatgatatatattttgctatctccccatccttttcatgtttgtaaaaataaaacctctgggtatcgttttaaattataccatgaggataatcctcaggcacgttaattagaaaatatcaaataggtgatgcactagctatgttggttcatgtacatagaacggacgcattttccgtctttcctgagctataggggagccaaagttaagaacaggcaaatatgatacatacccactcacacgtgcatatttttcaaagtcgaatggaaacaattttagataagaatggtagaaccgacccaaatctacaactctatacttgataatcttttcatctaaggtcatttacatgttcgaatattcatttcaagatctatttgaattattggattttaaatattttcaaataccttcatgcagagacaaactcttctatgaaattctcaacgagatctacagaaataattttaatttttttctattgcctaaaaatttaaaaatatagcagtaccgttttatgtgtataacaataagggttaattggattcataccattgcaaatttgctcaattaaaaaagtagcactatatatatttatgatatacattacgtggcactaaaatattataaaattagaagcaagccattaccctcaagaattgtgtcctgttcttacccaaacctattcttttgtgttcatcctctctcttgttcatcttctatctcgatcggtagagccggcgatgcgtgcctgcgaggtggcggtggtggatggatgggatctgccaaaaatgacgatggatcgagacatcgccactaccacgacgagcttgtcattgccgcgaatttgctcgcacgcgactgctgctcgctgttgtcatgactgctgcatcatggactcttgtcctttgccgggattgaggaggcggccatctcccagtcccactccctttgcgtatggatctggccaaggggaaactggtggcttgctgcacctctggatctggtgggagggggtcagaagcattgggagagaggaggaaattaaagctctgaccacagtcgtctaatcgctgctgccgagtgtgctgccgctgctgcggggaggaggggtcgccatcgctgaggggtcaccgtcgctgccgcggggagaagagtcgccaattcgccattgccgctagcaggaaggggtcgtcggcgtctcaagagcggaggaaaagcctcggcctaatcgagctaagaggatgaacaagcgagctgggtcgatgaaagtcatatatgcagaattccattcaccaaaatttaaaacaagtatagtgtctgtctacttgttttgaattggtgttataatcactatgcccaaatgagacaaattcaaccgcgggtgtggttggggttcaattatttaggtgccgaactggtcgagggagaggtttgcgtgcacactactaagaccataattgtgaactggagtacaactaattgagtgcacacgcatccactgtacttagctgtagggtatagttcaacagtataggaaattagatctccctagttgtaatacatcgtatttggtcccgttcgagtgagctgattgatggctgatgggctggaatacatgcatgtaacagtaaacataaagataaaatgcaaagactctattcggtttgcaaactggttacgccgttgtatatatacatgtaattaaatcactaaatctttataataagatattagataattatattttgataaaataaatatctattttaacttctaaaatctgatgtgttatgtatgagaataaaaaatttcaactagtattttgttgtgttttactcccttctttccaaattgatcatcatatatgtttatgcatcaataccaaggataatttaaatcacatcaatcaagacaccatacacacattctctcagaatgcatgcatcgattaaaacaccatacaaattacatcttagcatgcacatattcttgcacaatgcattaattgtattctgataaaatccgtatccatacggttatatgatgatcaatttaagaaattttgaataccattatatgctaatcaatttaggaaggagggaatacatttcacctaaatgttctaatgactaatttttttacaacatataacttggatttgctcatggtaaaatgtaataaaatatttggaccgcctaatttttagcatggtcggatgcccgattcttagtttagccacaaaatttatttgctaagggggtgataatgctaattttggttaaaatattaagctagatgggaggggtgctaaggccatccccaaccctccatctcatctagtgtccatagcattgaatacattgtaacataagcaaaaatatgatgtggcaagagagttaatgagcaaagaggtaaaaagatgaagaaaccatttctcatgcaagaaaccatctctacacaataatcaagaataaaaataatgggataggtggataaaaggagagagaagaaagatgattggatggtaatttaatttgaaaacaccatccattggatgtatagtttctacacatagtgtctatatgacatgacaagtatgaaaactactcgatagattctgggttaggggtgacctaatcaatttaggaaggagggaaaacatttcacccaaatgttttaatgactaatttttttacaacatataacttgaatttgctgatggtaaaatgtaataaaatatttggactgcctgatttttagcaaggtcggatgcccaattcttactttagccacaaaatttatttgctaagggggtgataatgctaattttggttaaaatattaagctagatgggagggaggctaagccctctcctcccctcgtcttaggaactgctttaatgttgtaaataaaaatatttctgaagtgttctcgtacaaagttttagttatatagtagtttaattatagatggaccttttatacttgatctcctgtaaattaacatatgtcagatatacgaattcatatagttggtaacttgatgtatatagtagtaataactatcgtgttggcctaagtacatagtaataataataataaagtaatagttcacaaatgacaagtgatgatgggctgtatcagattaatttgtggagttaatattcggatagaataatccatgttcgttgcctacaatcttacctataacttttgatgcttttcactagtaacaattactatattctaaaactcaagatataaatatgtcacatcattacccactagctagtgcatcttaaatctcctgaaaaataacccgctatatacaatttattatattctaaagctcaaaatacaagtcactacttcaaaacaacggataggtgccggtggagaaatctgtcacctaaagccggttcccaaccaacacctatcctcttctttgttgtagtagtgacttattccctaccagcacccaacaagcggcatctttgaggagagctaaaaggtgccgattcaggaacctgcacctctttacccaaccaaattccatagaacatttaattcatagaatgaacatttaatccaagaagaccaaacactaagaacacaaagaatgggccgatgtcgaggagcggagggtgccacgcctgtcgccacctccctcccaccggatctggtagagggggcactgtatgtagcggaggggagtgcgtagccaccgtcgcttgggtagctcgctgcctcccctcccgtcgaatccggtggaggagatagcgtcgccactaggtggggatggtcgcctccgcagctggatgggcggagtcgcacgtgagaagagagagaagtatgcaagaggaagattgagagagaaaggcgtgtaagaaagggacaccggggagagggaccatgtcctgctcttcttatcagctcgagcgaataaggacgagtggtcggctcggctcgatttttcgtacgctggtttctaaaaaaactggtatctataatatattattgatgtcggctttttaattcactagcacctataataaaataaagatgtcagtttttttttaaaaaaaaagagatcatgttggttttttatagaactgacacatataaccgtttaaaggtaccaattttttattagcccatggaggtgggaaaaatactataagtgccagttttagctattccactatctatagtgtcaatctatttatgtgcctttcgatagtagcgagtatgtcgaaacatcaccccaaacatcactttcttaatattgcaacatatatccatatctagcatttctataatatataatattcatgtaaagtgcccgatatcacatagttttgtacaataattattactacatactagtgcacgctatctatgaaatgtgggtccagtattattatagtaaaggttaatgtttgcagcgtcattattgcaaatctcccctttcaaagagatctagtactaatatttttgatccgtacatgccgtctaacaaacattaattggccaagttggggtaagattattcatgcaaactaatgctattggtattgagtaatacatacagttcattcttaactaatcgatctcataatttgttgatctaattaacccatatcaagtttgagttgatggtaacatcaacaggataagcagcgcgcctaatcgggtaacaaaaaaatcattgcgtaattgttttataaccacagcctgctggtttgaccgcaaggtaaatcaaaaacttaaactaatactaactctctataaccttggactcgcggaaaaataatgaataataatggtcgcaatccaaggcgctggagctggacacatgcatacgcctactgctgctttgcccttctgacgctaactagaaaattaattaagtcattgattattagttaactaattaattaaaagcaatcaatcgaagattcttctggctgcctatcattaagacgtacagagaaagtatgtattgtgttacagtggcttgttgctacaatatattgtctccgttctattaaaaaataaataaaagatatgacgcattttaatagaatctaggcagcagagttgcattcagatttatattactaagatatgttacatcatgtattaaattattactaagatatattacatcatgtattaaatttgttttctatgagatgaaaagagtatttgtcaataacgtaatcatatcatcagtaatatacaaatgaagtaaatgctaaaaaaaagacataaactagaggtgtactgtgaactagtgggtgcatagtgatcagtccaaatcaagattaaatcctgatggccacaattacaattttttttatctagagaagaatattttttacccggtttttacatccaataggatatatacatctatttttaaattagaaacttagcctatcaaatagagaatttagccctcaaataacccaatctaaaattcgcaattacatacgtgtggatatgttttcaaaacaattttactgaggtttgaggatttaattttagtgaggtttaaggttttgaagacttcttttagtattcaaggataattgggccatcattaatttatcgaagaaattaaatataacagtataaggccatttccaacccaaaacattagacatagtttctataaactccacatcaataagaaactagtttaatgctacttatctcacatgatattttggatgttgtgtataaaccatgtctcatgcaagacatggttttcttctttttcacatttatttacttgccacctcattttctattctagatgatagcttatttaatactatggtagatattattctagtcattgtgttgggaatggcctaatgttgacctaggtgggcagtcaaggaattagtttgtcgttacactcacgccgctaacgctgtgcctatgtaggccctgttcagggtgtctttagttcatgctaaaattagaagtttggttgaaattggaacgatgtgatgaaaaagttggaagtttgtgtgtgtaggaaagtttcgatgtgatggaaaagttggaagtttgaagaaaaagtttggaactaaactcggccttagattccaactttttttttaaaattctaacttt

SEQ ID NO: 8096 - DNA, 7828 bp, Oryza sativa
aaactttccacgcacgcaaacttccaacttattcatcgtatcatttcaatttcttcaaactttcaattcaattctaatgtggaactaaacacagacaacttctcgtttccaacgcgcttcaggtataagtacgaaacagtgccttgatgcaatcgcttcaggtggaggacaccgcactgattcgtggtccaaagcccagaaacgtacacccgaacagaaacgatactctcaccggtcaaaagggaaagaatacctaatatcgtttctttgttttaaaagaaaacaatcatcaatttctcttaaaatattatatattacatataggagcttcagttcctaagatgtcataagatacttccttgatttcatcatatcaaatcaattacagaagcaatagacaaattacaaaatatttttcaggacattcttgttcgtttggtgaggttgggaactcacctccagtatacacaaaacagagtatctcattagcgcattattaattaagtatttgctagttttttaaaaataataaattaatatgatttttaaaacaactttaaaactcacatttatcagtttgaaaaacgtgcacgcaaaaaacgagggtggtgaattgagaactctgtcaaaagaaaatagaggtttgcctgtttaaattagcggacataaagataatggataatccaaccgatgaggctcttaaggatgagattaaccgatccttagtccattcttttgttgtttcgttcacttcgaccactcgaaatgttcttacagtatactttactgatcgtacaaagacaatggatcaaattttatgatgaatataaatatgtagataacaaaccccttcaaaaaaaaacatttcaaaacttcatttatctattatatactaaaagtccattaaactttctagaaacgctcttaagtcgtcacgtgacattcctataaatactcataagccgtcacatggcactgtttaatctcaccgtcaattttcacttaaattggtggacccattattttacaccattagattagatctactattaaaaaattaataaattcctcctacttatatgatacacagagtataactgttctctggtacatacgtaccaacgattgaaagcaattacctgctgttcacaaaaagaatcatacaaaaacttagataaaaaaagacagtcaaaaatacatgcatccataaaaatagatggtcaacagaagtacgtaggtgagagagagaggacaggaagagactaaattctttattcaatctaatctaatgatttaaatactaaacgcatcgatttaaatgaaaatccagggctatgttttttttaaaactatctacttatgtatatatctattatatactaaaagtccattaaattttctacaaacacttctgaatcgtcatatgtcactcctacaaacgcttctaggatgtcactcggcgctttaataaatcaaagaaaataataaatattctaaaaatacaaaatctaaccatcgattttcctcgattttcctttcaataaggtggacccatcatgcattctctactgttagattcatcttaataaaaaaaataagacagggaaaagacccatatttttgtaaggtggactcggacggtctattatgctataccgcgcgtccggttatgagtcggtttggctgcggcggcaagtttatcgctaattaacttatctctgtatatacgtagcacaagctgattagctcccatattgtgttaccactaactcatagctatatttattatatatacggcaatatatataaatggaagctaggagattaacactaagattatacatatatatagctaattaaattagttatacatgatttgtgaaaggagattaacggcaatataacatagctaattaaatcagtttgcatgatttgcggcaacattacatagctaatttgaaccaatgcatttggcagtctcttgataaattgtccagcttacatcggtgtatctaagatctgatctgttttaagtcatcgtgatgtctttaaaattaaaaaagattttttaaaaaacaaaatacatgataatcggttttaacttaaatcgtttagaaaaattagaaaaacaaagtcccctccacctcaccctcaccatcacatacgcacaacgctttccgttccctccacttttaggcttgggttctccgctctcctcttctctctgtatcttttggagtaacaatgataaaagagaaacaaccaataatatcgaaacatccatagttatattaagctacatgtctcatatctattctaattattgatctatacataattaaaccaataaattaagattcataataactggtataaaatagaaaaaaaattgtcaataggggataaattgaaccaattatagaacatctaacaaatttgtaaagaaatggtttttaattttcacttaaactgaaacagccgttgccatatcaattaaattggccttccctctatctacgatgccatggcattatgatggcattatgagttacttcatgtattattatatatgtaattcacactaaaatagcaatatctaattggttaaaagtaatatttgttagtattagatttaaaatttaagactcatattgactaggtatatttaaaaagctctataggtcacacgtatcatagggaagcaagttctagattatgtatatctccttcgcatttattgatcatataaagtatgtgtaacaaattacgtcaatatgaacaaattagagaaagggctagcttgatagtacaaataaacatatttattagcaataattgttttttaagatttgtaaaacaaggctctaaacattcaattaaaaaagaaaaacaccttactttttatccaaacttaatttattagaaatgtatggtaaacaaacaaactaattaagtctaccttatttttaaataactaggaaggctgtaaatatttagttgtatagatgaattaagtactattatatatagtataaagctaacaaatagcttagaaaatttatttgagcaataccaaaacgataaagaaatttgtgaggaaaacgaacttatgaagcatggtatatgccatccgtttgatattccacccatataaattcatcaaaacataatcatgatacatgcccgcgcatacgcgcgggctatcttcctgtttataaaaaaattgtgtaattactactcccttcgtttcatattacaattcctttgacttttttcttattcaaactttgttatgtttgaccaaatttgttaaaaaaataaagcaacattttcaatacaaaacaaacatattatcataatatattaaatattagtttaatggaactaatttggtattatattttttttaaattttttttatgaacttaatcaaacttagatatgtttgactagcaaaatatcataacaacttattatataaaatggatgcatagtatttttttcactttcacctgagtgcacaccatgtacgttagtactccctccttcaaatagtctaggtcctttttttttgcaccaagaccaaggtatagttaactcattcatcttatgacaaaactaataaacatgcaaccaataagtattaaaatgatttcttcggttccgatcaaaagtttaatatagcatataataactacaaataggacttagacttttagaaaaaattaaagaataaaataggacttagacttttggaaggagtgagtactagagggaagtgggcagctacaaattttagggtaaaacctattttttgccctcaactttgctcaaagtccattcgtcatcctgaattacagaaacggttatttctcactttcaactttttaaaaccatatacttgggtctaaaacatatggatttctgatcgatgtactagagctagtggtttttttttctcacataaacttaatttagggaagtttcgtaattgtgggcctacttaggtgacatctacatggacaatgagtgcaatgtcaatatgaactaggaaaggcaattccattgcaagcaaaatcaataaaaatattatcatagtatttttcttgtctagtttaaaaaatggagggtgggggtaaaaaaaaccggttttatagtttaaggtaaaaatagactttgagcaaatttcaaagattaagagcttgtttggaatggaagacaaaacgtaagaacacaaagtacacgaatgcagccgtataacagaaaatgtaaaaaattaacacaatcgatagataattggggtttgagatgaaggaatttcgtctcatctcattcttcaacatagcaaaagtaaatattgacttttactggacatttattttccgacattattggtgcaaaagtaaatggtgcaagaaattcttcctcggttttgcctcctcctgttactgtacattgttccaaacagagagacagtgacttttcatatgattttaattcgcttcgactaaccctcgcttaaaaataaattttaccctaaaatttactattgatcttcgacgatcctttctgtagtatcttgtcgataaatatccaagaataaaccctctattggactgctggatatttgcgcctggtgattagtttagatgaaataatatcataaaaaacatttatctaaaaaaaatatcataaagaacattttttatgatattatttcatgttagacataatgttgccaagtgtagcttttattcagcattttttttccattttttcatgctgaaacaagatggcagcagacaatataaatcatatatattgttcatggatgcaagattataatgcttagtaaatttatactattcgtctccatactcttctccatctctcgttttaaccattgatgaatttatggcactgcaggacggttaggacaagaaatgaatcaaaccggtgtgattttaataaatggccggcaggaaaagcttgccttcggaacctcggtaagaaatcattatatcagctgtcactcacaattgtattttccaaccatttatctcgggaaaggtcaaggttaattactagccatgcttttaatttgctgccttttatgcactttgttgtaattgcatactacactgacaaaatatctactgtaataatcaattagctaataattatatacaataatacatgaattaataatgaaactcttaacaaagaatattttttaagcttcacaggaggtgaggcttgtctctcgtctctgtttttttttctgtgaggaattttatttcaccgcattatcatgccaaactgatcagcccatatagatgtgtacatgaagtgcacagcccaaaaaatattaattctttactgtcagctaaaaaaataattataattcttgtgtaggcatatgtaacccaagacaacgtgctcatgtcgactctatcggtgagagaagccgtctactactcggctcacctgcagctacctgacacgatgctggcgtcagagaagcgcgcccacgcggagcgtgtaatccgggagatggggcttagcgacaccatggacacgcgcatcggcggccgtatcaccaagggcatcagcggcgggcagcggaagcggatgagcatctgcattgagatgctgacacggccgcggctgcttttcctcgacgagcccaccagcgggctggatagcgccgcctcctaccacgtcatgagccacatcacccgggtcgctgccagggaagggatgactgtcattgccgctgtgcaccagcccagtggcgacgtctttgacctcttccatggtctcttattgctagcctatgggaggatggtattctttgggacagtttctaatgctactgaggtaattaattgacactctttttgtatgctatctattttcactggaattttgacttttgattaaaattttattcacaaagattttagattttaggtactacttttccatccaaccacccctcatttaattttcacccgattttacacataaacacgctccactcattaactacccctcatttaatgatggacattatagtcttttccttttattcttaatctcttcaaaagaaactagaatccgttgtattcgtaaataagaaaacatatgcatttagcaaagttggacttcgatcagtgtccgaaatgtattttccattcagtgcgactagagggagaatatgtcagcctaacaactatgtttgtaactaataaccacaatctctttaattgctcttgaaattgcacatctatattcatctatttcagttttttacccaaagtggttttccatgcccacacctgaggaacccatccgaccacttcctgagaacaatcaacaaggactttgatgaggtataggtgttttattatcatattttgacaaccatgttgtaataacattcttttctgccaggactgttggaagtatatttatttacttagcattacaatgtatgtagggaactatggaaagctccaaggctaacagaaaaacagcagctgaagcaacaaatattctaacaaatgcataccactccacttattcagagaaaacagccaatgagatagttgagatgaaagggatggtatgttacgattattaattagttgaattttctttaagatatacttcctttgtttcacattataaaatgttttgggttttcaatagattcatgcatggatccatatgtctttatatatgtgtccaaattcatatatatggatatgttagtaaatctagatgagagaagaagaggacaaaacgtcttgtaatgtggaacggagatagcatgctgacggagcgtggggctcctcaccgggagaccgcgcaggcccccctttgccggttcggccgggggcgctaagtgaggttcttcaccctcgatctgtggaatgttcgcgagagagcaaatgcacgagacacgggcgatgtagacaggttcgggccgctgagaagcgtaataccctactcctgtgttctggtggatctatgtgtgaaggagttacagagagccggagagcaagagagttcaggctctagaacccctcttcctctttctcttctctacgagctcaggtattctcagagtcgtctgagagtccccccttccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgccgtcactcgcctgacacaggggataaccctgtcattccttcattatgggtggagatttgcaatggccgctgtccgaataaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcatgccgcacgtctgcccttcttcatacaatgacttccttgccatggttgcgatgaagcctggaatgaatctggccgggactgacataccaactccaggagttagcacgccggctccggccagggacgagtgcctggaggctctcatcattccgacgggacggggcgaggcgtgtgacaggccggggcgaggcgtgtgacaggcctcctgttgcccctaacccgcgatctgacaggtctgtgaccggtcacacactgcgaccggtcacggaccggataatcgtgcgctg

SEQ ID NO: 8097 - DNA, 6700 bp, Oryza sativa
  unsure (1)..(6700): unsure at all n locations
ccccctcggggagacagagggagggatggccacatcatcctcgggcccgacccccccgagggggtcaggccacgtgggtgaccgcggctacccaagcctctagtcacgataccctcggccccatgtcaccgacacatgctcttagttttgttcacagggcactctgtaatcacagataaaactctatggacggatatgtggtatatatataaagaaattatgaataaataaaaaatttaattgttactcagcattctatgaatttttatagaccaattcttacaaccatccagttttcatttcaatgaacatgcagtccttcaccattgcattttgttactgtttatatttgatcatgtcccctgcctttgccaacctactatatgaaagtttgctttctccaaaaagtcattcttttaactgctatcaataaatatgtgttttgctttattttcaatttgacaatacttttctactaaatactgtttttttatcgaagtcacttcatcattgtttcaaatagtaaaaccgctaaatctatattatagtttttttttctttttttgcgtatgctcacggtaatcgttcgtttcgatagagctactaaaagtacatcatagaagtttgaaacataattagttgttaaattattatgtttgcattgatgcttcatggcctcatagatatatatttgcttttgtattatgtgttaacagggtggaactccatttagaaggaaagagcaagccagcttcttgacaaagctccttgtgctaacaagaagatccttcctaaatatgcacagggacataggctactactggatgcgtttgggcatttatttgggcattggcatttgcctcggcaccatcttctaccaagttggttacagctacagttctatccaggtgagttgggtaataaatattcattagaaatatatggttttacctagggaaacatataatccgtgttatgtacagttgtattgatatacttgctcaaatgtttcagagtagatgtgaagtaataatgtatacaaccgcgcttgtaactttcatggcaattggaggattcccttctttcgtagaggacataaaggtaatgttctatcctgatgtaaactggaattttctgcaacattgtttcccttagaactattatattttcaaatcccactaattattttctcttgtagaattgaattctcagtgttacagttatctgatttatatttgggaaaactaaatgtaaagcactcgtccagatgtctctatatatgttaatatttatatttagaagaaacaatatgagtgacatcttacacttgtgttttaaaatacaaaggaactggatttacaatttattagaagaaaacagtatagtgatacttttcaataacaggaaatgtttcttcttgtactaataaaacaaaacagtattttattttccttattcaaaaaataacatctttgttcaaacaagaagtcaaacagatataaatgttttccttcttccgctgtaataacgcataaatcataccataactcctgagaacattttttggaaatcagttattcagaagggagagattgagcggccattacggagtcatggaatttgtaatctcaaacaccctctcagccaccccttaccttgccgtcatcgctgtgatccccggagcaatgatgtattacctcacagggctgacccgaggtgcggaacacttcgcatacttcgtcgccacactctgcatgtgcacgctgctggtagagagcatgatgatgatcatcgcagtcatcgtcccagacttcctcatgggaatcatcatcggtgccgggatacagggcatgatgatgctcaatggtggcttcttccgcctcccgaacgagctcccgaagccggtgtggaagtacccttgctactacatctccttccacaagtatgcggtgcaggggttttacaagaatgagttcatagggctgtcttttccaagtgatcagctcatcgaggccaatgccactatcagtggtcttcaggttctcaaggaaaggctgcaagtggagatgggctattcaaagtgggtaaaccttgctatcctgtttgggatgatggtgacatacaggatgatattcttcgttattgtcaagattgcagaggagctcaggctaaaactgagagggattagatttagacggcttaaatagtcgtcttctctcttggaaaacccggccaggaggaagggatcattaaacacaaataaaatttgaagtacagaatgtactacagtagtgtggacttatgtcatttgagcttgataattcctaacgggtattttctggcattttagtcctttgccaatggaacaaaattgtaaaggattttttaaggtaaaccaagttatcgtgaacggttcgttgcacagtgttaaagggctaacattgctcctatcgcatcggtggtaagatgtcatttcttcatatttcaattttcttaatgccaagtattgcattccaaaaatgaatatatggagcaataatgcctaatgtaagcaccgacatattttaatgttcttcctgaaaagtgacagcaagagtgaaatgtgaagaaataatgaatatttatacagtgatgtatttacaaacggcctggtttgaaacttttcttctgggagagaaaaagtttgggacaaatccatatgaaaggattctatagataaaacaaaataaatggtagtagaacgcattgctgtttgagatgtgtacacctttaagaaataagatatatacaaaatacaattctccacctcagatcctgttatctcctccattctgtggatatatagaattgtcagaattcttctcttaatctgcatctatggctgctgtcactaacatcactatatgcaagatatataagctatgtttctgcaatattagctcctattataacaagttataaagaaacactagctattgtttgcaactacaatgtgataatgcatattggtgttgtcttgaaaaaagttctgcaaaactaaaggtactgataaattaaggtgttcgattggtgtaaatttaacaagtaggtttccgctgtaagttgttcattcttgtcgcaggagtgcgaatttctttataagtttgttccaaaaaccttccgttccacctataagatggatgtttacccctaattcattagaatcggttcttctagccggttttgatttgtaaacccatcttgttcaggagtttctagatatcaaggtggttggtgattctgtaacaccaaagcttgtcaaggttaaaaatgttgatgactccgtaaaatcataaaacttcaggtgaccgactgtgatagtgcctaaaaaaggagtcaactgacatatatggcacctcctttggccagatctggacagggatgaaggcacgaattgaaagtatagggaggcgagatgaagatatcctagagcacactagatggtaggccagtggagaactcatagacagaccaataatgggcacaataaggaagcaccatgtcgaccagttcgactcccctgcctccttttccttgtacccattattggtataaaccccatgggtagatgttgacagtggttccctgttccacgaggtatctagctatgagccgatggtacgtagtgttgttggaaatcaaagaatggcggtgcagccgttaggtggtgatagtctctagagccatgaatcttaagcggcaaaacttcaagtgggtgttcaacaaaggcttcaggaccggaggtgatatagatcatcgaggtggcagcgtaagtggttttatggggagtatgaggtcttttttctttattcattttcatttttacaccctaggagcactatcactgtcgtttcctggaccggcagtaatagtctgggggaacttttatggtacattctactactagtatatactagcagtatatttgatccaacggtgtaaattcatctaattttcctcctaactatcctgcagtataaattgaattgggtaaatttgtcttttatctttttgcatgggggtatttttgtaaattcatgctatctcacttagtcagatccgtttgcccggcaccagtcgaaaccgaagccgctcggcttgcaaccaccgccgctggtttctttggcgccgcccctgccaccgtcagccacaatcggcgccgccgccatcggaaatcgattcgatttccctccttttctctcgtgtctttccgtccacccaaaaccccatttttttccaaaaaatcccccaaatcggcgccggatgctgggtctacgggagggcgctggccggcagaccaggcgaaggtgcagaagggcgccagggagggagcaagatgggcccagcctccgtcgccggtgtcgccagatgtaacgagaagaagcggatgacgaattgacgatatccagggaaaaaaatccacgggaaagctaatccctatttgtgataaaaaaacaatctctattttaaatgactaaacaacccttttcagaattttaacaaataccaaatctacccttttatatactgttagtatatactagcagtagtatatactgttagtatatactagcagtagaatgtaccgtaaaagttctctagtctggaggcatcattgcctatgtttcactgccaattttggcagtctggaattgtggcaatgataaacgcttttgtactagtgtgttgcattatgtaaaacaaaataaaatgagatgattcattttttactcatgtgataagccccaaagaattagacaagatgtggtaaaattcctttttttgtcctcgaaaacaacatatttgatttcctggccaatttgtcctcgacatttttttatttgtattaatgtagaccatcatgaattatctagtgaaagtaacaataatcattaaggatatctttcctctccatatgtgaacaatgtaacaatgtaataatttgaacaatactgtataaaaaataaagagtaaattgcattggcggtacacaaacttgttaaatgggtacaatttagtgcataaacttgtaaaatgctcgtttcagtacacaaacttttctagttcgtgcgaacaaggaccaaaataacttggcaatattaattttacaaagctgatgttgattagaaattgtgacgtgcatacatgtagtgagtatgcataagaaaagcaatatttaaaaatttggtctctactttatgcttcatcatggaaatgatgaattccatatatcctgattggatttttttatcactgattggatttttttaatctttttctactattactatatcctattctatttttttattgaagatgtgtatgtctaatagcaaccttctttgatatatgtctacatagcatcctaatcaacttctaaatcaataagattagccatgcagtgtccttttcgccttcccccgcatgcactagacaagttcatgcaccaaaacaagcattttacaagtttgtgcactaaattgcacccacctgacaagttcgtgtaccggcaatgcaatttactcaagaataaaagtaattgtcagggatatcacagattctttaaagtttttttaatacaaatataacaatgtaacggcctaaaggcatcatcaatgatgagatacacaataatcataaaattggacccacatgcatacatctttttacctataggtaatactataatgtttaagatttttctcttgaccttaagcttgatccttttagtatgaaggattcaaaccaagatacattaaaaaggcataagatataaaataattttatattcttatggctagatctaaggtgagcgttcggtttcctcggatgttgcggttcgttttcttcggttttttagaaattcggttctagacaaatctaagccgaagagtttgtaacaaaacaataaaccgcgcccaaaaaaccaaacttattcggtttggtttggttcggttcgtcggtttaccgagtaagccgaaaaaaaggtacgtacctgttctgccatgccgcaggctgaagtcctgcaagcagcgtagcaacatattgggccacggtggtagtcggatgggctggattggctatgggccgtacgggttttaatgagaaatggatgctattaatggacttttccattggtcaaaggcttagacaatgctgttttcacgtaggggaatgggatcttagagattgatcggtttgtacggatgggtggattcttcagttgttggagatgagaaaccgatggagaagccgaagaccgatctactggagaaataaaactgaaggaggaaccgactatcgaaaaaaccaagagttcggttcggttcggccttcggttttcggtgattttatgcccacccctagctagatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8098 - DNA, 933 bp, Oryza sativa
atcgatccatccaaaacggacggccgagatcgagcggtccacggcggctcacagcagacagaccctgatgacgtcagcggtgacgtcatctccggcggcggctcggcggctcgggcgcgcaagctcgccggcgaacgacggcgcttcggcacgaacggagggcaccaggacgtagagaacgttgcggcgaactcaccggtgaccaaagaagcggcggaagagcagcggacggcgacggcggcgcggcactagggtttcgggcggcggccgatgcgaggaagacgacgactccgacaggtgggccccacctgtcagcgggcggacgcgcgcgcgagcggcggctgttgctggactgggccgactgggccgagggagagagggagagaggtttttgggccgtctttcggcccaaagccaaaagagacttttaaaaacctttttcaatttaaattattcattaaatgcaattctatttattaaaaatactttcttagctcaaataaatcccagaaaaatctaggaattatagaattaagcaaagtatttaatgaaattttatctggcccattttatattggaatttattaattaaaatttgatcttctcttctaggcttttaaaataaaatctaataattccatttaagcaacaatttatatatttaggatttttagggtgtgacaaacctacccccttaaacagaatctcgtcctcgagattcggaagaactggcaaacagatgcggatgagctgacttcaattcatcttctcgttcccaagttgattcttcttccgagtgattactccattggactttgcaaaaacggataactcgatttctgggtcttctctcatctatttccaaaaaaccgattggtttctcaacataaggcaaatcctcttggacttctatctgtttaaaaataacttctt

SEQ ID NO: 8099 - DNA, 1359 bp, Oryza sativa
ggtcagcagcccgctgctccagtgcggctctctcggcgcggacgcattcaagattgcggcgcgcctgctcctcctgcgccgcctcgcgaagtgacaggctgtccgccagccgtttggtcgtggcctcagcctcctcgagagctcgctcccgctcagcgagtgcgtcctcgcggagacggagcgcgcactcctcctcggcgtaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggagaacgtgctgggctcggggatgtcccccgaacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgcaggatcttcggcctcggactggccggacttggggtggcgggaggaatgcgacgggacatcgctgaagcagaagaaaaaaccagaaaacgaacaaaatgagtaagaaaaaacttctttttgggagaaagatggttgcaatgagagtgagacgaacctgcgaaggggtcggttgaatgacc

SEQ ID NO: 8100 - DNA, 633 bp, Oryza sativa
tactgtgccatccggctatacgtggtgaaccaagtgttctaggacaacttgatttaaaaaatgttgtacaggctgaccaccaggcgttgccaacccggccgatgcacctattgaaccttggtgctggattcgactgaatgatttgctgtcttaacagcgtctgctgaatcggctgcaaaggctgttgccttggtggtgtttgctgaactggttgcatgacctgttgctgaattggttgcacaacctgctgaattgggggtgtctgctgaatcgactgctgctgtattggatcaacaatagattgaggcggcagaaacgtggcagcaacctgatcttaggtcagctgatttgcaacctgcccgccatgctgtagctgctctctcattaacaaccgagggttcactggctggcctgacgccattgctgcggaacaagtaggagagttgacgccagtgccgtcgactgagatgttggtgcaacagagggaaccgcttgagttgatggctgaacatcggtaatcaaagaccgataatttggaaagacaccttgcaaataaaccgggcctacagcctgatgctcagctattgaaccatcggctatggacttcatcatgtttgataaggtattgactaa

SEQ ID NO: 8101 - DNA, 417 bp, Oryza sativa
gcaatgcataaatatgttagaataataatattccactagtattgggtctactaaccttttgcagagaatgacaataaaatgaaggagaatcaacatcaacttaaacgataaatcaatcggacgatgtcgaagaccagacttatgtatgaatgggccaagaactcagaattgacacgacaaatcaggccaaaattcacaagtctacgaagtgaagcaccagagaaggccaccacccaaaatgtgggctggttgggccggccccaggttcggccgaacctcccgtgaagccgatggatgcatggttttgaggaaacggtggagattcactccctatggcggttggagggtattactgtcacgcccggaatttctatccaaaattccaaacgcttacatgtgtgtgaaccctcgtccagg

SEQ ID NO: 8102 - DNA, 465 bp, Oryza sativa
attattctttttcttttacctcgtagtttggtggtgcaccatttggggataatgcggatcctgctgtaaaatgccttctgggaatacaaccatcttaagagtgcgtgtcagttacaggatacgagggcacagcaggcccgcttgaattccttctccatgtggtggaaaatgcacctgcactggagattttaacagtagatgcagcctgtgcctgataaaaggggaactttttaatgctttttgtcaggcttctcgacatcacctcgttcggaggctgctccctaacaaagttggtcctgctgtgagataaaaggatttatttgtactcaagaagtcaggatatgccaggtttaagtagcacgtcattagtcaattactactactacctcccatctgctgctaggtttctatatattgtgacagaagtagtaaaattgcttttgccaatttcatttaacttcacta

SEQ ID NO: 8103 - DNA, 27554 bp, Oryza sativa
  unsure (1)..(27554): unsure at all n locations
nnnnnnnnnnnnnnnnnnnnnnnnnnnnnnnnnnnnnnnnnnnnnnnnnnnnnnctcgggttcttggtctctgcccgaggtatcgaggccaaccccgagaagatacgagctatagagcggatgcgcccccccagcaagcttaaggatgtgcagtgcgtcaccggctgcatggccgccttaagtcggttcatatcgaggctgggagagaaggcgctacccctatttaagctcctcaaacgctccgggccgtttgcctggacggagaaggctgagagggccttcactcagttgaaggcgtacctcagttctcccccagtcctggtcgccccggagccagatgagccgttgctactctacctggcggcaaccccgcaggtggtcagcgcggcgttggttgtggagcgcgacgaggacaaccctcgctccgcgcgtccccgccctgtgtcgactcgacccaggagagagcagggaggagaggcccccgagccgaacggcggcccgaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctctgacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggttacggtggttacgtcctaccccctcggccaaatcttgcataaccgagagggtactggacgggtggagaaatgggcaatcgaactctctgaattcgatttgcgctttgaaccacgccacgcgatcaagagccaggccctcgctgactttgtggcggagtggaccccagctcccgagccagtccccgcccccgaggccagctcgggcccctcgcagctgcctcacaccgcctactgggtgatgcagttcgacggctccctgtcccttcagggcgccggtgcgggggtcacgttgacctcgccgagcggagacgtcctcagatacctggtccgcctcgactttcgggcgaccaacaatatggcggagtacgagggactccttgcgggactcagagtggcggctggactggggatccgccgcctcctggtgttaggcgactcccagttggtcgttaaccaggtctgtaaggagtaccagtgctctgacccgcagatgaacgcttacgtgcgccaggtgcggcgtatggagcgccatttcgacgggatagagcttcggcacgtgcccagacgggataacgcggtcgccgacgaactctcaaggctcgcttcctcgcgagcccagaccccgccgggcgcctttgaagaaaggcttgcccagccgtcggcgcgacccgaccccctaggggagacggacgcgcctgaacggcccctgaggcccgtcggagtccaggcctcgggacccgaggggagcgctcccagctcccctagattgattgcttggatcaccgagatccaggcgtacctcgcagataagactctacccgaggaccgcgaagggagtgaacgcgtccggcgcatctccaagcgctacgtgctggtggaagggaccctcaatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttttacatatgacatcggctcagagataaatgatatgacatcggcacttagccgatcggctatcatttatagatttaaccgcggtttctttgtctttatttcttattgattgcaggatcaaatcaactggcacgctagcacacccgaaggcgagttttggacctgcactggagttatcgtgttttacgtcaacagggtcccatatcttttttatctgttttggctgactagactgccacgtatgcgtccacgtaggaccaaaaccggcctagattgatttaggggggtaattcatccggtttgtaaagtttagggttaaaaataactggtattgaagtttagggtggtaaatcggacgaccacaattgttcaaggggtaattcgtacttttttcctttgttttatgggatgaactgatggaggaagtagattttaggcaaaatttgctacaggacaccgaaagattgcggcctttgctgtgagacattcgaagatcgtgaatcttttcgtggacactgtaaaaaagtagtaattagctgttggacactactcccatttttttattatttccagttaaaatggagagagaaagttgtgtaagtaccaaaatgcccctgctctctccttttcttttcccttcttcctcgtgcttgctactgagccgagcataggcgcgacgcgcgcggccagcccacggtggggcggtggtggcagtgcatcacccaggttcaccgccgacggcgacgccgtacctgaagctgccgagtaggtaggcctggagacatgttgatggcgagcacgatgtcgttgccatacctctttcgtggccgtttgctgtctgggggctcgatatcctgggtccgttcaggcgggccccgggcgggttcgagtatctgtatgtcgctgtcgacaagttcactaagtggcccaaggcttatccggtcatcaagatcgataagcactccgcgctttaattcatcaggggcatcactgctcgatttggggtgcctaaccgtatcattacggataacggcacccagttcactagtgagctcttcggtgactactacgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctaggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctgaactgagcaagctctcaccaatgtgggagggtccgtatcgagtgatcggcgtcccccggccgggctccgttcggctggccacgggcgacggcaccgagctgcctaacccgtggaacatcgaacaccttcgtcgcttctacccctagtgggggtcgggtgtcatgtctcgggctccggccaaccccgcacccccccgggcgtgcaaggttggccgggggctaccacatgcatatacttatcttttttctcttccgtatttcaataaaagcattttcgatttcctgaggactgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctagccagtctcgacacgtggatctccccaggcactagccccgacccgcgccgtttgaggctgggacctgggcacgagcccttgttcaagccaagacacagaaggaccgcggcacagaccatcctcgtctcatacacacaacaaacagaactgacacagaaatttcctctttacttgattgcagattaaatcagtctatacaagaagggggcccgaaggcctcggaagaagaaggaaaaattattaagattggcaggggcctaggggctcactccgacgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaattcttccagcgctgcccacggggagaagtcagggtccctggcctggcaacttgccagtacgagctccaccttcgtgtcacgcctcttcgaggagttcatcgttttcacaccaaaagaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaagaagctaatcttaaacagatagaagtccaagaggatctgacctatgttgagaaaacaatccgtatcttggaaatagatgagagaagaaccagaaatcgagttatccgtttttgcaaagtccaatggagtaatcactcggaagaagaatcaacttgggaacgagaagatgaattgaagtcagctcatccgcatctgtttgccagttcttccgaatctcgaggacgagattctgtttaagggggtaggtttgtcacaccctaaaaatcctaaatatataaattgttgcttaaatggaattattagattttattttaaaagcctagaagagaagatcaaattttaattaataaattccaatataaaatgggccagataaaatttcattaaatactttgcttaattctataattcctagatttttctgggatttatttgagctaagaaagtatttttaataaatagaattgcatttaatgaataatttaaattgaaaaaggtttttaaaagtctcttttggctttgggccgaaagacggcccaaaaacctctctccctctctccctcggcccagtcggcccagtccagcaacagccgccgctcgcgcgcgcgtccgcccgctgacaggtggggcccacctgtcggagtcgtcgtcttcctcgcatcggccgccgcccgaaaccctagtgccgcgccgccgtcgccgtccgctgctcttccgccgcttctttggtcaccggtgagttcgccgcaacgttctctacgtcctggtgccctccgttcgtgccgaagcgccgtcgttcgccggcgagcttgcgcgcccgagccgccgagccgccgccggagatgacgtcaccgctgacgtcatcagggtctgtctgctgtgagccgccgtggaccgctcgatctcggccgtccgttttggatggatcgatctcggccgttcgttcccgtgaaccgctgccgtgcgcccggtccaccgcaaaccctagccgctgacgcaataaaccctttttccttttcaaaaataattcattattgcgtcataattcaattaaaatccatataagtgttttaaatcgatttaatctttgaaaattcataactaattcatcttagctcggatttagttggttcaagtctctaaatttttctaaaattgagatctacatgttaaaaatatccacatgtattgttcaagcttgtttatgtgctgtttgggtgtttttgctcttttctgtttagattccgacgtttccggagagtccgttttcgcaggagaagaatttgaagagttccaaggccagcaagacaagtcacacagatcccaaacaatcctttgagcatgttgatcccgtttaaagctattgtttctattcaactatcgcatttattttcgaatgtcattgggtggaattaacctattgtttgttatagcccttttgttcttgaatactttattccttgataccttgggttattataacttgactagttgggctatatatattggttcgactacatattagatgtgattgcttagccatgcttagaaacattagcacactattgagataacttatgactcactattatttaatgatggcttaatgatagttcacgatggtcaatcgtgattggttaattaattacttgccaattaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgtttagaaaggttgggcctatacaacagggtatgttgtatagcgttgaattaatattgtttaattattacttaactgttttattaaattctgaaatgtttattaaaggctgtttatgcaaatggaaccctattataccatcctttgttattctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtagagtcgtctgcgccgtttatcttatctttccgctgcttagatctttattgattgagaggaactatctacctctgtaatgacattttatacgcttattaattagagtaataattgtactctattatcaatttgtaattgtgtgcctcggctgattcctggacgagggttcacacacatgtaagcgtttggaattttggatagaaattccgggcgtgacagtaataccctccaaccgccatagggagtgaatctccaccgtttcctcaaaaccctgcatccatcggcttcacgggaggttcggccgaacctggggccggcccaaccagcccacattttggctggtggcctcctctgctgcttcacttcgtagacttgtgaattttggcctgatttgtcgtgtcaattctgagttcttggcccattcatacataagtctggtcttcgacatcgtccgattgatttatcgtttaagttgatgttgattctccttcattttattgtcattctctgcaaaaggttagtagacccaatactagtggaatattattattctaacatatttatgcattgcaagcatcactagttctctcctgttttagtaatattgacggtcgaaactgatcgataacgaccgtcaacagacacccattggaatgtccccatatcagatagtatacgggaagtcatgtcgactacccgtagaacttgagcacagagcatacttggccatcaggaattggaatatggattttgagggagcaggagaatggagaaaaatgaaattagctgaaattgaagaatggagagagaaggcttaccacaacgcgaagatatacaaagaaaggacgaagcgctggcacaacaaaagaattaaaatcaagaaattcaagccaggagacaaagtactgatgttcaactccagggttaagcttttcggccatgggaaactgcgcagtaaatgggaaggaccgttcgacgtcatcgacacctcttcgcacggggcaatcacactctgcagcgaatctggtaacatatttaaggtaaacggtcaacgcctaaagattttccttgagccaaatgaaactttagatcaagaagtggatgtcattgaactaatcgattatgaacctgttgacaaaaaaaatcgaacacaccagcctggtgttaacaaccaaatttggtaatatcggcatcgggaaagaagattagatcgaatccaagtcagaggcggagatcgagttcggaaacagacagaaatcggctggagtccagatcggctacgattaggatcggctgggtctgagtcgggctaggcaagccgatgcagccgattccgacaatgcgacttgatgtatgacatcgggttgaattgaagtgcttcaaggtgattggcgcacatggatagagtcctgagaaggcaattgtgtctattaattagggtgttttatgtaaagtctgccgcaaagacttgtggtatcttagagtttgttagagatagttgtcgtgtccgttacggtcatatcttgtaattttcgggtataaatagacccgagcgctatgtaactttaaaaaagcacacatgttcaatacaatctcggcgcatcgccacccttttttgctttagttttatttcgacgagttcttgctttcgggttgagctgcatcggtttcgatcttcaacaagaggtaaaacttgttatggcggcttgcattctcgggattagtgcttccatctttatgacactctaatcttgtttatgtaattcgtcgagttatcatatatcctacataatccttggcaatatcgatatccaacctacaatcggctaacatccgtcaatagaaggcagacgattaggttaaataccattgttgacttagattatataggatatctaccactctatgacacatccaacagcttgattgtctagatattgtccttcttttcatacttatagctgcatcagttaagtttgatcttatgagtcatgattagaatctcaatctctagcctacttcttggttgctgattagggtagtatcggagtttcagccgatcttacctgatttaactactttttatcctatatgcttgattaacatgttaaatctgccctttacgttaagatcttgctgcatttaagtatattaggcttttgtttagtatattctacttgctttaatatcttaatatagagtggtatcggagtattagccgatacatgctagatctatctgatcggctatgctatgaacgtatatagtctcattattaatatatatttcgatctaagtgatttatactgtctcggcatggcgaccgatctatcccaatcacttgatttaagtatatatcgatataaagattatatattggtaatacttgcagccgatcgagtagattcagtccttccttatttattaatgactgccgatcgatgcatatatgacatcagctcaaagataaatgatatgtcatcggcacctagccgatcggctatcatttatagatttaactatggtttctttgcttctatttcttgttgattacaggatcaaatcaactggcacgctcatacattcgaaggcgagcttcggacctacactggagttaagcagatctcctaggcctcgtgttttctgtcaacatgcttttggcacgcccagtgggacatttaagaagtcagccaacaattcttcctcatggccgagaaaccaccaccatccccagctagcccaggctctgttaaggaaaagatgctgaaattagggttgactgacgtcaatgaaggaaatgtcgtgctgatcgatccagaaaaattcacacctgagtagaggaaagagtttgaagcaatgttgcagcaagcacgggatcagttcttgaactcattcatgtagacccgcaaggggacacttgttcagaagtacaaaataaaagtggttgctgctgatccggggaccagttcttctaaggatggagatgggaaacaagctccagacggctcggctcagctgagtaaccaaagtgctaccgacagctctctaggaaatcaaggtgacaattctcaaggagtccatggagtgcaaggtgacggggtgcatggagttcatggagttcaaggtgatggtgcccaggggttgcaaggagaaaatcttaatcagaatagtgatacggcacaagattttttcagtaatttccaagatcgggttgactacgctgtgcatcatgctttcatcaatcaatctagggtgttagtcaataccttatcaaacatgatgaagtccatagccgatggttcaatagctgagcatcaggctgtaggcccggtttatttgcaaggtgtctttccaaattatcggtctttgattaccgatgttcagccatcaactcaagcggttccctctgttgcaccaacatctcagtcgacggcactggcgtcaactctcctacttgttccgcagcaatggcgtcaggccagccagtgaaccctcggttgttaatgagagagcagctacagcatggcgggcaggttgcaaatcagctgacctaagatcaggttgctgccacgtttctgccgcctcaatctattgttgatccaatacagcagcagtcgattcagcagacacccccaattcagcaggttgtgcaaccaattcagcaacaggtcatgcaaccagttcagcaaacaccaccaaggcaacagcctttgcagccgattcagcagacgctgttaagacagcaaatcattcagtcgatccagcaccaaggttcaataggtgcatcggccgggttggcaacgcctggtggtcagcctgtacaacattttttaaatcaagttgtcctagaacacttggttcaccacgtatagccggatggcacagtaatacctcaagttgttcctgagcatttggtacgtaatatccagccgaaccttcataattaccaagggggtaacttgaattaccaagatcagcctccttccccacaagctcaatatcagccaggtggattggctcaacctcagttggcgcctcaatatggtcagttcgagcccatgcagcaacagtcacaaggggtagctcagcaacgaccgtgggccgatgtgattgctgacgtaatgagggaacagtttgggcttaaaccaaaagagactggaagcttgtattggcagccttaccctgagtggtttgagagagttcctcttcccaatcggttcaaagttccagacttctccaaatttttgggacaagatggtgtgtcaacttatgagcacattagccgtttcttagctcagtgtggtgaagcatcggctgtagacgctctaaaggttaggttattccggttatctttgtttggatcggcttttacttggttttcctctttgccgtatgggtcgatcaatagctgggccgatttggagaagcaattccacagctatttctacagtggggttcatgagatgaaattatccgaattgacagcgattatgcggcggtatgatgaacctgtgcatgagtatattcagagattcagggagatgaggaacaaatgctttagcttgagtttaactgatgcccagttagtcgatctggcttttcagggtatgattgctccgattagggagaaattctcgtctgaggactttgatagcttgtcacatctgatacagaaagtaaccttgcatgagcataggtccgcggaagttaggaaaaactctaagaaggttaatcatgtttgtccgtacatgtatgggttggatgatgacgaggacgattctgaaatagctgtagccgagtgggtgaggagtaaaaaggtcataccatgccaatgggtaaaaagttctggaaaagaggagaagtatgactttgatattactaaagctgacaagatctttgatttgctactccgagagaagcaaattcaacttcctgctggtcatacaatcccatcggctaaggaattaggcaaaaagaggtattgcaaatggcataattctgggtcccattctactaacgattgcaaggtttttagacagcagattcaagtggccattgagggaggcaatattaggtttgatgattccaaaaagccgatgaatgtcgatggtaatccttttcctgtttatatggtgcatacagctggccaaacagccgatagggcccgtgcaaggggttttcgggtgaattcggctaagattatcaacaaatatcagaagaagtatgacaagcagcagaagaagcatcatgagaaatacgatgatggttttgatcctcattggggttgtgagttctttagattctgctggaatgaaggtatgaggttgccatctattgaaaactgccctgggtgcagtgatatcgtcaagaactcaagccgatcatataataggggcaatcggttaaggcagacaacagtttctgttcattaaagattgggcccagtaaatcaagatcatggccaagaggacgatgtaatcaggaagaatcaatggtgtccttatggtattttcacgaagaatcagaagagaagggttcagagattaaggaatagggagcaccttcaggaggttgaacaaaaaattaatcatcggctgaagaaagcaaagccaaggcaggagtggcatgttaagaatcaggttcctgtagccgatgatattgcagccgatgaggcaaagaggttggcaaaagggaagagtgttgtgacggcaccggttaacatggtctttaccctgccagccgaattcgggatcgaccaagccgatgtcgatgaggtggaagaggaatcggctaagttggttctgtcaccagaacaggcagtgatcgagaaacccgaggggacagagaatcggcatcttaaaccattgcatataaacggctacgtcaatgggaagccgatgtctaaaatgatggttgatggtggggccgcggtaaatttgatgccctatgctacgttcaggaagttgggtagaaatatcgaggatctcatcaagacaaacatggtgctcaaagattttggtggcaatccatcagaaaccaaaggtgttctaaatgtggagctgacagtcggcagtaagactgttcctaccacgttttttgtcatcgatgggaaaggttcttacagcttattgcttggaagggattggattcacgccaattgttgcattccttcaactatgtatcaatgtttgattcagtggcaaggcgacaaaatagagattgtgccagtcgacaggtcagttaatgttgccagtgctgatttagctctttgggagatggatggccttgattgtttatatggaaaagtctgggatggagattttctaaaagtgtccaattctgatatacagccaattgaagatggagaacccaatctattattttgagggcgtcgtggagggttcaagtgtctacactacggacatggtagatgatctcgatgacaagcaaggtcaaggtttcatgtcggccgatgatttggaagaagtggacataggtccaggcgatcggccaaggccgacatttattagtaggaacttatctccagagtttagaaccaagctgatagagctcttaaaagagtttagagattgcttcgcttgggagtattacgagatgcctggactcagccgattgattgttgaacatcggctacctatcaaaccaggggttaggccacatcaacaacctccgaggagatgcaaggccgacatgcttgaaccggtcaaggctgagattaaaagattatatgatgctggttttattcgtccttgccgatatgctgagtgtgtttctagtatagttcctgttatcaagaaaaacagcaaggtcagggtatgcattgatttccgaaatttgaataaggccaccctgaaagatgaatacccaataccagtagccgatcaactagttgatgcttcttcgggacttaagattttgagttttatggacggaaacgcaggatacaatcaaatttttatggccgaagaagacattcacaagacagcttttaggtgtcctggtgcaatcggtttatttgaatgggttgtcatgactttcggcttgaagagtgctggagctacatatcaaagagccatgaattatatatatcacgatctaatcggctggttggttgaagtctatattgatgatgtggttgttaagtctaaagagataaaggaccatatagttgatttgaggaaggttttcgagagaaccagaaaatatggcctgaagatgaatccgacaaagtgtgcttttggtgtatcggctggccagtttttgggatttcttgttcatgagagggggatcgaggtaactcaaaggagtgttaatgcgataaagaagattcagcctccggagaacaagacagaattacaagagatgatcggcaagataaattttgttagaaggattatttctaatttgtctggaaggttagaaccttttgcaccattgttgagattgaaagccgatcagcagtttacttgggaggcagagcagcaaaaggctttggataatattaaggaatatcttagttgtcctcctgttttgattcttccacagaaaggaataccgtttaggttatatttgtcggccggtgagaagtcaatcggctcggtcttgattcaggagttggaagggaaggaacgagttgtattctatctcagtcgtcggctcttggatgctaaaactagatattcccctgtggagaagttatgcttgtgtttgtatttttcatgtacaaggctgaggcattatctactgtccaacgagtgtattgttgtatgtaaggctgatgttgtcaagtacatgctatcggctccaatattgaaaggaagggttggaaagtggatattttccttaaccgagtttgatcttcggtatgagtcaccgaaggcgattaagggacaagctatagctgattttattgtggaacatcgtgatgattcaatcggctcggttgaaatagtgccatggactttattctttgatggatcggtgtgtactcatggttgtggtatctgcctagttataatttcccctaggggggcatgtttcgagtttgcttatactattaaaccgtatgtgactaataatcatgcctagttataatttcccctaggggggcatgtttcgagtttgcttatactattaaaccgtatgtgactaataatcaagctgagtatgaggcagtgctcaaagggttgcaattactcaaggaagttgaagccgataccattgaaatcatggggtaaaatagaggttgtgggaacaaattcttacacatatatgtgtgctgtgattttatttttattcctcaccaaaacaaatcttgtaatagatctaaagattcaaaattacatgaaacttatatacaagttatactatagttacgtgcaagttacagtgtaattacactatgattgtactataattatatctgtcaaatttttaggggaaaatttatcgataaatgtataggtggacatgtaaaacgttaccactggatgaatgatgcaagaacaatggtaaatgtcagattcaattcagggttctcgttcttgtggagtcactcacattcagatgatgcggctgcgacgagggcacatcacccagcttctgctgctgatacttgctcccgttcgcctcctgcaggagatcaccattgaagaggctgcgacaaccctagctcctcctcctcctcagaccatttcctccatgataggctccctccgtggccgcggccgccgcctcctcgccgccgcgtccgccctcgcgctcctcctcctcctcctcctgtcccgctcgccgcgtcgtcgtccccacgggtatggcgtcgtcatcgacgccggtagcacgaggagccgcgtccacgtcatcgcctaccgctcccccgccgcctccgcggccgcggccgcgctcccgtggatcgactgggcgcgcacggcgtcgatgaaggcggccccgggctgttgtccttcgcctccgatccgggcagcgtgggtcggtcgctggcgctgctcgtggagttcgctcatggtcggcggcggcgaggcccggcatggtcgggtgaggcaaggtgggaagtcacgcgggcggcgggtgaggctcatggtcggcggcggcggcgagggccggcatggtcgggtgaggcgaggtgggaagtcacgcgggcggcgggtgaggcgggcggcgtggctggtgtggcgggcggcggagataatcctctttggcgtgcgttctttttttcgttctttttggcgtgcagtttctttttccggagcgagacgcagtgttaatccggtgctaattgcaaccgcaggattaatccggcgctaattgcaatcgcggtgttaattacactaaacaactcgtgctttttatattagtctagatttggcgtgcagtttctttttccggagcgagacgcagtgttaatccggtgctaattgcaaccgcaggattaatccggcgctaattgcaatcgcggtgttaataacactaaacaacttcgtgctttttatattagtctagataacatagggatgagtagcaaattgttaaacgccatatctgtggagtgataaataatataaatgcccccggacgagatggggggaaaagcagcacaaatcagtaagcccagtgaatactcagagttgaagagctgacttttcccttgcaaaatgttactgctgggtgctggccatcccgtatacgctttccatatgctgatcaacatcctgatgctgcaaatcttttagtaccacagtgtttcatgtccataactgcacggagaagctattcacctgatgaatagatgataacaaatttggacctgcctaaattttacctggccatatagttaacgtttaaacttatcctcatggtaaccgttgagaatccaatgcggcaaatcccaatttgattggatatcaatttaccaacaaacatggaaatccatcacacagcgtgttctgacaaaaagatgtataaagtattacatagttcatctgacgtgacaattttcgcttctgttctttgagtcaccctccggcgcttgatacctgcagaggattcagaaaatatctttagagatgtatccaaatgaatggtcaagtctccggggatagtgctagcgagggtattggggcataattaaataatgagaagtacaaaattgcaaataattttctaggtgcagtttaataaaataaaattcacatcaactgctccacgttgatgggaagtgaacgttgacaaagatgcataagttacagttaaaaaattgtttattactggattccaccccaaaattgatacaggaaggagacatcttaatccaaaagcacaagaacacagttcaacttgacaattacaaaggtcaccaagaaaaattagcaggcatactgtacaagtgttaagatgaaaaaaacgaattgcattttgaagctccgtattgctttattatattcctaggtggcatctcttgttggctcatagcaacaatccagaacagagtaacatggtaccatgatgcaggacgtgagcaaagtaatggtagtttgtacatgttacaaacaacctctctttattatactatgttcagattatcaatgcatatcaaagatttcagcatagcatttcatttggaatagaactcaattccccaaatataacttcttaacctatcacacggtacacaaaaagggacatttaaggcctagactttcaagaattgagacagtacccccttagaacaatatactatcattagttctgtagatggttttgcaaccatgcaataaaagccataaaatttatgtaagccagcacctcattcaaaacaatacacaagctaattctccctagcagctgggcagagttgactagcagtagttatcggcacaacagtgcgtggtagtggaggaatggtgccttcttacaatactagcagagctattttctggtggtttcaccagttcctgaggtttgagacaaggaggcacacagcagggtctttctaactttgctgaatctgataatatctctgacccttcttgcttaccctgcaacctgcagttctcttctacttcctaagctgtataacaataacttcatctccattttagctgagccacaggtggctctagttcaacaatctctcagatccattagaaatattgacctaatttcttttttttatgagcactaaatttaactttgcgaacagaagtaaagtaatatcatcaatgtagtcttggtgagtttgtccacacacctcgaagtaattctacatttaatgagccgagctgaacatgcagctgtcaaacacacccaccatctaccatgcagtcgtgattagtgagtgctgctactcaactctgcatagctgctagggagaattagcttgtgcattgttttgaatgaggtgttggcttacataaattttatggctttatttattgcatggttgcaaaaccatctacagaactaatgatagtatattgttctaagggggtattgtcttcgtgagcggagacaaggaaaacactatgcagccactgaatatcaggagggtgaatgtgaaagatcaatgatcttgttctcttgcatgatagaacaagatcacaatgttacatgagataacaacggtgtcaattggtggatgctagtgacagtcgattgaggggtaaaactttaatatttgctcgctcactcatcatctggaaaaagaaaattaagaatagccacagcatctccacctaggctaacccttcttgtgaaataaccatggggttaaatttggttcaacaataataataattagggccttctttggaacacgtgattgtgagatgggttttatggtacttgaaatgccttgttcattctttgtacctgcatagttgcatacactcattctggtacataacatcgtaaggcaaagcacgtatcaaaacagtttaaaaatcaaactagtgtttatacatagcatctgttcttacccaagggagcatattccttcgagtaaatttcacaaaaccccaggttttggggcacccataacacaaccccaggtactacgatttgtttcaaagaaccctagattttggggcgaaatgtttcaggacaccttatgtttaagcttgtatcattggttttcctaatatagttatgcataataattgcaaaaaaaagagatattcctgagtatatatacatgttagcatcattttaacgagcatcagttattggtaatatgattgtttacatgtataactggttaatgtgtcattactagtcaggttgttgtgctttttcaatcgtgcaatgcaagagtaaggaggaagataaattgcatgtgagtgatgtattttgagcctactaatgtgaacacatactaacaatatgagtatttgacataaactttcttgaaacattttggcccaaaacctagggttccttgaaacaaattgtaatacctggttttttgcgttacaagtgtctcaaaaccagaacgattttatcagccattcatctgtcatgactcatcattcaaatcaattattgaaatgtttgttcgtatcaataattgaaatgatcatgtttatagtagtttcaaatttaccatgtccaagtaaacataaaatcagataatgcactcctagcttagctagctacataatttgcatggactgataaacatgattgaacaattcagttaagctcttgaattttaatgcagacaatcacggtcatcgacaaccatttttaacattcaactaaactctaggttacgctcccaccccaccaccagacaaagggaatctttcctcacctacatgatttcatgacaatgaaaatcttcacttctgcaacccataatgaacttaatcgtttcttaacattttatcggtaatttacgttaggctccccctcccaacaacagaccccagggatgcttcttagaacaggtataatgaaccttagttcacaataggataaatattgtgcagaagtctggatgataacttaaaaggggatggatcttaggagagatgaaaacatagagttggcgatgaacttttaggagagaaaacaaaaagactaattcattatacatgcttgcttggaaaatataacacctccttatttatctatttataaagaactgctaacagattagatctagagatacgtcaaattaaaccatccaaaaatatgttgcgctctaataaaaactacttatcttataacaaaacaattgatccactaagtatcaactaactaaagtgtttcaaaagccatgtgctacatgatgagccctgatgggcttcatgtcacataacagttgaagtcatttttcatatcattacctggagctgcttgcaaataacgtctactatgactgcacctagcaataaactgcagtttgaatagtaatagtgcacaaggactggatgttacaatactatgaatgatttatctgcatattaactagcctgcaacctactaacttacatcaataaagcccattcaacaaaaaatggatatggtatattggtgatgaattgaagtgagtgaccatgtgtctttaaggaaataaggggagtggactacatagtacatacttctatattcattcttcaattaatgaaaaggatggcaatacctccatgttaacaagggcatattaacagattatatatgtactatgatagaaatagctaaaggaagcccagaatacacgtaattgctatctataaaaccactagctagacatagtggatgctattggtggttatacaagtgaatgatagaccccaagttacaataccataccatgccacatgaatactcacatataaaataattttccaaatctgattggacagaacaacaaaaccttaattcaacatttcaggccgctaagctcacatagtttttttttttttacttccattaccaagcgattgaatcacaaaacatcacagatgatgtacagttagaattttaccacaggaaagttcagaacatttgaaaaagcaaacgattaaaatatgaaatataattcataaattttggaaagctagactgggtaagggaaaaaatcaccacaagaggacatggtgaagaaagcaattaaactcaccaatcactgtgaacaccgtcataaaaatgcatgccctaaacattaggcaaaagagattaccttaatttgcagcaggatacaatcatgcagaacaaagcaaaatacccccgacagaacaaaatacttctgctcttaagcattttcaggagatccatttctctgtactaattgaaaacgccaacagtcacaagtcaccaaacaagtcatcattatcatcagctgaatttgtatccatattcccactagacttcttttcatcagcagctttgactttttctgcctggtcatccgacctgtatgcccaagatgggcccaatagttgtggaacagtatccccataaagatcatcataaattccaccttttgctgtgcttttaactttggtaagaacctgttttagcttatctgttaccccactgggggatgcactttcctttggtgaaggttgctcctttccttttggaatgacagtaacctgtacaagggattcatatttcccaacaagactgccttccttcacccctactggacctggttcagtttcaacatctgcgccatctgaaatcccaaccacttgaataagttctcctccaacttgatctctaaatgatactcttagttttttacttctcttcaagggccttccagctggctcgttatcatcatttgcaccagaggcatctcccgaagaatcttttgatctggataagtctgatttactaataccatagcggttaagtattgtgttgtatgcgaccacagcatcttcatcattggggtctggtggagatggcagactgacatctgatggaagactatgagttgggaaaaaggcagcgctattctttcgtaggatataggttctggttgatgcagcaaagcgaagtgactgaccaacttcaagttcaacagggttgtctttagttagtctctcatttgcaacaaatgtgccatgaactgatcctaaatcaataacatatatgctgaaatacaaaaagaatggaaaaaatgtcagtgatgcaccaaagcagcagtgtcaataaaagtagaaatgttttccatttgaggcccagtggtttttctggccgacaaattctgagcaaggcatgccttaaggttcttcaaaaagaaaacacattgcaacatgacataggcaactgttctgaaactaaacttgaaatttaggtgcatccaagggattgatttttttattgataatatgaatggtgttgttgaaccacattgtttcatataggttgttgcttatgaattattaagctcaattccactgctagcatgcgtagcattcagtaacaaacagcggctaaaaaaactaccatcaaagacaaaatcaacaagtggaatcacaactgtgttaacattagcattatttttagtctaaccttccatttctgtgtggaacaacagcagcatgctgccgcgatacagactgatggtccaacacgaaatcacatgcaggtacctgcctcccaaatatatgcctcttcttctccagattgatccgatcaatgacatccccatccttcaacacctcaagatagtaaaccccagggcgcggctctatcgcccagtcaggtggctgccacgctgattgcccaccaccgacctgggtcccagcatgccccggcgccccggtctcttgcccggccaccctcaaactggcacctgcggactcaggtgactctggctggttccaacatgtgaaatctgtggcagtgtcaatggagccggcggtcctttagctgttctcgccgctgcaggtacattcttggccgccgaaccggattgaacggagaatggctccaaggcctgagccttcttgaagcggtcaagcccgccacggtacatatcccgaaagccacgctggtatcaccaccacttctggtctcttaataacacaacaaatcaagcaactgatggccctggcccctgcgcacctgcagcgtccaatgaaccctagtgaaatttcgctagattgccagcgcaagaatctccggcctaaaaaatcagtaacagcaacaaactcagcactggatttggatagcgaatggagtacactacagacaaaaaggattcgatcgatcgatcggtcggtcacgggctcagggcgcaaatcaggaaaaagcgaaatcgttaacagcttagggcttaccgagagccgagaagtgctagcccggattcatctaggctcggttggaagcttccgaggagatcgaggccgccggggtgcttcggttgcggcggcggcggaggggtggggatgatggggattggggtttgcctggtggcgtctgcggactgcggctgctcgggcgctggtccggatgtagcggtggtggtaacactccccgcctcggatccccgacttcctcgccccgccccgcccccgacttttctccccacggcgggcgacggaggagcgcggcgatgggagggagggagggagggatggcggcgcgggtgtgaggggagcacgcgagggaacacggggagcgggcggcgccgccggcgcggaggggagcgagcgatggggtcgatgcgatgcgactggcggcgtgcgtgcggggaaggatccggggatagggctggaggatttgagcgccgtgtttctttctgggctgggctgggcttggtcggtttctttggacatgggctgtcacctgaacttgagccgacccacgttgccatgcctccctgccaccctccgtccgactaggtctaatctgattcctatttctcaaccacaaaaccggagtaatttgattcactcagtggttttgagagcggttttcgctcacatgacacgtgaggcctacttgttagtcatctttctctttcttctccttcccttgccatgtctttctccccatatttcctcttgccggcgggataccgggcgacagcgggtggtagcaggatggtcctctaggtgctcgcccacgacgagcgagtccaccaccgaagcacacgtcgcccacccatagcagcatggccatctcgctacttgtcaatgtccatcttcctctgatcctcccgacaaccaatgagctagctcgagacaaagagaggagagaaagagaggggaaggggaaaggactgagggacggtggtgctcctctgcctagcgcgaccttccctgcaccgatctacgtggcagaagaaagaaggaggtggtcgataaaccccaccgagctgcaagaagcggccaaagggaacgagatctggaggtcaccacctctgcttgccctcttcaagttcccaggggtggataagccggcaccacccatctccctcgtcttgctgcagccccgcgcccaactggttctaccacctcccagctccctcgccttgttggctcccaccatcctactactgccaagccatcggatcaacatgtgccacaacagccaaatagtagcgatatagccggttttgcagagggatgccaatcagattcggccgaaaattgagggcctgaaatagacttccttttgacaaccgaacaaaatcattgacccatcataaaaaaaattgtgagtacatataaaattaagacaattctatatgtattcacaatttcttaatttctcctttggctttcctccaccgttgtggttgaggaattgtcgagtttgactatttatcagctggagcgtatacacatttttttcttaatttctcatttggctccactgttgtggtcgaggaatcgtcgtgtttgacaatttgtctgtcaaagcatatgcacaattaaaattgctttaacctgactggtgtaacgcactggcatttttactagtagagataaagatagcgatcatataccgccatatagaacgatcatcggatcaacatgcgccacattagccaaatagtggtgatatagccggttttgtggagggatgccaatcagattcggccgaaacttgagggaatgaaaatagacttcttttttgacaaacgaacaaggaataagtccactttgactcccttagaagtgacgcgaatctaatccataacactcaaccacaaaaccggataggacgactcatcgaactattgaaaccagtgcaatttgactcccttagcggttttggagggcggttttgctaatatggcgctgacgtgacaatgttgatatagtattcgtcctacgtggcacttacgtggcattagattttttaaaaaaaattctatgggacccatctgtgatttacacaaaaaatattgtgggccccactgacatgtggggccatatgtcatcctttctcttcttcctcctcctccctctctctctcccttctctctctttctctcccccttttctcttcaccttctctctcgtagagcaatcgacgggtaagggcagcgacagtgggcgggaaccggagaggcgacggcttgcgggagggttggcgagcatgtgctagagtgtgcggcgtggaagtggcctcctgtggcggtggggtgtgcgggaaaggcgtgcgacgaaggggaggaagccgcggtggcggagggcggggcggtgggctcgactaagcgagacttaagcttggtgagcgacaaccggcggtggagtagcgcagccgaggcatgaggcagcggcgggcgcgaggacaacacgtaggggcttgaggcggcgacggggttttgtggaggctttgcaacctccgacaacggcgttgtcagtgtcaacagcggcggcggcgcagttggagatcctccttgggccggcggtgctcccggacaacatcgccttcaacgccgacctcggcgtggtcggggaagtcggcggcgacagcggtgacgatgacaaatatgaggaggaggatgacaagaaggaggagatggagggggcatgcggcagccgaatggtccagcccaccgccgccgccacttcagcttccgctgccgctccagctcccgctggccgctgctccaacccgtgctctccgtggccggccgaaggggagaaaagagaaagagaaagaaagagagaagggaggaagaagaaagagagataggatgacatgtgaggcccacatgtcagtgggccccacaattttttatgtgtgtgaatgacaaacgggtcccacgcatacgtttttaattcaaatgccacctaagcaccatgtcaaccccacggactaggtcaacagcgccacaccagcgaaaccaccctccaaaaccaccaagggagtcaaattgcaccagtttcaatagttcgggggttgagatatccggttttgccgtttagggtgtggattagattcgggtcacgggagtgaaaatggacttattccaccgaacaaaatcatcgacccatcatagaatccatggcccaaaacccaatacccaaatcttttccttcccacaagtccacaacacaaatccctaaccctaaaatccattattccccccacccggctaccccgagcgtcagctagcccgcacgcgattcgctcgcctcgcctcgcctcgcctcgcgcgacggtgagagaggtgcgcgggcgggaggtatcggcggtggaggctggtcgtcggcggagcagcgctggtggctggctggtcaggggcggagcagggcggcgcttgaggtcgaccggcggcggagcagcggtgggagtcgaaggcgcgcccgacgaggttgcccaccgccggcgtcgggtcgtcgtatggttgtgaagaagcaggttcggctcagttcctttgttcttctcgctagctaaattgtgttggtttttcttagaattccaagtttcacaaaaactgagaaaaccgtagacctaatgcccaccccaccccacccctggatggctagatgggattgtcacatcaaattcggtttcgcctaagtaaattccacctcatgaaattcaattagtaattagctagccgtcgctgcctcttcactcagctgcatctcccacaaacggaacaaaactttgaaaacgctcgctggaaccggccagggaaccttaggggtaggggtggggcttggataggtactccaaaggcattggttatttcttgatcgcattcgctaattaatagtaatttttaactaattacatgtgcccattacataacttttgccta

SEQ ID NO: 8104 - DNA, 1930 bp, Oryza sativa
tggacttgattactattaccttccttcagcgtaggaagagagatttcattatatgccactcctaattggtttgtagggtgagagggggagaggtggcaatggtggctccaaaggagggcactttgcaggcgttggcgtacttcatagttcccagtgagctcccttccgggtaaggccataaaaaaatcctcatctccattattgttcaacaggaggagcaagaaactaggtcagaagcgatttagcaagcaaactaatggtcttcctctcatttttgtttttcctatatgataggatcgatcctgatgcggcgtttattgtgtgtgttcggtttggtcagtacacagctaagcttgatgatggtagtagtgttcatgtgccaagcaaatacgctgaatgggttgtagactatcgacaatgcacattagagagcttggaaaaggattttgcagccagggtaaaatggggtaggtgccaacaggttgtggtgtatggatatgacaagagaactggcaaggaaacaaagtttttggataatatggatctagcgcatgcattatttgattggaagagggagaggaggctgattttatttgtggatgtggaggataaatctggtcaattagttactagctcttctatttcagaggtaaatgagttagtcatgggtgaggttgtgacagccaagcaaggtgatgctctagactcaagcaatcaacatctcattgattgggatagtttcaagatatctccaattctagaggagcaaataggttcttcagtgcccatgatgaaggaagatgaaatgtcaattccacaagagcaagttcctcagcatgtcattgattgggatggattggagatagctccaattccagaggagcaaattggttcttcactacctgtaatggaggaagatgaaatgtatgattttcttggactcagaactgaggatgagagagcggatcaagctaggcttgaagctgaaaagcagagggattctgctcctggtccagctccacgtcttgcacagcgggacttgaaccttgatgaggcagagatagatgctaggtttgaagctgaaattttctatgatagggatgaccctccaatgatagttggaagctcatatggaagtatggttgagtttagatcagctgtgaggcaacacgctataaaggggcaatttgagcttgggacagagaagtctgatccagaaaggttcaggggctattgcaaagctgagggatgtccatgggctattgtggcaaggttgatgcctgatggaaaatctgtgaaggtactaacaactagctaagaattgtctcatatttcaaatttatgtttgttagtaagaactgtcttatgttactaactaatggatttatgtgttgtaggttactttgaacagatttgcacatgcttgtacatctattgagggagttaagacaaagatggtatcatataagtgggttgcagagaaggcaattccttttctaaagaaggatccaaatatgggtgcaaagaagctaaaagaggagttagagaccaaatacaatgtcacagtaggatactcaaaagtgtggcaaggtaggcagaaggctgtggagcagatatttgggtcatgggaagagagctatttgtttaacttcaaggctgaggttgagctgaaaatgcctggaagtgtggtggagatagatgtacaggaggatgatgatgggatttatttttgtagattcttttgtgcattcaaaccttgcattgatggtttcatgaatggatgccgaccatacttgagtatagactccacagcctttaatgggaaatggaatggtcatctaccttttgttacatccatagatgggcacaactggatgtttccagttgcatttggattctttcagagtgagaccactgacaattggacttg

SEQ ID NO: 8105 - DNA, 2186 bp, Oryza sativa
ctatcaggtcaaaaataatggatctattggcgaggagaaagaagataggtgagaagctagatggtgagatgctccctattatagttcgtcaactcaatgcaatgactagatccttgggccacttgagggtggttcaaggtgatagagaccaagcagaggtggctgagatcactcctgaacatgagattattaggcatagggtcaatcttgcaaaacatacatgcacctgtagagagtggcaagtttctggcaaaccatgcccacatgcattagctctcataatatcaactagaaaccccagaatggctgattatttggatccttgctattcagtgcaaaagtataagcttgcatatgcaggtgttattcatccactttcagataagtcccaatggccaaaagtcaatcttggtttcaatttgttgccacctctgactaagaaagacgtagagaagcaaaggaagaacatgatagttgggtgtcttgataaagaacaaggcaagcttaggaccaaaggcaagtggcaggttcagtgcaagagctgtcttggcatgggccatagggcaacatctccaaaatgtcctttaaattcccagaaaataatgtaagatcacacatttacttgttctagcatatttattgtccatttccttttgaaaatatatttacttgttttacattttcaggaagaatagtgacaaacaagggagaccactaggttcaactagttgtgcagcgggtgctagcacacccaaaagacaaaaagtttcaagaaatgattccagcaatgctagtcctggacctgtctctgaaaggtaagatctttctatttgaatggtattgttgatcctgccttatgttttaactaacactcaatttattcaaggcaattggcgttgaccaaggctgctggagaagacaatttttattgtgcttgatcagcatgctgctggaaattttttgtgtgtgatcagtatgctgctgaagctttttacttgtacatgatgctaaaagttctgtaagctccaagtccttgatcaatcctgcacaggtatggcacaaagcagtgaaaaacagagacgaaagacaccaaaatcatcttctttacattacatagtatttacattacatggcaaacgaaccaaaatgaaatcttccacatcaattgatctctcatagtctgatatgtccattttgcacgacatcaaataattcctgctactgctgcttgtaatttccatcaagtaattcctgctactgctactgctgctgctttgccaactccatcaaataatttgttctcttcatgctaacgctttgcctgcttctgctgtgccgtggggcctgccatcggggcggtagtggcgacccacggtggtggtggtggtggtggtggtggtggtggtggtgctgtgcagtggcagggtatggccatggttgtggcggcctgagtggtaatgggcccaacattttacactcgaaaattggagggctgggtttaaaaaggggctgggctcaatttttatacatttttggcttaaaaatatttgagggctagggttgtgaaagagcccatgggccttgacccattaccacccctacgtggcgatggtgaggcatggggacaggggtgctgggcctaccgatgcggtagtagtggcaatgaggcgatggagtgcgtcggcatcgagcgaatgagacgagccaccagggacttgctttgatcgattgattagattgatctatttggtcagcaggggcaaaagtgtccttaaccctaggagagaagaagaaaatggaaggaaaaagaaattggggaaaatgggagtctgttcagttcgtcggtttcaccgagtaaccgagaaaacccacctgtatgtgctacgatgccgagggctggagtcctgcgagcagcatggcaatatattgggctgcggtggtggtcagatgggtttgataggctacggcgataggggttgttaacagtgataggggttggtaacggcaataggggttggtaagaactgatggtattaatgggcttttccaccagtcggagggcctccacgatgtggtttcatgcaggaggatggggtcgtagagattgatcggttgtgtgggttcttcggttttccagagatgagaaaccgagagaaaagtcgaagatcgaagcaccgtagaaataa

SEQ ID NO: 8106 - DNA, 3027 bp, Oryza sativa
agaaactttgccacacctctagaaggtcctcgaatcgactatctgccctcctcttttcattggtttgtttgcaacggtttcccattctcctatgcccctctaggttaaaaatagttgttgttttggacaaggacatgggcacggtctccaaaaaataactttgaccactacttttatatatatatatatatatatatatatatatatatatatatatataggacactcatatggggcaccatggtatcaaatgcacaaaatcacttaaatttttcaaaattttcaaattgtgagtatatacctagttataagaattcgattcatacctatacctatcaacaaataactcaaatttaactttatttcacaatccatgattacataactaactaattatatatttggatgctatatacctagaatcaaaatctaacaaaaacaagttcaaattcagttcaaacttgctttgaactagttagtaaagtagttaatgttaatacctaaatatttgaaaaagtttcatactcatttgaattgggtatatactcaatttcaaccatggtgcccgggcaccatggagcaccaaacaaatttaattaccgtcctgcactccattcttcaggccacctagaatagagatagctaagctagacgacaggcatacaaaccaaggtttcaatgtgtgactatatttaatcactccaattttcttttgactcgactatttgatttatgaacaaattaaactgatatgcttgttgatcaaacaagcataccatgcatttggctctaactactgccatcattggataaatgagaaaactgctctcttgcccaatctttaggtgggattccctcaggtatcctagtgtttgttagattttctcaattcccccatagtttaatggaaatctgtgtgttttcctcaaagtcttctgaattttccttgttttcatctcaccttcccgtagattatttgtaattgcaagtactaggctattattttcactaacaaaaagctgatcatacctcaactaaattaaaagacctagaaatagcgtaggggctacggtcacacgaaggtgtgactaatgaactagtgactgtgattgttctttgtcagatatacactgttaaaagaccataatttattaatcaacacagaatctactgttttgttggaattgttccataagtgagttgtcagttatgaacacatgctgtttattgttcattttgacatgcatgaagcattgaacacatgttgctcctgtactaactgccttattattctttttcttttagctcgtagtttggtggtgcagcatttggggataatgcggatcctgctgtaaaatgccttctgcggatacaaccatcttaagagtgcgtgtcagttacaggatacgagggcacagcaggcccgcttgaattccttctccatgtggtggaaaatgcacctgcactggagattttaacagtagatgcagcctgtgcctgataaaaggggaactttttaatgctttttgtcaggcttctcgacatcacctcgttcggaggctgccgcctagcaaagttggtcctgctgtgagataaaaggatttatttgtactcaggaagtcaggatatgcgaggtttaagtagcaggtcattagtcaattactactactacctcccatctgttgctaggtttctatatattgtgacagaagtagtaaaattgcttttgccaatttcatttaacttcactatgtaatgctgaatgaagtatatgtatgttcatgaagcaatcccccgagaaatgctaatcttgaaattagatataactacatcttccgttgtatgctgccagtgaactatttgccatcccttgtgcaatttttgtccaatgtgtcaacacatactgtcaaagcgtttttccagcttggaaaaagtccactttgactcccttaaaaggtacgttgaatctaattcgtaccccttaactagaaaatcagattagacgactctctcgaactattgaaaccagtgcaatttgactccctcagctgttttggagggtggttttgttgatgtggcggtattgacccggtctttgttccacgtggcgcttatgtgacgttagaattaaaaatatatgtgggacccacttgtcattcaaacaaaaaaaatgtggggcacacttgtcatcctttctccctccgacccttcttcctcactctctctcccttagtgcaatttgactccctcagcggttttggagggtggttttgttgacgtggcggtattgacccggtcttcgttccacgtggcgcttatgtggcgttagaatcaaaaaatatatgtgggacccacgtgtcctccctctttctctcccttatctctctctctctcattcagcatggcggcggtgggcgatgggtgcggctacaggaggaggccaaggatttggggggaggggaagggggcaggcaggatcgctggggatgacggttggtctgcaccgtcggtcaccaccatcgtccattccggtccaccaccgccggtccacacctgcacgcggcgtcgcccgaggcggccgatgcaacaacgacggcaatcccatctcttcccctcctctcctgttgtcgccgctcgttgatgttgctgacgagggatagtagcgactccgtctccatctcttccctctctcttgcttggcggtgccagggtcaagcccgtcctagtcggcgtcgaagttgggggcacgctccgcctcagtcttgtctcgggcggcgacgtccacttttcctggtggctgcggaatgggtaggttaggagctctctcgcccccgcagtcggttgcccggtcgactccctgttggcggcagtggcagcggcagtctcattgggggactaagagacagatggtggcggttgaggaggccggaagccctggagcggctgctttcgcttttaattgacgggcggtcgttctcaccttctcggcagctacttgaacggagggagagagagttcacggctagc

SEQ ID NO: 8107 - DNA, 16079 bp, Oryza sativa
  unsure (1)..(16079): unsure at all n locations
gccatggccgaagtggaaaagaaaagagagagataagggagagagagggaagaggaagaagggtcggaggtagaaaggatgacatgtgggctccacatgtcagtgggtcccatatttttttgtttgaatgacaagcgggtcccacatatattttttaattctaacgccacatgagtgccacctggaacaaataccaggtcaataccgccacgtcaggaaaaccatcctctaaaaccaccgagggtttcaatagttcggggagtcgtcttatctgtttttcagttaagggatacgaattaaattcggtgtactttaaatggagtcaaagtggactttttcctcccagcttcgctcctgtgaaatcaatgtttgtaactagatgccacctagaaaaatgagtataattgttaggaaaaatagataattgcagttcacatgttgtgttaggcttgttcgtgtcccaaacccaattgggacgtgatggacgtatttggcttgagctggagaacaagttccaagtgccagccaaacccaatttggccgggttcaattaatccccatgagaaaggcagggcagacgattggctaggacgattttttacttgtgatataagtttgctaattcgtgtgtaattttagcgtttccatataaaggctgtgtttagttggatccaaagtttagattttagttgaaattggagataatgtaactaaaaagttgtgcgtatgacaggttgatgtgatgaaaaagaactgaagtttggatccaaactttggatctaaacacagccaaagttctttttagctctgaacaacaatttaagctattccgtagtcacttcgctaaaacaggaatgaacaactatttaagctatttcttagtcactccgctaaaacaggaacgaaacaaaaaggtttttgaagcacggttgtactaattgcatagtatcccaacatggtccggtgaacagagaagatatgaaaccaagactcagaaaaccacagcacggttgtacagtgctaattcgagttcctcgtcaaaatctgactgaaaaatgaaactacaggagctataatttaggtcatccgctgggcagcctccttggcgagcagcttttccctggccttggtcttcgcctgcgacttggatcccatgacgccgcctccccacttcttcctaacctcatcgaatttgtcgttgaagttcgcctagagcaagatggtttgcagcgttagcgaatgaggtgctaaagggtggcagcagcactggatagtatgatatgatgattaaatgcacgagggatctcgtggtttctcaccttgatagcctccaggatcttgctgaactcaagcttgtcctcgttcttgacagtggtcaagcagaggacagatgcagttttcttgtgaacaatctacaagtgattatttgtgaagaatgagactctttatactagcacctataccttcaacaagtacaaacaaggttcaggaggaaatatactgatccaagacgggcttttcctttcacaatgcagtaagggacctccatcttcctgcacagggctggaagccacacaaccagctcaatcggatcgacatcatgagcaatgacgaccagttgggccttgctctgcaagaaaaccattcacttatctcaacaattttgtttgattgtttgttcccataaagatacgccttgattggtaactaacaaagatatgcataggtcacttaggttctgtacctgctcaatgaggtatgtgacatggttaagaccatacttcacaacaattggtttctttgcctcaacggttttaccttcagcctcagcctgggccctcttcaaaagcctctccttcttagcagccttgtcctcagggcggtacttgaggagcatcttaaacagattagttgctgcaaacaactatgcacataagatatttttgacaccatgaattgtaaaatataacaaatgccgcgtacagagcaattcaagttgaactgcatgtaagtcctgttactttgttttgaagtggtactatgaacacaataatactaagaacacaccagccacattagcaaccgacatcctactaacaatggtgtcaacgtatgctacgtacagtggacagatgaccaaactatactaatactaaagaagactttagtagtaatacctcagcatttcctgttcttatttttcattcacggacaaatttcctagacactagcaaacaacaaacactagtgatgaaaagcttcgttcaactgaaagaaatctaccctgctaaccagaaatgtactactaagctagtagtaagccataatcaagaacattacattacttgggcactatatacaaaccaccacaattcaaggttcgcaatgaacatatatacaggtggattttcctaaccatctcagtgaaccaagtagcgttccaggtgcaatgccaaacccgacaaatctgactgatgggacgatgaacgaatcaaggcgaattacataccgaggttcttgtcgagggtgcgagtgaactggttgagcgccgggggcaccttgaggcgctgcttgaggatgcggcgctggcgctggatgcgcaccaccttgggccacttgacgaaccggtgaaggtccttcttgggcggcagcgcgccgccgattccgaactgcttcggcctcttctcgaacagcgggttcgtcaccttctcctgcacccatcaacatcccaaatcaaaccacgccccccccccccccgcaacaacaaagatttcaagcgcgacaacggagcaagagatagatgattgcgggtaccgtcttcttcttcgccggcaccggcgccctgccgcctcgcttcggggcctgcgagatttacgatccagacgcatcagcgcatatacatgattcatatgtaaagttgcaacctccaagcgaggtctcgagataagctagcagccgctgcgagaatccaagacagcgttcacaagatccaaggaaaccacacgaaggacaccacagaaaaaagtatcaccaaaagatccggtttcttcgcagaaaggaaaccgctggagcagctgcgatagcactggcacacaaaagacgcggcggcagcggcggcgagaacgtaccatttcgccggagggggggcgctggagcttggtgttccgaacgggagacggcgaggcggggggtggagggggaggcggtggcggcggcgaaaggtggtgacgcgaggcgaggtggtgattttatagaggaagagtcgggacgacgtgaatgcttccagctcgtcggatggcgcgagcttgaggggctcgggacatcttggccgtccataggattagggtttaggaggcgtcacttgggccgcggccgtccataggctactgggccgtcccggttgcttttaaaagtgaataagtctgtttgcctccctcaactcatgtcctttgatttgcaacactcaaccgcaaaaccccatatatatatatatatatatataactctcaaaattgttgcaaatctactaccctggtggtttcggaagtggttttgtcccacgtgtcatctttgtccacgttgtctagcactctagctgagtcagcttgtgggacttacatatcagggacaaggataaaaaggaaaaacggttgggcccactgtcagacacacttctcttcttctctaggcccttctctccctcctccggaagctcgatggtcgctgccccaccccgccgatagccgttgagtcttgttcgcacgcacgaaaacaacaaaaatctagcgtaaataaaaggggatgggagtaggtagtagtgacagttgaggaaatcaagaaaagagaggataatgcaacgggagatgggggcaatcggagcgggtcattttccccgcccaccgaagaggcagtccctcagacagcggggagtggagacccctccccgagagtggagattcgaccagggggttagtcggcgagcggtgcgaggtatctgcgatcgtgatggattcgcggggcccgaccaccccgcgaggaggaggaggtaggaggttatacaggttcaggctacccggaggtgtaataccctactcctgtgttggtgttcgttgtcttctctagatcggctaagaactgaaagttcaagtgccattgatttggttttgatgattaataacaaatccaattatgtgagactaatgtttttataagcatttctttgcctagtctcatgtggatatgaaagtggagtgttggtggacctaaatcacaagaatgaaatacatggagatcaagctatatgtatcactctttctcttcatgtacatattgatatgttcgtatataatatttccacgtgattggcatatgcatgtgagactaatgttttgtttgagtattatctcttatttagtctatttacattgagacgtggagatgatgaatgtatgtttttattttattgtctatatttgataaatgccttctattcttgtataggataagctctcaatgtttaatatcttgttatgcatactcttgcttcacacaaatattttatatgcatacatttagggggagcaaatcctatactttagttatgcatgtaatcgattcaaattattcaccttcatttaattgagatctttacacttgaacatatatttgagtatatgacacttgtggtgttgattaatactcatcatttattcatatccttttatacatgcgatcggttggtcaacatgtgtaggttgacaaccggatcattgggactaataattttattgagttgaatgaaagaaataggtcccaaggattacaaaggtgttgatgctcaagtgatatcattacatctaacaataccaagaatgacaaagtgaagatattgaagatgtgtgatacaaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccgtgcgagaccatttaaagctacaagtaaccgcatcaatcatttgaagaatatatggtgaaacggtatcggcattggcgtccctcaagacaatgaaagaaagataaaaaaaaaggcattcctaatggtatagttctcttcttatttacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttggttgagttgggtagtcctctgagtgagctttccatagagtccaagttcatcaaaaaggactcccgagcgaaaagttatagtcgttttactctgtgcttttcggaaagtccgaaaaattaccggaaactccgataattttttggacaactccgaaaatttttggacattccgaaaatggctgcgaatctgagatttgcttctataagttttcggacttgtccgaaaatgcttttcggaaactccgaaaattacagtcttggcctccaacggctagtttttgaggggctcgggtatataaactcctccacccctcctttgagtggctgctgctcttggggagtattagacacatccaaagccaaatagccatccctatttccctacctttgtggtgcctctttgtgagggggatttgagaaggggagagagttggattgagagagtgaggagttgagagctagtgagcttcactccatcctttgtggtgcctctttgtgagagggatttgagaagggaaagagttggattgagtgattgagaagttgagagctagtgagtttcactccatactttgagcactcgagttcatagcaagcaattcttcgattgtgtttattacttttggggactaaggtctcctagacggctaggcgtcgccggtgagcacccaaggctgtggtgtgccacggaaagtttgtgaaggcttcgatttcgcctccgcaagggaagaaatcaaaagtaaaaccgaggagtgcatttgtgcaacctcgtgaggaaagggttgaaataggcccggcccttgtggctcctcaacggagacgtaggatccgtggatccaaacttcaggaaacaaatcacgcgtctcctctctttgtttgcccatttgtgcattctctcatattgtgcttgagcttgtttttacccgatctacttgcatgcttaattgatttagttggtgaccttatatcttatttagataccttatttgtcaccttttgattcatatacattttgtttatttgagctacaagttcatagatagtgttttattcctttatccgccgaactttttgattgagaccggaacttccaatctcatatcggaagttcctatttgaaccaaaagttctcatcattctaatatgctacgaagttgtgttaatttttaggaacgcctattcaccccccctctaggcgacattaaggtcctttcaagtacaaaggagaccttttcaggctacaaagcgatagtactcacctaagagaatccaacccttcattcgtatctagtccccttccttttatagtccaaggaggggcttaaattattacaaatctactcttagtgttgtctcatcagccgtcttgtcactgccagctggttccctaacgcagtcctcaagaaacccttcaagtcttacgattcatattaccccgggctcccaggctctgtctgagatagttgggcattcgccaatgtgctcaccacgtggtgcgtggtgggcccaacgaggcccgatctgcctgaaatagcgccacgcttgcttctttgcccgtttggttaaatcaagtggcacggggcatgtgcgacgcgtgtcccaggcgccaccgtccaaagtgactcagcgttggcgtcttgtccacttcctttcaactcagactccccccataaagctatttcacttatgatgaggcgtgctacctccaagctggatgtggagcatgcccaacttcctggaagtttatgaggtaacgccctcccgtgcttaaagaaggttgattattcttggatgagcttcttgaaggtatcgttgatggaagaatatctcaagattatccgtcttatatattttgacgcccctctaagcagaggaacgcgaactatacaaggactaaggtgagtccgaggcctaggactagaccggacctgaggcagaccttagcttatcctcttaatatataggtcttgcatgtttctatgcctttcttgccgaggaccgtagaaccttcaagggctagggtgagcccggggcccaggacagagccgggcccgaggctgaccttaaggcagaggaggggcatttttgtgacccaagccaggccccaagttacttctatacacagagttttgagacatatacataggatccctcctcagccagagagaatcccatatatgaaatcttaggtgggcccagggcctttcggaaggggttcctagctacgtcaccctagggttacctttttatttttaaatacattctgagcatgctatttatttgataatgatcctttttccggataaatgaggaccccgattcccatttcaccgacaaacggcagcaaattggatgacgctcacgctcatcgccatccttccccgaaccgaggcaagctgtccctcatgctcccgaacatgaagaggagttctccatagaatgacgccactagaggctgctgactcatagtgggagcggcaccgccaaacacgaagtcgccgttggtgccaacaccaacaccgctcggcccaatctccccgatcccatcctatcctatgtcgtctataccgctgtcgccgcagccaaacggattccatgacgccgtagtgagtgacgccggtggctgctggcgggagcgggaggagtaggcgggcgccacgtggcgcagcttggctagatgcgggaaggaggaggcagtggtgcagccatgtgatcagaggaggcaagggtgagccctaggttggggtttcccatggcgcctaggggggtgctgctgctgaggggtgctgctagggttttggcacgtggggtggaggttggcgctgctaccattggcgtcatccctaggcatggcaacggccggggggaggggattgcaggggaggagaggagtgtgttttagttggtccgatttagggagagaagcggaggaggaagggttgcatagggaacgcgtcgacgatggtggccactgatagtgggcctcacaatttttcattttattcttgtcactgacatgtgggtcccacaagctgactcagctagtctacaagtcaaagatgccacgtgggacaaaattgcctccgaaaccgttcggggagttgattttcatcggttttgggaattagggggttataccctgttttgcggttgagggatgtgtgattcttctaccagggacatgagttgagaaggggggcaaaatagacttattcctttaaaattctgcttggaaggagagggaggagacagtgcaggagtagatgtccaccttcgccgggggagaatggccacctcccaatcgatgggcgtggggtggagatcctcgccgccgtggaggccatggcgagggttggggaaggagttgatggcgacgtcgcggccagtgaggaggttgttgccggccttcctggccccacctcctccgcgcctgtggcctctacaacactgtgttacccatcactggcgccgacgccctcatcctctcccgcctcactccgctgacctccacctcacctgctggccggcctacctagaaaagagtgagagagaggaggaagggagagaagaggggaaagagagggtgatgacatggccaccctgacatgtggggcccacgttgactcagttgccacgtcggaaataaccagggttaaaactgcctaaagacccaaagtaacctagttttgttagttgatagatgacatatatctcgtggttttgtaatccgatgacaagatgagggacctgatatgtacttttttccccctaaacactcccaatgtggaagtaaacggccccattgttattcggggaataagcgaaacgacatatttacaaatgaaaaataatttgtgaatataatttttatatacatgttcttagcaatctaaaaacaaatgttaaaaaataaacttcgatgaaaaaaaccctaaaatcaacaataaactttaagattataaatttaaattgtggctgataagtataagtataaaaaaaaagacgaggccgaaaaatcacttgggcctgttctgttagtccagcccactaggcaactccaacggcggccgcatcaaacatggcgtcggccggaatcgcagcgccaagcccccagtctcctgtccccaatcggcgacgcagaacagaacgcgagcagtcgagcagcccgaccaccttgaccacatcagctgccagcagagcaggagctctctcctcttttttgacttcaaacttgcgctcgctcggcgacaagctcaccaccaccccatccttttcttttaccttcttttttttttcttttccttttttgctctccatggcttccacctcctcatcagccatcacctctccctttgcaattctctaccaaagcgagcatcactactactagtgctccttccactctctcctcctccttacactgtccctccatggaggaggcccctgcaagaagcgcctaaggatccctccattcgggttcaccccaccacaatggcggcggccaacgccggcgccatggtgcgcttcgtggcggcgttcttggcggcggtgctggtgatgatggtgccatgcgcgccgcgggcggcggcggcggcggtcggggtgaactggggcaccgtgtcggcgcaccgcatgccggcgcccgtcgtggtggagctcatgcgcgccaaccgcatcggcagggtcaagctcttcgacgccgaccaggccgccctccgcgcgctcatgggcagcggcctgcaggtcatggtcgggatcaccaacgagatgctccagggcatcgccgcctcccccgccgccgccgacgcctgggtcgcgcggaacgtgtcgcgctacgtcggccccggcggcgccgacatacggtgagtccccgccgcgctccctcctgtaatttgggaaaaaaatggattccttttttccttgagtctctcgctgcaatggaagaatctctgcgttcttgcatacctacatcttgctgtattgtgtttgttggattcttgctggcactgtgtttgtgttaatgcctacttgcctagtcaatgagatattgctagtctactgactcggaacagtgttaagtgcctctgcttgttttctttttcggaaggtcactgttcgttctcttctcttatgttgattgatctggggttattatattaatttaaggtgtatctttctcttgatgactggaagtttgtttatagattgtcaggggatgcagtctantgtaatgctccttatactgattcaagttgaatttagttagtgcaagtgcattgttccccgattgccttttatggacaattgcgccagtacatatttgtgtcggacttggaccacacaattgcactgttatttatgatgaacttgacttaatggaccctgtgattctgttgtagtcgcctttgtgtctgtggtttcagtttaatggttgaactgaaattttgctttgtgcaatacacgtccttgtcattatgtagattatgaagttacctgcgttttcaatttattttcaggcacataaaacaagacacgattttcttacaaaacttaaatgcacgtcaagatgtttttgttctgctctgagagttggcattaataaaaacataaataacacttggtaccttctgttctgtatcttttagtcactatgaagcttctacttgtcagagtagaacacaaggcatgcaaagatggtaattttctatgatacacatcctgaaaatataccatgtgtatggtgatttctagatatcatttggcaaacaaaagctctgtcaaaattctgaacgatcattgaaaatacagtattgacatgccaaaagcccaaagcaatgtatagccaccagccttatttttgttaagcaagtgctactatgtttgaagttatttctgttactttttagaacatttcaatatacaggattcctcaaggattaaaatgtgataattatccttgcaaagcatagtaaaatgtgtttcaagagacagtgtctttttccatctgctagatttcattcattgatgcacgtgttagatgccagaatatatctgcacatcatgagtccaatttagcgtttaattttctactgctttgggatgtcaaatttagcttttccatgcaatccaccggatgtcaatagttgtatattccactattcctctatctgatggagtatacactggaatagaactcaacatttgttggtgctaacacttatccattttttgttcatatcctaggaaataggggtatctaaagtagcctttgagcttgaatggccctgcactttatttgtttgtggtcatctatattgtatttttaagtcatactgtattagtgttaacatgctacccacacaaaaaggtgctggcattcagaacaggaaaatggataaagaaagattgtgggtagcagacattctttccatgtcaaaagaaggaaaatgagagaaaataagttgtatgacatagcttttcctgccgaccttagccatgatagcaatctagcaaaagctttacacccatactctgtctaattcagtcacatagatgtgctagtgtacaaaagcttttggtgcaaacatcactgcaaagctggtgagaggaagcaaataatttccaaataccaaatattaaagcaaggaaaggaaataaacatatttatctgacatataaacaggaaagtggttcttactactctcttactctctatatctggtaactggcaagggcttaccgttgcatcacttgttgtcacttgtctctcgaattggacagttgctgagtcaagcttatatgttctaacccgatcatttggcatgattaatcttctactatgtttgttatgggttgcatagggggtaaacaccgctgggaggatagctgagcggcacggctgctagggatgagagagggacttgggtactgtttatgtttttgttgttttctgtggacatgcctgcatttgtttgctcaatttcagaacacacagcagttggctgcatttacatgactacatttttgttgaaacaatttcttttgtaggtattgaatagatgaactattgaatatgtactgtttctctatttcatgaagttttaatcggagtaaccaaatgggtcatcccagcaacgatcaaatgatttgatcatgagataatccattctatgccatcgtcaaagcatgaattttacaatatgccactgacaaaacttagttcaataatataccatccaacaacttgttttctttcttatatgtcatcgccactagtcaaccattagtcaaactccgttaagggagagaaaatatctattttacacctaggatatcatgctacatgtggattttattggtcatgatccactattttttctcattgatgaaaaatagaaacagcatgtctttttatcatgtaagactatttgatgtgatatggcattgtgcaaaatctcaattttatcctaggggtaaaattgtcattttccttcccttaacggcgtttgactaacggtgatggtatataaggaagaaaacgaattgtttgatggtatattgtagaattaagctttgtcggtggtatattgtaaaccaatgacatagaatggattgttgtgatcatggaacataatttttgttttcatttaaggtggtcagcctggtaggactgtgaagtgtgaaccgagtggaaagcaacataaaatgcatgcttttctaaaaaaaaatactaatgttgagtatgggttaaattacaggctagagaatcctttatttcagaatatttgctgggaagttaatttatgtgcttaatttttttttgttgtacctatattcctatggatgtctattcgagctgtttttacttgcttgagaattttctttcttttctctgaaatctgttatgttgcttactttcttcctctgctaaatttgtttatgactttactttattcattttcttatacttgtccctaatttaaacaggtacattgctgtgggaaatgagccattcctgacaagctatcaggggcaattccagtcatatgttcttccagcaatgaccaatattcagcaatcattggtgaaagctaatcttgcaaggtacatcaaactagttgtcccatgcaatgctgatgcatatcagagtgcatctgttccatcacagggagtgttcagacctgatctgattcagattattacccagctcgctgcttttcttagctcaagtggtgctcctttcgtggtcaatatctatccattcctcagcctttaccagagctctgatttcccacaagattatgccttctttgatggatctagtcacccagttgtggatggccctaatgtgtactacaatgctttcgatggcaattttgacacattagtttctgctttgagcaagattggctatgggcagctaccaattgcgattggcgaggtgggttggccaactgaaggggcaccaagtgcaaacctgactgcagcaagggcattcacccaaggcctgatcagtcatgttttaagcaacaaaggaactcctctacgtcctggggtgcctccgatggatgtatatcttttcagccttcttgatgaagagcagaagagcacattacctggcaatttcgagcgacactggggagttttctcatttgatggacaagccaagtaccctctgaatcttggattgggcagtccagttctgaaaaacgccaaagatgtgccatatcttcctccacggtggtgtgttgcgaaccctggtcgagatcttaacaatgtcgaagaatcacctaaagcttgcttgtactatggctgatgcaccaccctctactatggtggctcatgcaatgctattggggagaagggcaacatcttatatgctttcaacagctactatcagctgcggaaacaggacgcccagagctgtgatttcgatggacttggcatgatcacttaccttgacccatccatcggtgactgccgctttcttgttggtatagatgacagtagaacatctacaatctattcttcaggtgactgttctcggaggcgctttggattgtggatcttggcgttcttggtaattgggttccttcagattggggtttatttgtgattttggttgtcgagagtcgactttaaacagctcccttgggcacacttcccatgtccttgtgaagtagcttcgtcaattggtggcttctagatgtaggaaaggggggacactgttagatgtacatgatcactagcttgttcttgggattgtgctgtccaattctgcaacttccgatcttcatgctaaggtggccaaaagctttctctagattgaaatgaagatggtagatgttgttgcaacctgattctgccattctttggtaccaccattttgatttggggcgaatatatttcttttgtagggggtatatgaggctatggtattgctgtggtcttaaagatacctcatgaaaccgctgaaattcatactggtggaatcacgagaaattgttttgtttgactagctttgtccactggatatacattagggtttttgtgcaatctcaatgcctgacatccattatattgtgctatatgagaatgtcataaaaacgccatgttttgctgttccctcgttcacaaaaatacaggtacaagaaatggcagccatgtgcccatgtcaattcggagttgcatcaggcctcttttattactcctagcttaatgccaggtcaaacgttggttgcgttcctcaaatcagatcaaggaattacatcaaaggcctcacagtcaagttcctcttccacagcaactagaggtgcttaaagggtagagtatttctaaataataaagcatctttataagcttccttttctccaatgcaagcaccttttcatgagtgctcaactggttgcaagaacaattaatcagggatggttataagcttaagcagctgctaagcaccaatgcagtaatcttccaatccaattttaaaaatattcaatatgaagtcttcaaagtttttaatcgaagttttcaatttgaaatataaaacctttatgttcagtaactttcaagttgatactttctattcaaactttcaatttgaatagcaaaaactttatgatctaaaactttcaacggcaatctcaaaaactttatcgtcaaaacgtttgaatcataattcatccaattttaacccattcaaaacttttacttataacttttcactctcaactcaagtctcctaaagtttcactcatgacatcaaacattttgcccaaatgaacaaacttttatctcaaataataaaaaactttcaatccagggatgaggtcagcttgtggccaggtctgaggaagaaagaggtgcaaggcctcatcgatgtcacggggattaggcctaggggcttgttagtaaggaggaagaaaggtactttgagctcataggggagtagggagaggggtatgggcggcatgccaaggaggaagaatgtgactcgaggctcacttacactaagacaaggaggatgaaagagtggtacaacatgatgatttgacaacaacatatttatgtgtaagtaagttcgcgtgtcaatacaattgggtgactgttggaataagtcttttcgccatgttgacaggcgaaacgattttgtgcaccaacaagttatgagtactactttgtgtaagggtatgataaccaatggcacaactttcctcatatgatcaccaaaac

SEQ ID NO: 8108 - DNA, 14892 bp, Oryza sativa
aatccattggaacaaacaatattttcaacaaaacccaataggattcctagtaggctcttcgagacgtagggtggagaaaatggaggaatggtaagaatatatgatgactttgataggaatgtaagtgtaaaacagtggatgacatgaatgcaagtgcaaaaaaaaagattgcaaaagaaaaaaaaaatctatgagtgattgtttgattagatttcatgaaaaatgcaaaaatcaaatgagagaggtggactagaagtgaaaattttcaaaaggttagagctcttgctaacttttcttcaaaatttatatgcactaaaccatcccttaggaattttggagccccattgaattggaggattcaatttccaaagaaaattttcccatggaaagcttttgattcataggaaaaggattaaaaaaatttcataagaccttcatatggctcaatttcatagggaaataagccaagaaatccaacctctcgggaactataatttgctttgtttatttcctatgatggtattaaagggaccttcttgagctttcccgtgttttctattcatgtaggattagagaaacatgttactttaatttctacggttttcctatcacacgtttcaaaggagtcactttaattttttcctacaagttgtttggcaccaacaaaaatgttataatcttttagaatggttcccattcctccaatttcacaaccaacaaaagctgaaggaaaacaaaatccttcacaccgtttttttctaatatacttaattaatcatgtttcaaaatttgtatgttttcaattccatagtcatttattttgtgctctcgtattttttttctgtttatgtatttttagtcctttgttccaaataatgagactatggaattttgaaacaatttggaatgcagattctgagaaaacgaaccaacaagagagagacgtgtcgcagacgctccatatctcaaccgcttccatcctgggtcccacctgtcagtagccacacccttgataaatacccgtgaaacccaggatcccgtgggtaactccccaccttaaaccccagacaccctcaaaaaccctaatcccctccctcccgccgccgccgccgccgccgccgccatgggctccgcctccgctgcctcgctcccggcctcctttcggcttcggcgagaacctggtcctcatcctcgacttcagctcgcagtacacccacctcatcacccgccgcgtccgcagctggggtccttctccctctgcgtctccggcacggcgccgctcgcctcgctcgcgggcctccgcccccgcgccgtcgtcctctccggggggccccactccgtacacgcctcgggggcgcccacgttccccgaggggttcctcgagttcgccgccggcgcgggcgcccacgtcctcggcgtctgctacgggatgcagctcctggtgcagtccctcggcggcgccgtcgaggccggcgagaagcaggagtacgggaagatggaggtggaggtaaccgcccgctcctcggcgctgtacggggagggggaggtcgggaagcgccagacggtgtggatgagccacggggatgaggtggtgaggctgccggaggggttcgaggtggtggcgcgcagcgtgcagggtgccgtcgctgccgtcgagaaccgtgagaagcgcttctatgggcttcagtatcaccctgaggtagcgaccgttacgattcttacacacatttttcaattggtgttatctaaatcaatcaacaaattcaattgcatttattagtcgttcttggaatatcatctctttgttgaaatgtgcattttgtatttggattgatgttatctaaattaaccagcaaattcaattgcatttatcactctttctcggaaaattatctttgttgaaatgtgcattttgtatttcggtcgatgttgtctagattaaccaacaaattcaattgcaattattagttctctttgttgaaatgtgcattttgtggagcatataagatgtaaattttgtgggaaactgattggttattgacgattgattattatttagttttgaaggtcaatttttgttttgaccttttggatagtgggtcttcttttcctgaaatagctgggtatcctttggggaaggaaaatagtcagttatatctaaacttccacaatatgaaaaggtgaaatagctgggtatcttttggggccataatatgaaaaagtgaaatagctgggtatcctttggtgtaaggaaggttgttagttccacaatatgaaaaactgcaactttagaacgactgtgattgcgctacaactttaaattttgctttgtttcgtatttcctgaattaacctggatgctttctgcttatctagatcttgtgctaagttttataatgcaactgctgtatatggtgctgatgttttctgcacagagtaaaataaatttgtgtttggggcttagcatactgttgattgtgtgttcacttgattgggatttattattatgcactcaatttggttcttttgtagttggcatgcatgcatggcaaacatgttgttaaactgtttacaccaaagcatggttatgacgaagtattaatttaaactgtttacaccgaagcatggttatgacgaactattcattcttttcattatacaaggtgacacattcaccccaaggaatggaaacactgcggcgcttcctttttgatgtttgtgggataaaagctgattggaagatgcaagatgtgctggatgaagaaattaggacaatccaaagcatggttgggcctgatgaacatgtgatttgtgctttatctggtggagttgattcaactgttgctgccactctggttcacaaggcaataggggatagacttcactgtgtttttgttgacaatggcctattaaggtagtccttgtttcattatgttatttagtgataacattttcagaatcagtatgcaatggaactgacataagaccccttgtacagatacaatgagagggaacgggtaatgttaacctttgaaagtgacttgcaccttcccgtcacatgtgttgatgcatctgagcaatttcttagcaagctaaagggtgtcaaagatccagaaatgaagagaaagataattggaagggaattcatagcagtttttgatgattttgctcacaaattagaacagaagataggaaaaagacctggatatttagttcaagggacactgtaccctgatgtgattgaatcatgcccacctcctggaagcggaaggacacattctcataccatcaaaagccatcacaatgttggtggtcttccaaaagatatgaagttaaagctaattgaaccactcaagctcttatttaaggatgaggtctcattgaaatttatttacataatatctctccatttttatcctttgcatgatcttgtgcaataaaatttacataaattacattttgatggaaagattctgataagtaaatttcaaacatatttttctattccaaaaggtacggaagttggggagtattttaaatgtcccagagtcattcttgaagcgacacccatttcctgggcctggtcttgctgtacgtgtcctaggtgatgttacagaaggcaatgctttggaggttcttcgtcaggtttgaagcctttcaaactgttgaaaaatcactacatcagctttggtatatgatgttaattcgcattgtcatttatttgtcaggttgatgaaatatttgttcaagccattaaagatgcaggtctctatgatataatttggcaagcatttgctgtgtttttgcctgtacaaacagtgggagttcagggtgaccagagaactcactccaatgcagttgctttgagggcaattactagtgaggatggcatgactgcagattggtatgtaacactgacgttctggctcttacacccacttgcaatttgttgattgtcgcagccttcgttgtgccattttgcagcagtttcttgtggttcgacagatatgttatatacattgcacagttcacaataggatacttgtgaattgaatcatgcccaccttccagtagtttgaatgatgagatgatagttcagcattcacctttatacccttgcctattgccttcttgatcatttatgttaataatttgctgcttcatttttcatcggtttatcagccgtagagcaaacaacgagagtcttggtttatcagccgtatagcaaacaagaagtcttggttatctttgaaatatttttaaattatttgacaaatacaaatttagggtgttcattaattttatatttgtctctggtgcttgtcctgtatgcctatttcttggtgtgcaattattgcttaggtctgctgatagttcgaacctacagaaatacatttgttttgtgttgtgtgtgtgaatcttttgaaatcttgcatgttttcttatgtgataactttgccctgtgaactcttttctcaggtattattttgagcgtgagttcctggtagatgtggtcaacaagatctgcaacaatgtgcgaggtgttaaccgtgttgtccaggacatcacgcaaaagccacctgcgacagtggaatgggaataggaacttcgtgctctgaattctgatgccgtggagtggcctacttttatgctgcaatggagtgggaatatcaacatattcccatattatacatatagctgtttattactagattgtttgtttacatcctttgacaaatccctatttgtcaacctgtgatagattttgaactgagaaaagctttgaactgcacttattaactgtgctttctattcttgaatagatatcttcacctttgaagaccttttatcttttggagtaaatctttgttgctacaaaattttcattatcccttgtgccccccatcttttagacaaagagatgtgccatctacaggatttggattttttttttcaattgttcttttaggacagaatcttttagacaaaagggatgtgccatctatggatatggattttttttttcatattgattctttaggatagattattggtgttgaaaactgacgttggagtcattgggccttctggttttagcggacgttggctaattgactgctcgattatggcattgcattctgaagattgagcatctttttcctttttatggccccatcgtgaaacgatatatttacaaataaaaagtaatttgtgaataaaatatttatataaggtcttcttagtgatctaaaagcaaaagctgaaaaataaactttgatgaaaaaactgtaaaatcagatttaaggttgaaaatttaaattttggatgataagtatgagcataagcgaaaaaacaaagctcttaattgcaaagcgtcgaaatatattaacactaactggcaacctttactgtggcaacctttactgctgcggtgcaggatgtgtctgatccattgttaggtttttttttagataatggataaaatccagcctctatatctaaagtggatatacacagccaaaggttgtttacacaagtgcatacactctaaaacccatgattgagaaacatgaaaaagaacaaccgaaaagaaaacactagaaagtagatgcggagctagcccgcccttccacacccccctgctgtcactgcaaccaccataaaagcttcttcattctagtctaatcaccttgtagttgccaagcaagggtctcatgctgcctgaacaacctactcatctgcggtgctaactactatcgctaccatgccgtcgtcgctgtagagaaccatcttcgtcgagctgccatagtgccatagcttatctcgccaaaagtcgtcgttgctacactgacaccacatcacacgacaaccaacaccccaaaatgcaaacgacaccctgttgccccatcgcccacctccgccgagcggccaaagcttatctcatcagaggacctccgctgccaagttttcgtcattacagaccaaaactttcgccaagccgttgtagcttatctcaccgaagagttgtcgctgcaatgccgatatcaccgcagaacaatgattcatcttgttaggtttactactgattcttcttgtttacaatttttcttgaacaatgacctctctaattattttaattctctctattttttcttattttatcattattttgaatggagttcaatggttaaaacggatcttaaaaatatatgtttgaaatatataagccatcaaaaaaatttaaatagacagtatacatgtattactcacattgtcggaggctattgtatgcgtctcgccgtaagattaattcgtgcgtgcgcgccggttagattttatcaatttggacatatatccaatgttgttttcacttgccttaactagtaattaataaatattgttagacaaaagtgataggaaaaaagtcaacatgttatttatttatattaaaaaaacagaggaagtaaaaaatgtgaaaaaccaacaggaaaaaaaatcgaggaaagtactctgcccggccagatgctcagccgggcccggtgttgaagcgttcctccggtgatctggactatttttcgcggtcaaggttagccaaatttaggacttgagaaaccgtccctgcaagcaaaacgaaacgaacaaaaaaaaaaaatcctggatcaccaagcttatttataccactcagtcacactcactggagatcgatcaagacgacgacgagtgatcatcctcatcatccatggcgagcagtaggctgttcctcgccgccgccctcctgtgcctcgcctcctccgcccaagcattcaagaaggcaagcacaaaaccacacagaattcattcatctactctataatttctgatgaatttcttgtgtcatttcgattcagtgaaacaaactgggtgtgatcctttctgatgcttttttttcttttttttttctttttttttgttgttgttgttgttgttgttgttattatggccacaatgtttgggcgcagccctacatcgtgtatctgggatcacacccgtacggcccagatgcgtcggcggaggagcacgcccgtgcgacgcagtctcaccacgaccttctaggatcagttcttggcaggtaataaactcactcacctagattggtgataatcgctattacagactgtgtttctatgattcttctttctgttcttgattgatggaaacaaaaataaaatgttggactaatgcacggacgcacgcagtaagcaaaaataaaatgttggactaatgcacggacgcacgcagtaagcaattggccaaggacgcgatactctactcctacaccaagaacatcaacggcttcgcggcgcatctggaggaggaggtagcaacccagatcgcgagtaagaagagaacatctaaattgatcaagaaccgatgagtagaatacataggacaaattcgatggcacatcaacgaaaatgtttggagttgcagggcaccctgacgtggtgacggtgatggcgagcacgatgctgaagctgcacacgacgaggtcatgggacttcatggacatggagagggacggccagatcctcccggactccatctggaagcacggcaggttcggccaggacgtcatcatcgccaacctcgacagcggtacgcatcgctatctttatttatttatttattttttaaataatagaataaaactttcgacctttgcttcaaataaactacagtcacctattacaaaattctctcaaagagagcaaatacacaggcttattgccatcttaattttgatgcgtttttgggttcctcgagctcccatggttgattactaattaatctctgccgttaatggtgatcgaatcaaggtgtgtggccggagtccaacagcttcaccgacgaggaagtggtcggcgaggtgcccaagcgctggaagggctcctgctctgacaccgccaagtacggtgtctcctgcaacaagtgagtggctccatttctcggccgtctttgaattgcagaatttttttttctttacccacctcattaatagttcatcatatacaataaagacagatttggagtttcaaatcttacagaattttcaaccaataaatacaacctgtttaaaatgaaaataaaaaagagagagagaggaagaagcatgtcaaaatatcttaaatctaggggaaaaacagttgtaaaatctttttcttttgcattgtaaccgagtattattgttctataatcaagtgtaggtgctctataactgagtgtaactacaagtttagtctacaggaacccgaatcttgatcaaagattctatggatgaaaaatcgagctaaaaaatgtatcgtaagtgaaatattaaaacccgatagattatattaaagagagcatttttgactataagcagttagtcataccgatcaggggatagtgtttttacaataaacacttgtcgaatttaaatttatcatgacactataaaattcctgcatccgccggtggattcgttcatgtgagattttgcaggaagctgatcggcgccaggtacttcaacaaggacatgctgttgagcaacccgggcgcggtggacggcaactggtcgcgcgacacggaggggcacggcacgcacacgctgtccaccgccggcggccgcttcgtgcccagggccagcctcttcggctacgccaacggcacggccaagggcggcgcgccgcgggcgcgcgtcgcggcctacaaggtgtgctggtccggcgagtgcgccgccgccgacgtgctggcggggttcgaggccgccatccacgacggcgccgacgtcatctccgtctccttcggccaggacgcgccggtcgccaccgtcgcctccttcctccaggagcccgtcacgctcggctccctccacgccgccatgaatggcgtctccgtcgtctgctccgccggcaactccgggcccctcgaggacaccgtcgtcaacgccgcgccgtgggtcaccaccgtcgccgccagcaccgtcgaccgggacttccccaacgtcgtcacgctcggcaacaacgcgcacatgacggtaatgatcacctcgtcccacgccattgttaactatagctatatccatggacgaacacttgggacgacatggctcacggtgcaagcttgtctctcccaatgctgcgtgcgtcgcaggggatgagcttggagacgacgaccttgcactctacccagctctactcgatgatcaaagccagcgacgccgcgctcgcgagctctgaccccgccgtcgcgtacgtaccatcctttgaacacgtgaaattttctttctaatttgtgtgagatgatatgagatcgaattgaactgattcgtgtcaaaatcatggcaaaaaaatctgtatggtttttcaggtcgacttgcccaccaggcacgcttgacccggagaaggtgaagaacaagatcgtggtgtgcgtgcgtggcggcgacatcccaagggtgacgaagggcatgaccgtcctcaacgccggcggcaccgggatgatcctcgcgaacggcgagatggacggcgacgacatcgtcgccgacccgcacgtgctcccagccaccatgatcacctacagcgaggccatgtcgctgtacaagtacatggactcctccaagaaccccgtggcgaacatctcgccgtccaagacggaggtcggcgtgaagaactcgccgtcggtggcggccttctcgtcgcgggggccaagcgggacgctgccgtgcgtgctgaagccggacatcgcggcgccgggcgtggacatcctggcggcgttcaccgagtacgtcagcccgacggaggtccccaacgacgagcggcggtcggagtacgccatcctgtccggcacgtccatggcgtgcccgcacatctccggcgtgatcgggctcctcaaggcggcgcgcccggagtggagccccgccgcgatgcgctccgcgatcatgaccacggcgcgcacccaggacaacaccggcgcgccgatgcgcgaccacgacgggagggaggcgacggcgttcgcgttcggcgccggcaacatccacccgaaccgcgccgtcgacccgggcctcgtctacgacctctccaaggaggactacttcgtcttcctctgctccatggggttcaactccagcgacctcgccaagctgagtgccggcaacttcacctgcccggagaaggtcccgccgatggaggacctcaactacccgtccatcgtggtgccggcgctgcggcacacgtcgacggtggcgcggcggctcaagtgcgtcggccggccggcgacgtaccgcgcgacgtggcgcgccccgtacggggtcaacatgacggtggagccggcggcgctggagttcggcaaggacggcgaggtgaaggagttcaaggtgacgttcaagtcggagaaggacaagctcggcaagggctacgtcttcgggaggctcgtctggtcggatgggacccaccatgtcaggagccccgtcgtggtcaacgccttggactgaggcgccgagattcgtgcgcgcgctatcgatccaagacgggcgcagatcagggtttaggtgttcttttattatttattttttgattgagagggataatattatagtccattatagagtgagaggctagatctcttggttgttaataaggttggatattttttcggaattgctgtaaagttgtcgacggttttttctccaaaagattttcactttgtggacctttagattattgttgagatttgtgatacttggcgttcaatatatagttatgtgataaatctttatctttactacttaaaaattctgtagtggtggtggtgactccaaccctgacagacacgcgaaacatgagctgtcagatcgccaaatccaactgctaagatcgatccccagtcccataccacgatcgcgcttctccccctcgatccgcctgtgaccccacccacaaacagcgcatcgcactccccactattcgtgcacctacctccgtcgcccgctcttccgctccccccactgccttcgtccaaccgccgctgccgcacagaggagtcctcggtgagaccaagtgctgccagcgcccgtcgcacctgccgccaggtaatcgtcgtgtcattgccgcataccgcccctccggcgacatcgcatcccccttcaatttgctgtcgccgtcaccatcgattcctccagatcgggcgtcgtccatcttgcctcccgttgcccttgcccgttaccgctgcggtcccctcgctctcggcgccgcatcgctcccctccgctgtcatcgcggtccgtgcctcgtcgctgcgccccttgaatcgttgttgctgtccatcgttcctccctgtgcccacgccaacggccgcccccgacgacatcctcgcagccccctctgcccaccccaatcgcccccaatgccgccgacgcatcacgcccgcccccgatgttgccaacgcatcgcgccgccgtccttctaccccaacccccaactgcaatctcctcagccttgccacgattgcgattccttgcctctcccattctgctaccgccaccgacgcggcccttctgcctcgccaaatcctcacctgaatttgacgcgcccttctgatcatgtgcctatcagtccaccggccacgggagtcatcttatcctaatgccatcagcctacccacatcatcaacgccatatatatccatctcgccgcgtacctcgccatcgtcgcaagcctattcgccccacgggggccttggatcctgccgcgtgcggaactctgtcgatgaagccaagcgcaagcgggctctcccttccacaatatgcactcgcaggtggagcttgattcggagtgcaccgcagccagaggtttgaccggtcattagcgtcgggcatcccaattcaccgatggcctaggtcatccgctagacaatggagctcaaggatctatctgatagatccattagagcaggtacaatagcgggctattagccagctatacacgtattttaatgaaataaaagatgagagagaagagcagcgggctacagatttgtagccagctgcagcacggactccaagacgcgatgtgtgtattacatgtgagaccatatattaatagtatagtaagcaactattatatgaattggctattagattagctataggtaaattagagccaacagtgggctatactattgaacttatagccatcgtgctgctgctgaggcgtgtgataacaggagaggagtcccgagattctcagtagctggcgacggcatgcagtggcgcctgtgcatgctagaaggaggattctttgtacaggtgagagcaatattaagggcccaatatgtgttcaaaatagattgagatagaaaatttgctctgcaaaatatatgaatttgtgtaccatactaccatctgcagtgtagatggaagttctaaaaaaaaaaatcagttgcaggggatgtcaaatttgcactttgtaccgtttgcaggggaccttcacccttctacttatactaaggtaaaccttccgagcatggtttttcagttttgtccgccagaaagatttctttgctaacgctgatctgatccgtccagccaagacagatgcacatgctgcgctgggtggttgtaggcaccatccgttgctggattttctaaggtattgtttagtagtactgccttcagcattgcgtcctaatctgttaggattcaatgttcgctcttttctgctattgttgggttttggtcttgtaatattgtttgtgatcttttctgctgtttacttgtgaatccggagattgcttagtgcataaaccgagatcatacatcatggaatttctgttcttccatacatcacgaaattttcatttactatgattcctcaactattaattattcttttgcaccctatgtttgcccttattgtctcaaaatttggacagtggttagtgtttagtgaacaacatgtaatttgatgattctatgtactccttctgtttcaggttataagatgttttgactttggtcaaagtcaaactgcttcaagtttaaccaagtttatagaaaaaaataataatattttcaacccaagataaatttattataaaaatatatttaattatttaatttaataaaactaatttgataatgtaaatattactatatttgtctataaacttagttaaatttgaagcagttggactttaaccaaagtcaaaacatcttataaccctgaaatggagggaatactaaggtgttgtcatgacattatatgtcatctattgctcagtatagcagaattccttacttagattccactgttgcttttgtttagatttgcaatagctgaatcatgcatttgttgtgccttttgcttttctgttgtgcaaaaatgtaaaccttttattctggcaagctaaggtcaggaaaaagctggaaaataccatatgcaactagctgatttgtgtcttgtggggcgagttgcagtacggttggttgtgtcagaagattcacagggccagactcaacaacgatcgtcgagaaataggattgttatgttactttagagaagtcttgttagtggtactttagatataagtcttgttaaatcaggttaagttcagatatatattgagttaaatcaagattaagttaacttgagtttgttaaggggtcaagtctatataggagatgtaatcgtactgttatggcaactaataaactaatcaatctccaagctcatataattatcgttccccttttctcttcttcctcctacgttccctcttccctatgcatattctttctttcttgtatacagagccatcaccaccgttgtatatttctttacttggtctcagaatgcactgaacgtttctactttttatgtttactaaaatagaaagcacaaattgtttatttgacaatggtattagttgtatggagtattgtgtttttaaatttgaagaaatgaggaggttaacggtttaagatgctttgcatgaacattactttgacatttagaccttgagctcaaagttgtcttattgtccagggactcaacttttgggatgtgtttattggcatggagaaaaaaaatacaaatatatgaagcctctgacttattaagtcgttgtatgtgttagttgatggcaatgcagagctggcactataaggaaatgagggtgttgaagcaagtgtagagcaccaaacttcttctgcaacaaccctatcttccatgggaaccattgtgttatttgttttgctatagaatgagaaccattgtgtagaatttcgcaaagaactttaaccattgtgtagaattttgtaaaggattatgtttcatttgatgcattaggaatgagaagcagatgaaactatagacaatctttccaaagtattgcgtgaaaatatgaagtgtatcaatatgtaggttcttaatgttccgttccattaatcaattttgttatatggggtactaaaatgtgaatactataaacatgtgaaaattataaatatgtgacataattattattagttctatattaaatattttgttacagttgatttacactcattgattatttaccatcatttcactcagtgtgatttttccccgttgcaacgcacgggcacgctgctagtttatggttaaatttgtaggtttaattgactgttttttctactccctccatttaaaaacaaattctgattacgaatatagaaataatattgaaactgagaaattgtttatatttttatggaaggtgtaggtcggaaagtttagggttaaatattgtctagtttcaaagtttatcatcgttttatagttttgcaaatattttggtatgtaaaatgatttttttaaaaaaatactcctccgtttcttaat

SEQ ID NO: 8109 - DNA, 7517 bp, Oryza sativa
tcataacaaaataaattataattacgtaaattttttgaataagacgaatggtcaaacatgtgagaaaaagtcaacagcgtcatatattaaaaaacggaggtagtaacaattatatcgtttaacatcataatttgtaggttttgttgataacaacaaaaaattagacacaacaataaatcaagtgctgttttattacgtttaggaaaatgtttcgttactagctcagaaatgtttcaaacatgtatgcaataccgtctaaccctagccaaaacattttctctatcgcgtgtgaaatatcgaaatacattagacggagacattgaaaaatcacaaaatgtacatcattaccagtaacacgattagccccgagtgccaaaatttttctgacgtgtatctattagcttgtcaagagcaaacaaatttttctgaagtgtgtgtaaaactgtcagaaaaaaattattttcctaacgtgcttttaacaccgtcacgatatcacaaatttctctgaagatgagaatgtgtatttagtatatgaattttgtacgtaccagaaaaattggtggcctagtgggtatcatttattgagtggcaactcaaattttaacactaacgatataaatagtgaaatatagtttaatttttatgacgtgactttattgttagtgagattctaatgaacctaacggcgttgacaacgtcggaaaaattcattgtgacgatcaaacctgtgaggattaatattcgtcctcatggagactagtcatgcaaactaaaattttcctgacaagcaagttgtaacgaaattttccagatggtttctggctgtcagggctagttgagtttgtggtagtgcatgtttagatcttgcttctttcttctctcccgtcgttggatctccagcctcttcttcatgggcaaccatccgatgaagacagcgaactagtcggcctcctccctcctccgccgaagcatagtggcacgctggtgcaggagctccagcgaggagggctcctcccgacgcacgcgtataccgtcgatggatatgtctcgctgtgctcgtgttgttcgcacaatgccagcattcaggcacccttcaccataaaccaaaattcctcgaaaattaaacctttttgtcacaaaagaaatagccgataatgataattagtgcctatattagttataggctatagttgttaagaaagatgaaagatacgccaatgggaggtgcactagatctaacgtaatcagctactagaagttagtaaaattcttaaccttagtttttttttttttggttgttgtttgtcatggcgagggtcttaaaaattgctagaggtttaaaatttacccattcgacatatatccaagattgaacataagctgtcgaaagggcaaatttcaaaccaagattgaacataagctgtcgaaagggcaaatttcaaaccttgagtaatttttaagacaccacggtattatcatgtatcatttaatttttgctgttaattctttcattatttagaatatatacgtacaatcatgtacaccactatgcatatgcacactcatataacagtgagagctagtgcaccctctttttttaacacacgataaagaggccgattccaataacaaatccataaatatagctaaactctcattaaaaagagcatccatgtgtatagttgtgaacatcatttattgtatctccaggtgttatactaaagtaatactgggcctgttcggctgcactacagggggctacgatgctgcagcctcgcacagtattttatgtagcgcacactactagaaaaatagtttttagaggcagtcaaaaacagttatcgcaggcgggggagacaaccgccgctatccaattgcctgtgaaaataggtgatttttgcaggcgggtccgcgacccacctgcgaaaataattttagggaacaaaaaaaaaatccggcgctacccgcaggtgacgccgccggcgccagcatccccctctgaccgacggctctccacctctgtccggcgccgctgcccgagggcgaggggagcgccgcctttgccgccactgccggctggctcccttctcagatctgggaggggagcggctggtgctgtctgtgcccccgcggccgtcggctcctcttccgccgccggcgtctagggggaacgaaaggagaggattagtgcccagagccgccgcctcctcctccttgcgtgcgccgagacgccgacggctgccggttgctcctctccttgcgcgcgccgaccaggccatcggttcctcctcctttgacgtcgccgcggtgtcacgccctgaagttccacctcccttgctttaaattcataaaataaatcgcctaaagaagttgcttcaaattaacctagagttgaatccttaattaataaatacatttaataatcgaattcggcgtggtggaattttttttgagttccccatgctcaaatatattaacagaatttttagtggaatttttaaagccttggaaataattttaaccaattaaaaatgagcatgtgcaatatttaatcctaggaaatccgttttctttttctctttttcttttcctcctttttccctcttcttgggctgtcggcccatcctttctcccgcacctctccctccttgctgggccggcccaactcccctcccctttctctagggtgccgacaggtggggcccacctgtcggtcatcccctacctccagccgcccgcgcccaagctggcaaccgccgcccacaccgccgctttccccgcttcccgtgccccactccgcccatgctccgcgcccacgtcgccacccaccttccccacgccttaccgcctccgcgcgcgcgcccgagagggcgggattcgattttgaatccgcccctctctctctctctccaccccacgtcgccggcgccactcctccaaatccggccacctcccggcctcgcccgcttctcactcggctataaaacgccttccccgagctccctctctcgtttcccctactcgccgccttctcccgtgctctccaccgcgcccgcgccgctcgccccttgcgccgccgcctgccactgcactccggccgcgcgccgtcgccacgccacctgccgccgcctctagctccgccgacacaagggctacctcggccgccactcagttgccgcctactgccgcctccaaccgccactagccgtcgatagtgccattgccgcgccgctttgttgccgccgttggcctcgtgggtccgagggccgcctcgtccatcccgcgcaccccgccgtccgccgcttgccgccggtgttcgccgtcgtctttccccactccggccaactcacggtgaggcgctccctcctgctcgtttctcctccctctcccccctagcgccgggccgcgccgctgcttcgcccgtgcgccgtcgccttcggccgacgccgctgccacccgcgccgccggttgccatcgccggcgaccgctcgccgccgccgccctcgccataaccggccagtcggccttgaggccgagccgagcccggccggcacctccctcccctcccctttgagccaccgcctggtgggacccacccgccaggcgcctcctcccctcttttggagccgctgccagtgggacccaccagccaccccccccccgctgacgtcagccctaggcaatattgcacaataaataattaatgacttttttcttttatagtaaaaacacaaataatcttcttaaattcataactaactagccacatggttgcgctttgcgcaactctaaatacatgtttaagaacctgtgtcaatggcatccacccatacacaaacacaatcatctacgtggccaagacccctgagtaacaacttgatcctaagcatttatattgtgatgcgtagtagtacattataatgtacatgcccacaaaaaatttgatcccaaatctaataaaataacaaaaacaaatgtagtagctttgtgttcttccaccaaatgcatggtggtaccgtggtattcacctggaaacataaaaaatataatctttttaagagcaaatcatagattagcaggaccagttgatttatgttcttccaccaaatgcacgttggtattcacccacaaaaacaaaaagtatgaaattcttatgagctaatctcatatgagaaggaccagtaaggacatagtctcatgtaaaaatgatagaaagatatgctcctcaatttgtacaatgattaatgagtatggagtactacagtattacagatatagataggtgtcatatgataatccaatatctaaagctctgccaaatattccaatagcagtatgcatggtattgcctttggattgataagaaatgcacctaggcctattaggacagtaaagaatctacgggttcgtggaaattaccataataccgttaattaaacttctaagcaagatttatgggtggtgcataatcacaaagctagcaattaacgtattataattctttcttgtaaatatgccttgtttaattttaaacgagaacccattcttcctgtcgacacatcattcacacttctacacacacacaaaatatcattgaaactcattgctcttatagctcaattctatgcttgatcaagtagtctaagacattttactggcacttggaaaaataaggataggtgtaaatattacttaccgatggtctgtacagataatttatttctccctcctccgctgcgtacccaagcataaggccccaccactgatgtcgatgatttaattacaacgctgcagccgtgcagtgcctgctgatgcaaaataaaataggatcagaatgaagcatcctaatacgggccgatgttggccaaaactacatcttgtgtgagttaaccttttttgtttaaacagttagggttatccctaaatcaacatgtgctactgaactttctactgttgcaggcgcagggaaaaataatttcagtcgagatgtcttcagtagcagcgatataaataacttctagaaaaaaattaaataataggaatcaggaaggctataccaactaaagctggtacccgaataattatcctttttaatagtagtgcacacaatttagcaagatagaagtgtatacattattgcagcccttatgtaaactgctgaaatcctttccatgagcaaatatttttctaagtcagtcataaatgaagatagtaatccactctccatgaatagattattagtgtaattaagcattggtgacttgagctgtacagtatatgcatctgtaaattaatactaactataatcgatttacatgagtctctaatttgtctggtccctctgaagctaaagctgggatttttcttttggtgtatttgtttgtgattcatgaaacatttagatacacttcatcatctgttgtgcgataccttagagaatcatttactttgagtataggtaaacagatctacattctacaaaatatttttatttgctgatacttgcagttctactcagttgtcccaaacttgattttctcaattgtaattatagccaatcatggagcctaaattgatacgatttttgggcttatgaaataaagcctaataaagataattaatattggaattcataaggtgcatacatataatacaaatcaatatagtagtatttgaaaggctaacatccaatcaacagtcaagaaaggaagatagagaaggaaacagagaatgaggaatagagaagagagtgaccttggttgttctgccctggataccgatttggtgaataggtgtggacgcagctcctgcggataccctcctcctcgccatcgctattcatctgtcaaccctttccccccttcttcagggtagcgggagattagaggtggatgtgatgcgccggtgccggtggggtatacggcggcggcaggggtgggatggagccgcggtgatgaggggatgagtaacgccggcaatggagacagagaggactagagggggaggtagcggcggcttgggagaagaggcggcgcgcggcggctgggcctcaggagcggaggcggcgtgaagacgagaagagtcgcgttctttcttcttctttttttaccgcagggacgtggaaggacctcgttgtgaaagaaatttctagaaggaataagaagatatttcgccgatctaggatctaacggcctgaaactttctgaataggaatcggacggtccatattttgttgatgacgtggctcaatgttgttttgagaaactttaataatttcactacttttgattcatccgagctccgtttaagtccattcaagtctcagtaaattcataaaaaatgcatagaatccattaaaaatggtgttgtttcctgtttcagtagtcttatagcatgttttgcttgtgtgctttggttgtcgcgtagatttcggttgttttgtcgatccgcggtttctcgaagacgttgctgagacctcatcagtgcaagagcaaggtaaatcatgcattacaattgatcatattgtacccaccttacaaatgtcccgcatttctattaaatgttgcattgttttacaatatcatatgggatgggtcctactactcagccatatattgtttacctgatgccattgataacttgggtattaaaatgattagatgttggtttagggaatgcttagccatgcttagttcaactagtacacaaagggggaatcacattaatgcatagactttgattattggtatagctttggaatagtaccaccgcaatggtgttagctaattaaaatacactacatggtgggctgtgggtgcatggttttgctaatcgtgcccatgacgattaaggaccggttcgcgagatgccctggaagaacttatcgtacttaccataagccagcgtgggcaacggctgggcttgtagtgtagctttcctctagccgacatacccaggttagggtgggtatgatggagttgggtcggccggggtgttcggttgatcggcttccggattcactgtggcacgagaggggggctgcccgttgcctgctggggacgggggcgaaccttgaggtgtggtgcgatcggttagagggggttatgcgaagggtcctatcacgacctctttccggtatgtcgtggtggcatgtcggcgcacagatacatgtcgtggggctgtgtcttgtgggtacagttgtatacctctgattagagtaaaactgttcgaatagatgtgcccgcggttataggcggtcgaccagattcaccgttgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgaggatttgtgtatggacaagttacaaaggattcacttcctttccc

SEQ ID NO: 8110 - DNA, 26286 bp, Oryza sativa
tctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacagtagcccccggcgttatgccagagcaatttcccttctcaagggaagcggtcaggtgtgacgccacccctaaagcctggtgacaggtgggaccggtctccgtagttgggcacaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaacgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccgttgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccaccattttcttctttcttcatggatgtcctggagttctacgatctccagatggcgcacctcacccccaatgcggtgatgacattggccatcttcgcgcacctgtgcgagatgttcattggggtgcgcccttctcttcagctgttccggtggttcttcaccgtgcagtcggtgtcaccgccgtcggtggttggcggctgctacttccagccgcgggggccggtgttgaaccgctacatcccttgcgtcctccgcaagaagtgggacgactggaagagcgactggttctacacccccctcgccaacgaagcgcgcctccgacttccaagccaggccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccctgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccttcgcaggttcgtctcactctcattgcaaccatctttctcccaaaaggaagttttttcttactcattttgttcgttttctggttttttcttctgcttcagcgatgtcccgtcgcattcctcccgccaccccaagtccggccagtccgaggccgaagatcctgcggccgcagaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggttcgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctacgccgaggaggagtgcgcgctccgtctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgctgacctcgaggagcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccgactccgacgaggaggggaacgccagcagtggaagcgacggtggcaacgaggccggcgacctgggcgcgtcagaatgagcccccaggcccccgccaatctccaattttttctttttgtatagatcaacttaatctgcaatcaaaaatgatgaaaaatttctatgttaactttattttgctatacatatgagttgaggatgatttgtgccgtggttcttttgcattttagcttgatttaagggctcgtgctcaagtccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaaccgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgctcgatgttccacgggttcggcagttcagtgccgtcgcccgtggccagccgtacggagcccggccgggggacgccgatcactcgatacgggccctcccacattggtgagagcttgctcagtccagcacgcgtttggacgcggcgtaggacgaggtcgtcaacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaagcgggccgtgatgcccttaatgaatttaagagcagagtgtttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggaatgatctgcagggcctgggccggctggtggatttgcttggcgtggaactgacacgctctgcatcgccggaccatgtcgactgcatcattgagagctgttggccaatagaacccttgacgaaaggccttgccaaccaaggtgcgcgaggcggaatgggctccgcattcgccttcatggatatcggcaagaagctcaacgcctcgttcctgaggaatgcatttcaggaggattccgttagccgcacgccgatagagggtcccttctatcagcacatagcgtttggaaatgcgttggacgcgttcactcccttcgcggtcctcaggtagagtcttatctgtgaggtatgcttggatctcagagatccaagcaatcaatctaagggagcttggagcgctcccttcgggtcccgagacctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcatcggcaatcatattatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagtccggccgccactctgagtccggcaaggagtccctcatactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtgtgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcgttcttcgtccaagtggcctctcggggcgcactcgtcttctgtgccgatgtcctcggggtcggaggatgacaggagcggtcttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcgcccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacgcacacttatcggggttcagctttatgcgggcggagcggaggttctcaaaagtttccgctagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcgtctagaaaacacaaaaggtcgcaccccgcagtggagtcgacggtctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgtgactttaaggtcgccacggacagagatggggccaccagggcccggcatcttcatctggaggtaggcgtagtggaccgccgccataaacttcaccaacgcgggcctccccaggaccgcgttgtagggcagactgaggtccaccacatcgaagttcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgccttctgtcctcctcccacttcctcgttcgctcagccaggtttttgactgcacgacagtccgcgagatcgtggagggaggtattgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgtcactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcagaaccgctgaatgtacgagcgaagcgactcatcatcgcctcgctgtactgcatgcaagtccgcttcttcgcctgggcgcggatatgtgccttggaaattcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcacggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcaacggcgtggattcggctccccgtcgtcgccgctcacactcggagagaggtcgtgcgcttttccttgctcggccattaggctgaacaagaaaaacttggcgcacacggaagagtctgagagctcagaaaacacacactgagccccctacctggcgcgccagatgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacaaccgtgattagtcttacccctagttagctatcgaactggtgtagttcaggtggttggttgggcctgttgcaacgtggtgtagcgttagacaatgattggttaatattgattaattactacaactgttttactgctttcaactactgcttttaaatgctagctttatgcaaaaggacctttagcctcccttggatatatcctgcatcatacctcctcttccggtatgacttgctgagtatagtgggtagtactcagtcttgctctcttttcccccataacagagctgaagatcttcctagttggagctgtctcgttgaggttggttttgtcgctgccgtcaagtattgcctgtggaatggagtcgcccgctgcaggagtcaagtcttcaggcttagctcgcttttatcttttccgctgcatctgtaatcttttatatttttgtaagacgtggagctgtatgtcaacaattgtcgtttgtgtaccctggctggtcctggacaggggtttaatgcacattcagcttagaaattatggttcgtgagtttctggcgtgacacgcggcccccttcctcccgctgccgccaacctcccgccgccgccaccgccgcacgagtggtcaccgccctccccccgccccctcaggccagatctgggagggagcgagggaggggagcgccgcgggccaccacccccctcgggccagatctggaagttagggaggagccaggagccgccaccgcctccaccggtagccactgccctccgccgccaacctcccgccgctgccgtcgctgccgccgcacgcgtggccaccaccctccccccgcccccctcaggccagatctgggagggagcaagggaggggagcgccgccggcccccgccctccgccgccgcctccaccggtagctgccgccctccgccgccgtcagcgtcggggagaggaggagaggtgaggggagaggaaagagctgagagctgaggaagagaggtgaggtgaggtgcgggagagagctgagaggtgagggaaagaggacttagaaaaaatctagcgtatgtagcctctatttatattccctatgtattttcgcaggcggaccataaggtatttttgcagccgaccgtttaagtggtccgcctgtaaaaatggattttcactggtgggcagcgggtttcaccctaatttacatttttgtaggtggctatttggctccgaagatcatgtccgcctacgaaaataaatacccaacgtcggcaaaactgtttttctagtagtggcagctgcctaactggttgtgttacagccgctgtaagatgctgccgaacatagccacgggtacctaggtggatttaaataaatgttttttaagaaaaaatttgcagatgtttattcatgccgtttgttgtttacaacattttcaatatgattgagtcatgttcgcagttctacccctccagggtaaaataacaaaaagaaaatctgacagcgctcggcttcagttttccattacaaaatcgcatctaatttacgatggtaggagcttttcaggttaattgcaattgtataatattattgtagaacacaaattgtatacgtaaagttgagaacgatcaatcactcatattgtcatcttagaaaaggaagaatcctacttaccccataccaagtgtcattattaaacgtctaatccaattcagatctgcaacattccacaagattttcccacaaagctatgccatcagatactacctgcccctgtactttcggcaatacgtttaccttatccactgggcatgccgacgccattagtgtcactgtcatgccagcctcacactcattccagctcaagctaagcaaagctaaccaacacattctttctagcattatccaaatccggcactgcgagcacttgccacatctgatcacatcaagagattaaagctaatcccaactcagatgtgatgcatcaaattttatatttttgggtcacactcgaacacactactcccaaacacttgaaaccgacatagtattgggtggtgacaagagattgctacaggcccagccattcattgtccttgctgtctggtctcccactgctgaagttagctggctgtttcatggataagattggggggaaaggaacatagccaaaaaagggaactggaaagggagaaaattgcattttgtgtgtactatgtgagatgctgtgatctgtggttgtccaaatatttgtttggcttatcctttgtaacggtttttgtgggtatgatgaacttgaggcatgaaagggcgatatctagaggttgtttgattctttgtaattgtttgtgtcgccaatttgggaatggtaaagatttgcccattgccaaaaaaaaaagaagcaaatgtgcttgtttggattgctttataagtatttcataccaaataatttgtcaatgacaaaagtttggttacaaattaaatgagtgacaactttgccatgtttccctaatttttacttcccctttctcgttgaatcgtctgataaatttaactgtttcatattataggtcgtttgacttttttttcttagtcaaagttctttaggtttgatcaagtttattgaaaaaattagcaacatctacaacaccaaattagtttcattaaatttaatatataatatattgtgataatatatttatttttcatgttcttgtactagatcgcacctatctacgatgtttctataatgtagacacaatttactctttttacttctttgattacaacaaatgaaagaattactgatatgtagggttgaaagtgattcggatagtctccgtccgaccagacctttttttcggattcggatagtttctattggatatatccggaaattttcaaattcggaaatgaaaacgaatatgatataggtgatatccctcggaatcatataatggtcaaatactatccgatatttccatcggattcttatgcaaaaacatgtttttcttttctttacttaggtggaacaaaacaaaccatatgaaaaagaaccaaggaataacaatcaacatacaaacaaatggaaaaattcaattctgaaaaataaccactcgaattttcaaaaactttaaattcaattctgaaaattttaaaaagagtaaattgcaccgactgtacaacaacttgacaggtggtgtgtgatacaatgtaagaacttgagaattgaacgtctgagtgcaacaacttgtactaggacgcacccacttgtcaagttgttgcactcagacattcaattctcaagttcttgcattatatcgcacaaacctatcaagttgttgtacagtcggtgcaattgaattttggtatatcaacttggctaagcatatggtaggcgagttttttttcacgatgttaatatgccattacatagtaatcatacggatattaccttataatattgaatttaatctttaagaattatactgcatattgtagtacaatttacatccaattaccttatcaaatatcaaccaaaatataataatttctacatccagtttaattgactttttgttattagttattaggataaaaatataaatatacttatataaatatacttatataaaaacttcataagtgatcgtataaattcaaaataaatatttaaaaattgaatttataaaaaaagtactccaaataattaagttgtcgcataactttttaatttattgtatcaaaatcgtagcaaccttgcaaattgttgcatttatacgatcacttatgaagtttttatactaaattgtacatacctgccaagttgttgcactagaacgctcatttctcaaattattgtaccaatttgcacccacctgccaagttgataaaccgtagatacaatttactctttaaaaaacttttaattcaaaaattgaaaagtttcagtttgaattcaaaactctcaacccatctttaaaaaattcaactcaaattctagaatgtttaattcaatttcgaaattctcaactccaattgaaatgttcaacccaaaatttaaaatattcaaccaattttcaaaaatttcaatgtgcctgcgaaaatttcagtgatacaattaatttatttgtttcaggataacataaatttgtatagaaaataaacacaacattttctatctcccccttgcccttgcaaatagagataaaatttgaaaatgttgatgttttgttttttaaaactaatggctacatctcttcctcgatttaagaagcttactttgaggggtcttgatattttgataattattcgtcaccgtattcgtttcgattcgtattcactccatatctgtattcgacaatatttgattatgttttcgtatccgggtttctgattccgatttcgattccaagaaaaaatatgaaaacaaatatgatagagctagtttccgaccgtattcgatccgttttcattcctactgttatgtttgtttaaaatatacttcaacaatattaaataaataattttagcttctgcaaaattactaaataaaaagtactccctccatcatgtactcatttttagctcattccatttgtcccaaaataaggttatttttagagtaatcattgtattagaatttgtgaaaaatagataattcttatattgggagtcgataaattgaaaaataattgtattgagatttgataaagtaatggtattatagtgttttggttttgtattggtatgtattggatggatgaaaaaaataaacttagggcctgttcaggtttctgccaaaataaacctttctaaaatttggcaatgtcaaaattttaataagttgataacattgccaaattttggtagaatcggttaactatgttattgctaaaattctttagacattaccaatgtttggtaacgaactgaatacatctacatgtttattaatttttttaaaagtaatatagttcgaaatggtattaatctgaacaagcttttaatttgggagggaggatgagggagtagtcaaaatgtaaacagcaagtcagcaacagcgaacaatcttatctatcgtgaaacagaggtgtaccagcacatgcatcatccacccagacccagagtgtcccagttaactttagaaaccagaattaattacgccagctaattcgtggctcaacagcaaataaatgaccaattagtctggaagggtagcaagtggcaacggtggcgaggtttagaaaagactgaaaatgcacgtacgtacgccagtattacatgatctgcaactgccacttaaactacgaatttgtaccatgccagatttactgacagcgaatcactttttttttctctatggagtagtgctaatataattaacgttaattaatgttgggtggagagtaattaagcatgtctgcttttgtgtactgtactagctgattccagagcattggcgtccctttttccgtcacagggcattggcggcacatgtggtttaggtaacctcacaccgtcacacgtactaatgacatggtcctaacacatggtagaatgataggctagtctactggtcattccaaaactacactttttggctttgtttagaaaaacaaaatattttctctgaccaaatatatgtgacaagagcattaaaaaattaaatttaaactcgtgtcatatccaaataaaatttaagaatattttttcacgattttgcatttacatacgaagggcatcatcttttcgcttatgtttatccatatcagcaaaaatttaaattttaacattaaatttggaactgattttgtggttttttcatcgaagtttatttttcagtcttttaattagctaagacacatatataaaatttttatttacttttcatttgcaaatatgttgggctagaattttgaaaaaactagcggaaatatctgcgggttgggatcgcgccacccaacatatgaccaaaacttcttgtttttttttttactcacaataccatgcgaccaaaacaccatattaacaccgaataaaaaaacaccatattaacacgagaaggttagtttaggcaatgtgaacgatgcagtcacgcggataagctatttgtggtaagcattcactgctggttggtgaactatgttaaatactcaatctatttcaggttataagatgtttaaactttgatcaaattaaactgttttaagtttggccaagtttatatatataaaaaatattttcaacctaagctaaatttattataaaaatatatttaattattaatttaataaaactaatttggtaatgtaaatattactatatttgactatacacttagtcaaacttaaagcaatacatgttataacttgaaacggagggagtagttcatttgacgagttaataaattcattcttatccaacatatattaaatcaaaagagaaatacgagaactaatagtgtgtaacaaatgataaacaccatgtgttacattttgttttgtcccttttcacacaaaacagcacagaattgtcctaggtacatatagctgtatagggcgtgctgtacctaaaattgtaaattggcaactggcacgtttaattttttttgaactttggcatgtttaattttagtacaacacgtccagtaggattctcacgtgatgtacactccatgaggaataaaaaaggtgaaaggtcaattataccaatcaaattttaaaaaatatgaaaccaaataaaaaaagaaatggataacctccagcacagatattctcatctcaccgaccaaattccccaaaccccaaatcaaatccaaaccgaaacctctttcctaattaaacgaaaaacacagggaccaaactgtaaatgcccaccactccctcccctaaacttcagccatgacatgagtgctcctcgcattttcatcagtggagaggaaggaagagaggaaaccccattgaggaggaggaggagatggtgaggcggcggcggcggtccgtgctgctgctcctcctcgccctcacggtgctctcgccgctcgtgctctacacgcgccgtctctcggcggcgctgaaccccaaccgtgagcgcatcttctttttctcttgttccttttcttttctttctttttcggtgtaattttggtgtagagattgccttctgtcgggcggtttcttgggcattggggtttatggtgttaccgtgtgatttcttgcagagaggagggatttgcctggcgaaatcgtgaatcaggtgcgtgtttctcggggttcttgcgagggattcgggagatttgtttggattttgatgagaacatttttttatggatttttttttgttttgctagggccgtggtgttaaggctagcaagctaaatgcacttcctctggtaaattttgttattgctcttcgtttcttcattttttgtttattttttcttggcgagggcgacgaataaaactggaggtttttttcttttggggttcaggaaactgtgggttctttgaaagaacccgttggcatcgtcttctcggaggagtcacgcgaatctgcaagcaaatcgaccgaacccgatagccaaggtctgggattttattttcttggtcctgtttgcatcttgtgttcctaggtccatggtatcgctctgtgaaattaaactatgatattttgagtttgtgctctgagttcgtttgcacgccaactgttcctagaatttctattgaggaaggcaggggagcacaagaaccgggtgctctctgaggccacggctgctgatagtgccagatcggaagacgatgacttgatcgagcaagtgacaagcaaggatggagaagatgatggcttggcgacggtgtcagttgatcagcagcagataaccacggcatcccaacagcgatctgcttctgaggttgatagtttattattgtcaagtttttatgtgcatcttaccaaatttagttatgttgtcacctgtggattagtcatctggacctttgggacctccgcatgtgctttagcttctatttgggattgcattattagtgttggggccaaactctgaatttgtggtaggtagggaaagtcttttttgtgcctattatacctaacttatcaatatctggtaatgttcctttcttgtgaaaagacagtggctactcatatcttgacgtatctttcttttcttgtcgtagtaggtcaaagtacctaagatgcaatgatgcattattttcaacattaaagaatgtgttggtaaattgttctgctcatgtcgttagaggaaaccatattttttagttgaacatgaattaatttatgcaatgtagctccgtacaaagtaactcagttgttttgttttcaaatgtgtgggtaaaatgctgtaagggtgtccttcagaaaagatgatgatcatagtttatctgacaatgttaatgcacagtttactgtaacaagatttatgctgttaaacaactagactaatgattaatcatggagtatgtcaagattcaaagcatttatgtttatcaattttgagaatgtgtgtatttggttcagttacggtcttctgcttcaggctaaagttaagtttctttgttatggaatgttctttgtgcacgcttttgttaatatgcttgcctctttcagccattccttaactttcctgtaagttaacttgactcccaatattcttgcctttcatgtttgtccacccaaaccgtttcttaagttgagattcttgtaccaactttgcaaggcatccctaaagtgtagaatcttggcacctgatgtgaagtccatttcacattatattccctcaacctttacaaatacaaggcacatagcaacctagacaaagtttcgttttgggaaatgaaactaccagacatttaaaaggctactcacatgagcacgtgcacacacattttcataattccttttgttgagttgactagaaatttctagatttggtagatctgttcacatgtttgtgcatccatatgctggggtcacctaaactgtagcactcatgcagaatttgtgccattttattatcaagtaatggtatcataattctgttcttgaatttcctttttaacaaaattcatttgccatatgttgagataatgatttcttgctaaatggtttcttttttattgcatggtcttctatttacaggcaagttcattggagaatgtgcctgaacagacatccatggaaaactctctggaaggaaacaaagatggtgctttgcttgatactagaatccgcaatatcagggatctgttaatcaaggcaaaggtctaccttggtcttggagccattcgagcaaatccccagtacctcaaagacttgaggcagcggattcgggaagttcaaaaggttcttggtgatgcatccaaggactccgatctacccaagaagtaagggtttcctatcctgtccgattgatgtatttaacattgtagctagttattatgttcaggatagcagcctcatcaattgttctgtaaccttttcatctgtcttgatttgatcagtgccaatgagaaggtgaaaacacttgagcagacactgatcaagggaaaactgatgcaggatgattgttctgttgttgtcaaaaagcttcgagctatgcttcactcagctgaggagcaactgcatgcacacaagaagcaaactgttttcctaacacaacttgcagccaaaacccttcccaagggtcttcactgcctccccttgaggctagctaatgaatattttttattggatcctagccatcagcaattcccaaacaaggaaaaacttgatgaccccaaactatatcactatgcattgttctctgacaatatattggcagcagctgtagttgttaattcaacagtgttaaatgccaaggtatgtaatattctgtcctagtttgaattacgctggaagatgatagcaagcatcatactgagtagattttattttatttgcagcatccttctcatcatgtcttccacatagtaactgacagactaaactatgctccaatgagaatgtggttcctctctaaccctcctgggaaagcaacgattgaagtacggaatattgaagagttcacatggctaaatgccagctacagcccagtgctgaaacagctcgaatcacaatcaatgattgattactacttcaggacacatcgtgcaaactcagattcaaacttgaagtacagaaacccaaaatatctttctattctcaatcatttgcgattttatctacctgagatttacccaaatctccacaagattgtctttcttgatgatgatgtagtgataaagaaggacctaaccagcctctggtcaattgatatgaaggggaaagtaattggtgttgtagagacttgtggagagagcttccatcgttttgatcgttaccttaatttctcaaatcctgtcattgtgaagaattttgacccccatgcatgtggatgggcttttggaatgaatgtctttgatctggctgaatggaggcggcagaacataactgaaatctatcactcctggcaaaagcttgtaagattcacatattctttacttccttgcataaataaaagtacttgctagaaatatttctatctattgaagccaagatacttcttaacattcaagaaatcgtgttgtttgtagtgagtagttagtattgaaccaatactagcttgagggctgtatgcctttatccctgtacgtaaagaatgtgacagcgtactaaattttttttgaactgctacatggctggtttttatgtacaatgaacatacctatttttccgcttaaaccatgtatcaaggcttaggcccactttgattcaaaggaaattcataggagttttagaggatttcgttcctataggaatctttcctatatagctctttgaatcaaaggaatgaatcctatggaatcctatgaaattcctatggaatacctaataccatgctagttttggaggaattctaacatgaggttttacctcatggaaactttcctttgagtctttatctctcctctaattcctgcgtttttcttgtgattcaatcaaatgaccattcctgtgttttgcaatcctcagttttacacttacattcgtatgaaaatcctgtgtttttcctattcctacattttctcaatcttgtgtttttcctattcctacgttttctcaatcctgtgtaatcacttgtaatctatgaaattacctttttagaaaggtttgtaattagtgtagaaattatttatggaaatgataactaaaatatagtgtgtatcataagtgtcaggtggctttgagtgcttttagtactaacgttgagttgtgtactttcatgttcattttggttcacatatgtactgaaatatatcaatctttgcttgcagaatcaggacagattactatggaaacttggcactctgcctccaggtttgattacattctggaataagacgcttcccctcaatcgttcatggcatgtccttggtcttggttacaacccgcatgtgagcagcagagatattgaacgtgccgcggtcatacattacaatggcaatatgaagccttggctggagattggtctgcccaaattccgaaactactggtcggcatacctcgattatgaccagcccttcctgcgggagtgtaacatcaatccttgaagaaagatggcaccttcaatgatccacactgacataaccaatagttttccccattcgtgggtcttgtgctctttagtttagtttttctagtatttgattgatttttttttaattgtagatgtcagttgttaactagatttccttgccacctgtcctttgtatccctacttctgcataactgcagatatggttgtagatgttttgatattacattctctcctggggcaggaaaatgttaaatagtgtgattctcctgtgtatggctttttaatccctacttctgcataactgcagataagttgtagatgttttgagactgcattctttcctggggcggaaaaatgttatatggtgtgattctcctgtgtatggcctttttatctacctgaaagtttgttgcattgtcacttgaaacttatggaagtgtattccagtccccaaaaaaaaaaaatgaaaactggatattacaccaaacacgacaggttacccaactgtttccaccatatggtttgccggacgtgagcacatcgtgagtaaagtctagctcagctatttaacggtgcatttggatgtagtacactacttgcttgggctctggacacatctttgatcagatttagcaagttctccctatgatgtcaaatgaccgtatctaatccttgcagattattgggatattgatttaacttcactgccgatccaaagggattgtgtacatcttttctttatccaaaattatgcagccgaagtaaccgatggtgagatgaatagttcacggttaaatgaagggagatgaagccactgttttctaaaccgagccggattttcctggaccatttttatataatcttcttcgtgttcttattagtgcatatttgagacagtttagtatttttggggaatttccaatagaattgtgcatctgtttattaagactttcagaaagaaataaagaattaataggttttcaatttcaaaattggatatcatgccgggggtgaccgaaatttcgaaaatttctggctgaaattttttgaaatttgattgaatttgaataaaatgtgaccaaattcacaataatttgcaaaaaaccgaaaatttcgagcgatatttgagcatgccggtggggggggcgaaattaccgagatttcggaactttcaaatcctgcgtcacaccacaccaccaccacaatataaggaaacacggccacaccgagaaccttcaaaacaacgtctccaaaaagattacaacattaaaaacgccaccatcgctcatcccgaaacgatattgttttctcctagaggataacattaaagagggggaggaaggcacctcgacaaccttctcaagagggttacggcggcaaaagacgtcactgctgtcggataagaattgggctaaggttttgtcccgagccaccggcgcggggacgacgcgacacacgaaggggtatccgacagcagcaactctaatgagatggaatgatggatcgaaccagacggcttttgagacagtttagtctttgttccaattaattaagcatgacattggggtattcacaagttgagtgattcagaaactaatgccagtaatcggcagctcacttataccacgtacagaatccactataattaagcgtcaagggagaggggaaaaaaaaatcaaagcaacaaaatcgtctaagaaacgtacatgaaggagaaaagaaaagaaaatcgtctaagtagcataaagggaaaagaaaagaatcacaaattaattaagctcagtgcacgacacattaatcggagctagctaagctagtgtctttgttgcttgctaggtgcatgcttgccaagacagcatgcaaaaaattaacgatctcgtcacagatcgtcgtcatggggctacgggcacggcttggggttctggaagccggcgtacttggccctgacgttctcgcacttggacgacgagacgccgttccccttgtaccgcaggtcgacgtcctgcagcacgacgccctggcacggcaccccgcacttgagcagcaccgccacctgcgtcgtcgccgtccccttgatgttcttgaactgcacgtccttgatcgtcaccccggacacgaactgcacagttcgacgacggtcaggccgatcgatcgacggcaatggcgaatgaattaggaagatga

SEQ ID NO: 8111 - DNA, 769 bp, Oryza sativa
  unsure (1)..(769): unsure at all n locations
tgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactaggcgccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctatgtgtttacatgctctgctntgaggctcctgaactntgatttgagatatctctatgatggatgatctatctatacaaactaaaatcaaagaagaaaaaataaattcgatcataaaaaaaatggaatattgttgatgctaacctctccgctggcaatctgtggggcccggtgctt

SEQ ID NO: 8112 - DNA, 2378 bp, Oryza sativa
ttcacacgcgtcaatacggaaaaggaagcactggtgcggttggcaacagttgtgacaagcagcagatgatgcacattccagttgattcgttacattgattacatttattcgttcaagcgacaggcgacggaggctgtagtatgtatctccaaatctcttctccattctgccagacataacaaatttgggttgcataaatcatggcagtcatgtgaatagaaataaacacgtgcatcgcaattctcatgtaagttgatcgaattattgtattccaaacaaaaagactctgcgcacaccttcattgaatttacctacgtatcaccatgcctgattctttctgtgctctaatctttgttagtgaaatctattctaatttcagataatacacagcacatacatggggggatacatccccagttcaactcaacaaaatatatatagttagaaggaaaggaacacccttgcattcttacattgatgttgcagtcttgcaggaccttataaattatatagcgacatctacatttaccaattggaacagttagtggttgcacgatgttacctacctacaatttgtacgtgctcgcacaagacacatttgtgcactatcctaatctacaaaactactgccgccttatataaaacctggatacctcactccaatttcgcatccagttttgcaatgcttctcaggagttgtttggagcagacattctgcgcctgagctacatatcgcccacgatttgctttcacccatgcaggttcctatttgacaaattaagtcaagaaaccacatttaggtgctttagctatatagagatcagtaaaaacacaaagataacacataaagaatagaaaatcacctcgggaacaaagtgtgagaaaccaaacttgattaagaagagagcatgctccattatgaggatggctgccagtcctggctcaattttccatttaccctcctcatcatacagacaaacaagaagcaagcagtttgtacagattgccataacaaccaagaactgaaaagaatttttcacattgagtattacaaggcatgagacatgcaagtatatctatgaggaatatatattaaaaaaactgctaatgaacctggaatatgttcagccaagctccaatcgtagctgcatcacggggagcaggtcttttcaacatgaccaacaacttcaatgcatccgctctaatttcagtcacattattctgtcatgaaaataatttaagataagtttagcacacacaaatcaaacaagaacacacatgtatggcatgcgctcgacaagagggaaggacacaagaagagagagaacacaaatagctgtgatgaaccacataccagagcagcaaagcagaatatcgacggaaatgcacaagcaaacatcatgatcatcccaaactgaagagttagctcaagaaaatctgtgatggactcaacaatgtaagaacataacacagacatccaaaagaactgagaatagacaggatgattatttattgctgttaccatcaaataaaccatcttcaagttcttctccaatgcttgcagtatacgagggttttagatattctttctctactcttgtagataaccgaactgacttcccagctggcgattctttctcatgttttttcttgctacaagatggaagagatttcttacatctctgaattggtctggaaaaagaatagtaggacaaacagatttggctgcagaacttactgaacagctctatactttttatagctataattgaggtaaggaatggaattctcaatcagattttccaatacctgcaagttaatatgtatcatcaaaggaagactagcatttatgattataactaatgatggaataattacaatgcagacatgcctgggacacaatgagacgcttgattaggacttgccggagtgccataatgttgcggtgcagtgaagcatggtaaaacaatccaatatatgattgcataaagtaaagaccaaagacctgcatttgccaaaagagtaagaaacctaacataaagcgtgaaccatattcttggcatcattgtgtttacttataaaccaaactatcagcactagactgttccccttggttgttttcatactttattagagtgacagacaccttgccacctatccttgtgtaatactgaattgcagcaagatacactgcagttaacacatacctgcataaacatcagcaataagaactgatgcttcatattttagtggtaaccataaacaacaaaataaaacataaggaatagatataaaacaattaggagaaaataagcttcaggtcaattgcacatcgttgataactcaagaatcatgaatagatcatagtgatattccta

SEQ ID NO: 8113 - DNA, 24298 bp, Oryza sativa
  unsure (1)..(24298): unsure at all n locations
atcatgaatagatcatagtgatattcctacaatcttaccttagcgcctcagtttttgtaatcgcatatagatgagcataggccaactcaaatggcagctgaagacaaatgatagccaaaacaatgatagcattattcctaattctaaggagaacaccaaaccactcatttctttgtactatacttttctccttgggagcaccaaatttcctnnnnnnnnnnnnnnnnnnnnnnntagaaaagcttaaagggtccagttcattgcccatagttttgtattccgaaaatgaataatttataccccatctgttgaaaacatcacataaaagaaaggcatgtttgtgagcacggtcttgaatatgtttcaaaggaacttaattgacttagatatatacagattgcatagaaaattgcatgctacctagcaaggacagctgaattcttccgtttccaaaattgcaaaaagaagacagcccaagaaataacgaagaaaaagaaagctggaagaaccaaccactgtaatgacctgaattcagacagcagagaaaaacatttagctgacgacaacaataaaatcccaatgatattttctagatgagaggtgcatacccaaaatctatcagctgggttgcaagtccaaaaacagctggaaagaacagccaacgtgtatacattccgaggaaagaaaaatatattgcaatctgcaattccagaattaaattttatggagtagaataaggtgatacttgatttgcttcagatagaatagttcataaattaaatatggtaggtgtaacatgtgcaatcacgctggtctacctttgttccaaagtaagagtaaatttcatcaataggttgccatgtgaaatcaaaccacttgagtgcccagcttctcaggagttgcttccttttaatttcatctgcagcaaaacagttggttatctaatactaagaatttcagaaataattcaggttggtttaccatgcaaagggaagactagctttacgattccttcatcttccagcctggttaagagtgactcattttgagtccagtggaactctttatcgtcaaagctgagagttatatcagaatcggtcttgttcacctgcaagtctccatatctacctactgtcaaataaggaaatatgaagcacaacaagactaatcactttgtacattagctatatgttttattcatatctcatgtcaagcgaaaagaaaaactttgagacttgagagaataaccatagtataagcagaaatatactaaaccactttcctatttgcacttggcttgtttcttaaatgcaaatataatagacaggtcatctgatgcataatgaactatacttaaatctttgaatcagcagtgctgcaaaaaaaaaatcaattttgcaaaagccaggcaggacatacatgccatccgtgaaataccggtactaacaacgaagcagtgctggtctagaaaaatgccaacttagtgtggaatctccaaacataaataactataactacaatgtgccgaagtgggtaacaggaacaaaagcaactacaatgggagacaactgtgcacttacgatgctgtatatcaagtgccggaagcaggcaaaccgctctcgccagctaaacagggacccgtcgggctgcctgacgaatgctccaacctggtcccattcaaactgcagttccattcctgacaagcagagaaataaaccatgaacacatcatcaaatcacccattctgaaatactcacaggtggattagatcagttaccgatataagttagcttcttcatgttcatctccgctgcaactctccccagggtccccatgggcgcagacagctgaattcaaaatgcaaatccacaaacattacaacaagctcatggtttctcgccacatgattatagcgaagtgtagtgctccctttcccctaatcgcctcctcgtctcagaaattcaaaatcaggccaccgtgccaaacggcggaattcaaaatataataataaaagaaaaaaaaacaccggaccttgatgaactccgcggggacgccgcggacgcgctcgacgatcagccctacgtcctccagctcccgcaccagccgcgccacgcagttctcgacctcgccgcacccggccgcagcgccgcggtagagcttgggcacgacgatcccgacctcgaaccccgtcgcctcatccacggccgcgccctgcccctcgcccgctcccccttccctcatcctccacaacgacgacggatcagacgcggggaatggcggtggatgcaagggagcggatccgcatagggggaaagggaaatgcggcgagcgatggaaggaaaatttttttgcggtctttgggaaatgagaatggagtgagacgaggccaaaggacgcgagggtaggaagagcagtttctattgtaagtatagtaattaattagacttactattttgattagcacttaattaacctattgttagctgttgccaccgatgcctgtgggcgtagttaaactggcgatttgggaggaaaacgaggattaaatcgggaggtaatagcgattttgaaagctgtggtggctgagcggccagcaggtgcgcctagccgcctaggagtcctgggctttccacccgtagagtattttgacaggtgggcccacgagccaacggtccacgtgacgcgagagcaccgaacgaggcgtgggtagctgccacgagggacaacaggttcacgtttcgacaaaagagcgcgagctacgaattacccctgcggctgacactgggccacgggtgatggctttcgccgtcgtgccgatttgggtcacgacgtatgtctggttgatcgctggttcggataatgtgttcgacgtgaaatgtttcttccaacgctaatcttctcgtgatgacaagattaaggtttttgttagtgtgtaatttgctgcttgctggtgactaccgcgcagtagttcgatttattagttacgaatcaatcactgtttattccgcagaaaaaggaatcgttttgtctgcttatttgtagcaccactcgaacggcttcctcttctgctgcagctgatgcgctcccgagctgctgccgccgttcccgtagacgaaagaccggtacgccatggcgccgcgctcctggaccacgtcgcagagcgtctccgggcgcagcgccgcgacgtgcaggccgacggcgtcgaggtgccaccacccgctcctcccgctgaacccgaccaccacgccgccctccatcgggtactcgaacggcaccccgtcccccgacgcgtccccgaacggcccgtgcaccgcccccgtgctcgtccggaacgtcagcgaccgaaccaccgtcgatccgccgtgcgccaccgggccgcaccggccgccgacgccggtcaggaactcgtacgggtagtccagcttcacctgcatcgatcagagagagagggagagattcagagagatgcacattttttttggtagatgagctgacttgcaccggagcacgcacgcacgcacgcacctcggcagtgcggcttgttctgccgtcgccgccgccgccgtgcttctcgccgtggacagggtggccgttcctgtcgtactccaccctcatcgactcgaggaaccgcccgtacgtcagggcgatgctccggacgccgcggtgcgcgccgtcgtcccacgggctcccggcggtgcctccccacggcccgaccttgatggccttgctcgaagcaaccatcctcctctgctggtaatgacccggttgctgaaagagcaagaaaaaaaactgtgttcagctgcgttcgtcgtcagaaatgttcagcacgatcgagaattcgagaccacgacagttgatgtgccttaccatgtccattagactgacttgcttgtcacctgaaattcggagaagaacaggaagcacctggataagtggttgtatcctagtaggagtgtactatttttcgttaacaagtaggagagtgcacttatatagaactgaaatactcacttttgtaagaggtaagtggagagtacaaagaattagataccggatagcacaagctagaccatgatgttcttttaattttgtgcttcacctggggcaacaagaaaccttagcacataataatgtactttaatctgtgcttcatctgggtcctgggacagcaagaaacttagcattgtttatttgaaagaacctcagcattgttgctaatcacttttttttttgaatttttgctgctaatcactttgagtgttctcgggtcttagataaagcaggtatggctggagcgggcgaataagatgctgagcgattgtgattgggttctggcatattaggtggggaagaatcaaatgattggcgtatacttcctccgtcccaaaaaaaaaagtcaaaccatgattttccgtgtctaactttaactgcccgtcttatatgaaatttttttataattcgtattttcattgttgttagaggataaaacatgattaatattttatgcgtgacttttttttaaatttttttcataattttttcaaataagatggacggtcaaacgttgtacacgagtttttttttgggatggagggagtatgtacctggaattttctcgttcccaaaaactttttctggtctgaacttaggactgatcagtttgtccggtatcactccccgtatctgctatggattaatttatctgaatttgcaagcataagttcttttgttctgtgttcaataatataagcagcgtcgtagactgactgacgagctgatgaggaatcagaaactcttgtcgtatctgttgctttgtgcttattgctactgaaccaacattctggggaatattagctagtagctacggtacagattttcgcggttaacaaacactttcaggacagggccacaagaacatagaaactcttttaaaactctttgaagtattcgggtggatgttcatatgtttcttccatgtcaactaaataattaaaaaaaaaataaaaaaagatacattaatatgtaatatatcacttaacatgcatgttcaaaattaacttctaaaggttcgaaaaaataacaaatttagctataaatatactacctgtaacaaataatatgtaatatactagttggagtttattttgttatttttgttacaactcgtgcaaggtggattttaacttgcttgtttgtaaagtgatatattaatctatcttataaaaaatatttttttcataacaatttagtttgcagggaaaaaggtacatatggtgaaatttagaatccatctcccaggtggacgtccacaagaacagtccaattggaaacacaacagaaggcgaatgataatgctatgcacaccgcacagctcacctgcttatataattcagatatccagtagtggtagtttacactttacaaccgagcaacccccaaggctcccaatgcgtcgcaatcttcctgtcattaggcatgaatcggctcatttccaatagcaaatttatcagactagctgacactctagcagctatatgttttccactgtttcttcgctgagtaatcatggacacccaatcagcttcttgttcacgctgtcaaagtctcaaatgctatattttcaggaatgcgggacactccaacgcatatccactgttagctggggccttgtgccgtgctctaaagattcttggacacctcttattatggtgtatccggacagcagcttaactttgctcctacgtcaattatcagtagctcagggtcaggtgaactatctgtctatttgtgcttactagctttgactgaacggatcaggacatggcagctgttcttttcttttctctagcctgttgcttcagccttaacgtcttagcttgcactctgcagaatgagatgaaaccaacaactcaactctttgtgacttgtgagttgtgaactgttccgttcacgtcgggttcacctgcgatcttcggttgagcgcaggtcaagctgttcctgaacacgcctgcctgatcttgcggtctgacgagcaattcacgagggaaagaaaacttcgttcggacaggcggctggacgatgagtgaaacgaaacaggggatcaatcaaacgaaacggcgccaaaccatgcaaggcatgagggcgacggccgccccgccccaccggagcagccatcattggggaggggggggggggggggagcaccgaacgctttgcgcgcgcgcggcggcaacgatcgatcgcatgtggtgtgcggccccactctcgtcgccttcgaatgagttggctcaatcgaatgatcgaatcaaggttcatatactgttgctcgaaatccgtctttgagaacctaaatctcttcgtttcaatttcttgatgccatcgccgtgtatttgtcactcgcagcagtgcaatgttaaattcgggaatgagtactacggagtttcattccgttagccatcacctgcaaaaagccaagaacacgtaattcttgtaaacactaaaccaagaacaccggtcgttttgctcgtgagctgtctcggggtaggcaggccaggcagacagactgtgaaaccaagacctcttcagttataacagcgcgctctcctgcgcctcatcacacacacacacacacacacacacacacaccccacgcattcaagcagccctggtgttgtacagatcatccgaggcgacgtttctcgattcgatcatggccaccaagatgttccgcgccgccgtcgtcgtcgtcgctgccgcggtgtcttgcctcgccggggttgctctggctgccgatgggcccgcgccgagcccgacgtccggcgccgccgccgtctcgtcctcggtcgtcgccgccgttctctgcccggccgtggcgctcctcttcgccaacctgcgctactgagttggttgaggtcgtcgcagcgcgcgcgtgtccatgaggctggctccatgaacgactctgttcttctctgcttgatcactcgcctagtgtgccttctttacccccctggttcttacctgtacttagcttcttccttccggtgcgctagattaaccgttcttgccttcttgtgatacgcatctatgtgtattgattcagatcatttcataccatcatttggaactatttattaattgctccgttatatgccggcctgtgaaattaatcgtcgtggttttgtttcccgacggatatgattcaataacctgctacgaatatcacggattctagacgaatattgtggattatacggaggatgaactcatgaacaccaggcgattttcgctgtaactatcgtgtgtttctccagttctgtttcatttccaattttgttttcttttggctgttgtcactgggtgcaagaccgtcaatttgtaaacatttggttcactgatcgcctgaactcttcttctcagataatttctgcgtgcgtgcagcttatcagctttacaatttgcaccgcgctgggccgctggcgccgcatcgaacatgcaatcgcccattctacattcctacctaggttttcgtcagaatgccaaggtcgagcccagaattccttacagtgtaatcgtcgatgacaaaatccgccgcggatacctaacctcgaccatcttgagctccgcgaaccgccgtgcgcgtgggctgaacagagacgccgccggcgccgtggcgactcgacgtcgccaagtcggatgcaaggcagatgcagcgactggacgaaactagagttcctcgtgagggtgcgagccgccctcgcgccggcgttcgtccaggtacctcatggcgaggctggcgtgcaacgccgcgccgtacgggagcgcggcgtcgtcgacgcggaagtgcggcgagtgcgcgaggtgcaccagcccctccgcctcgttgcgcaccccgacgaagtagaagtgggacgccggcacggcctcggagaagacggcgaagtcctcgctccccatgcacggctccatcgcgccgaggaccgcggccgaggcgccgagcgtctccgccgcgacggcctggaagtgcgcgtgcagcgccgcgctgttgatggtcgggggcagcagcggcctgccccccgcgtggaagtccaccgccgcggcgcaccggtacaccgccgactgcgccacgatcacctcctcgatccgccgcttcagccgcaagaagccctcgttcgagaacacccggaacgtgccgccgatcgtgatcgactccgggatcacgttgagcgcgtcgccggcgaggaacctcgtcaccgtcaccacctgggcctccagcgggtcggcctcccgcgagacgaggccctgcagggcgaggacgacggtggaagcggccaagatggggtcgacgctggcgtgggggtgtgcggcgtggccgcccttcccggtgatcaccgcctcgaagaagccgcagccggcgagcagcgggccgggccgcgatcccaccacgccggtggggagctccacgctgacgtggaacccgaagatggcctccacgttgtccacggcgccggcttccaccatcctcctggccccggtgcccacctcctcccccggctggaagaggaggaccaccgtaccctgcaaaagaagaccagactttgcttaggctgtattgggggatgcagtcaagcaacaatattgcgagttagtacttagtactccctccgttcgttttctaagatatgacgccatttactttttctcacatatttaactattcatcttatttaaaaattttatacaaatatataatatataaatcacacttaaagtactatgggtgataaaacaactcataacaaaataaattataattacataaatttttttaataagacgaatggtcaaacatgtgagaaaaaatcaacgacgccatctattaaaaaacggagagagtacatgattaattaagtactccctccgtactcgtaaagaaaatcgttttggatagcgacacggtctccaaaacacaattttgacttcttgtttctataaaaatatttattgaaaagtgatatatgtatacttttatgaaaatatttttcaagacaaatctattcatgtaatttctacattttcaaactcaacaacatgagagttattcgtgatttatattcccaaggtttgatttacacattgtcctaaatgaattcatttataagtacggaaggagtattagcttaaaaaattttaaaaatagattaatattattttctaaagtaattaactaggtggcgcggctagcacccatacaaaattatctattttttaatataatttatttaaaaattgttaaatagctctttttttgtcttaagactttgaaagactaaaacttatcatctatgtgtttctaattttttagtttttaaaagttatatgtatttgctaccccttattttttgtcacattttttatttgcttgttcgatctatcactgtttctattcattttcctcagatcctttcaaaattagaccttacaaattttagagtttattgtctcgttgggtttcgtttttataatttttaggtgtcccgtcaaacattgccattatacttatctattacccgtccgttgtcttctctctttattgtcattgtgattttaaaaattgattttttttaactttcgaagacccgccaaaccatcggtagcatttccattgtactcctctacggctgtccgctgcctcccctctttattttcattgagatttcaaaatcgaacatgattatcattaggggtttatttttttctctctagaagtcccatcaaccgtcgtaactgctgcttaacagcctgtctgtcatcccaattttaatcatcattgagattctatttgaggttttgtttataactattagatggctcaaaaacagtcaccactctactcttctcttctctttattgtcatttatcatcattgtgttctaaatgtttttttaaaaaaattccatatttcttgttttgatattttttatttttaaattatattcatactttaacttttataatattttttctatttttagaatttattttatttgttataccaaattttagttaatcttgtcaagtgttctagatggtctcttctttcaataatctctactttttattacgaattttagttatttataaattgtattcctagttgaactcttatttttatttttataatttcagaattaattttgttttttatttcgaattttaattaatcttttattgtgttctatatggtctatccttttaatattccttattttgttattttcaatttcaattgttttaaaattgtattcgtacttaaactctcttttttatttttcaaattttggattttatttcaaataaacataaaatggattaatgtgattttaaaatcaacttacctaaatttttattttaaaaaacacaccgtttaatattttagaaagtgtgctttaactttgacagccgctgcgtcactcataataagtgtaccaatatatatagcaaaccgttgtctaccatattcagaaagtatattaaacacataccgctgatgctttcagctgcaaaatagagtactgaacaatatgaaactgacatcaccataggtgttcgcccgcaagaacaagcctctaggaaaatttacgacggttcgcctgtccttgtttggattctcctccaattcactgtctctcaggtcaggtgttgcttcaatgcatagcatcagaagggacataaattatcaaattgaagtcaaattattttttgttttttttgaaaaaaaaagaggcaaacttgaagtgcagtaactgattttggaaacgcctattgcccgaagaaaaaagtacgcatgctgctcctagattccatttggccgggataagcactctccacttctccagaagaggactcgatccgtccgcaagaaacaaagctttgtgacttgctgcaatttcatccacaggatgtcaggaacgacttcgctgacagacattactcgggctgaatacgttgacagagacgcccggcgtatcccgtcgaaaatcttgtttgatgttcacagggtgtattcactacgtagtactccagaactcaatttcagcgacgcttacgtatgatgtcaaactatccaacatgtctgcaatcgttccaataaaatctgaccattttaattcagtacaataatgctaaatatgtttcatattaaatcgttgtccccgtttactcacggggataaatttaggaaacgtttttaccccccatcgtccactaacgtctttttctaggaaccatgtgtcgttgacagaacaaagttacaaatctgataatgctaatcattttaattagttggttagggtcgcagttgaaaagcaaaatctcagcacgattttttcttttgagagaaaagaaatcgaagcaaagaaaagggaaatagagatatgattaaaatgaattataacaggctgatgtcgttgcttcaactgtgaacaagaaatatttgaagaatctgttgggaaaaagacaccgcaacaaacaaatgatcgagctaactgatatattatagcagtgcacagttttcccttttttttctaaaggatctcgcggttctgttccaaccacatacgccatttttttaaaaaaaaatcaaatcaaatcaaatcagacatctaaaatattcaagcctataactgttcaggggatagagatcacctgcagttgtaatgtggactgcaactttagcagtccttacgtgaccgttagatcaaagaaaaacatctcatattcggccagaacactgtagcacgcgtatagtcctgtagcgtactgtagcatatactgtagcgttgttagcttggttatgacgtggcacagccatctgtcgttcatcagcttgatccgacggttgtgaagggatgtgactgcctaacttgcagtcaatgtaataactgtaacggatcttgattcctgttcaggtcatcaggtgcactcacaagctcacagcgcaagggttcgcatctctcatctcatgcactctatgactgataagccgcaaaaagaaaatcaacgaaacaactgaaattatgtactccctcggtcccaaaataagtgcagttttgtactatttatgtctaacgtttgatcgtttgttttatttaaattttttatgattactatttttattgttattagatgataaaacatgaataattttcaggtgtgactattttttttattttttttataaaattttcaaataagacggattgtcaaatgttggacacggatttttacggctacacttattttgggacggaggtagtataaaacttttatacttaaatttttattttttaacaattgaaaatcaatgctaaaaaataaactataataaaaaatcaaaattaactaaaattaagtataaaaattaaaatttaactgtctctgataagccaacaggcaagctattgagcaagaagagcaaactttgaaagagataacagcggatgaggagcaagagggagtatagttgcaatagtaacctgcagctcatggcgtcgctcctggaggatcctggcggcgccgaggagcatggtggtgtgtgcgtcgtggccgcaggcgtgcatcttcatggccaccttactcttgtgctcccactgcacctcctcctgacaagtttttgttgaaggcttttgcagatcagtatatgaaagatagaatgaatatcccaatattcttttggtgcattgaacaaaacccagcagaatgtatctcaagctatcttaacgcttaagtacccatgttgcaaactttgatttcaatccacaaattattgtgtcaatagaatagactgtggaaccgtgtgtataaacattttgctgttgtggagttagtttttcatcccttaagtggtcataaaaagtctaacctatcaaatagtcataaaaactcttgaaaaaaattgttaagatttatacaatagtcgtctatgatgttctttttttttaaaaaaaatcataactatgtaaataacatgtaaagtatgggaggacatccaatcagaggatacaaacttttttgtgattttgttactaaaaaataagctcaagttaaatgtaagggtgtgtttgcaagagcaagctcccaacactccactttcattttagaatcaatttagcaattctctcaacttttgagtagaagataaaatcaatcataggtacgcatatgacttatgcggtgggacattataatggttaaacattttatttttattactaaaatgaaatgaaataatgtctcaaaattgacaacattttaaaatagatgtagtcaaacataaaaacaacttacaaaaacacaatgatttgacaaaaattgttatggaaaatgttttcatatggttataagttaagcatgttatagaatgcatgattaaaaaaacatgtttattggagacttgctgttgttttagacatcgtgtaaacaaagagatggtaactcactccggccatattttggacataatttaagtaaagtaattcgatgtacaaatgtctatatttgccctgaaaagtacataatactctaatttttatcaagtttattaaacatcaacttatagaattagaaggtgtggttagatttctgtacaacctaaacataacacaactcttctaggttctatgttactgtgcctctactgctttattaaacacaagcttgcgccttgcaacggcttaacaattatagctcgttgaaacgcaataattttgtaggtgctcataattttttttattttattcttctaaaaattcctttgaaattgctccattctaaagggaggctcgatttatatgcactgatgcctctccactgaacacctgaatttttcatccaattcacttaaatttttacctgagaaaaacataacacagaaaccctacagatcgattccgtcattcttttttttccctttccttttttttttttttgaaaaggcaggcagcaggttccatcattcaaatgactactccaaccaaaacgcttaacagataaaacaagaattccaatcaatacgtgcataagaaatcaatgagccatggcaggttgcccccccgggctgtctcccacatacgttacctgcatcgggagtgcatccatgtcggcgcgcagcgcgacgaacggcgggcgcccggtgcctacggtcgcgacgacgcccgtgccggcgaccgggtgcctgtacgcgacgcccatggcgtcgagctccgccctcaccagcctgctggtctcgatctcctcgaacgccagctctggccgctcgtggatggcccacctgacgcccgccatccacgccgcgaactccggccgcctcgcccgatcgagcacgtcgacgccgccgccgccgcccgccgacgcacctcggcacgcgagacatagcgccgccgcggcgacggcgacgacgacaacgaggtcatggctacgcaggtgcggaggaggagcggcgcccatggcagacgcacgcgcacgcgccatggcgcgcggtcgcgaccgaggacgagcggtaccggccgcgggtacggtaattggtaagtatacacgcgatgcgatgtcccccggccggcgcgcgcgtgtggcgggttatatatacacgtggacgccgggcgcgcgcgagcgagagcgacgtctccgcgagacgactccgcggctccgcctcctcctcaacgtgaggcggacgctgattacgtcgcgccgatggccgcgcgcgcgcctcgcgctgggcgcacgatccgaacgttcatatataataacggcggcggcgttgtgtgcagggattacagcatgtacaataacatattattagccagctataagataaaagataagagagaatagcaacgaactacagatatgtagccatgtgttatggctccaagacacaatgtatataaaacaagtatgatcatatattaatagtatagtactccgtaaaaaacgaattagctgttagatcgactataaataaattggagatagtactggactatactactacctctgttccaaaataagttaaaccgtggatattcgtactcaacgtttgaccattcgtcttatttaaaaaatttgtgaaaaaattaaaaatatttagtcacacataaagtactatttatgttttatcatctaataacaataaaaatactaatcataaaaaaattttaaataagacgaacagtcaaacgttgaacgtgaatagtgtaaaactacacttattttgagacggagggagtattaaacttgctcttagctagcggcatataggcgaggagaaaagacgtgacgggacgcgcgcgagagaggctcggggatcgttggagtggtgttggatcgactcgatcgtgggtccttgtgtctgcgcgagtattctcgcggatgaagaattcaacggctcaggtcaggtcttgccttgacgatcatcctcgcggccggctgggccgcaagtttagaatgcaacagttttaacgttttaagcgggtatatagctctacagatcaaaaggttctaaacggggcaatttgtccattaattgttggacatggacgccctcatggatattggagtcaaccgtgtgggttcgttttcgttttctccggtactggtgtcttcgtcagatcaaggcgtgtcacacacatactggattactggtgtacagtactccagaagacacgccacgtacgatcaaatagtaataaagcaactcattagaaaaacaacgtcaacgacgggacaaatataccagtgacgtcgtatgttgtgcaaccagccagcttattattaagagtatgaccgtaagctagctataaacacattttgagaagataaaaaagaagagagaagaacaatgggctacatatttgtagccagctgcagcacagactccaagttacatatgtatatgacaggtgagaccagatattaattatgtaatactccctatgtttcaggttttaagacgttttgactttcctcaaagtcaaaacgctttaagtttgaccaagtttgtaaaaaaatagtaacaaatttattacgaaaatatatttaattattgatttgatgaaactaatttagtattataaatattattatactccctccgtttcaaaatgtttgacaccgttgactgtttagtacgtgtttgactattcgtcttattcaaaaaattaagtaattatttattcttttcatatcatttgattcatagttaaatatacttttatgtatacatatagttttacatatttcacaattttttttttgaataagtcgaacggtcaaacatatgctaaaaagtcaacggtgttaaacattttaaaacggatggagtatttatcaataaacttagtcaacttaaaacagtttaactttaaccaaagtcgaaacgtcttataacctaaaacggatggagtatatatttatggataactattgtattcatggttcaagaaggcgctaggcgctagttgggcggatagggggcgcctagcgcctaattggcgcctaggccccgcctaggcggcgcctaggtcgggtcaaatagttaaattcaagaaattagtaggcatattgcatagaaattagactatataacactaaaatagcaataaaatactacctaagtaatttaaccgcctaatgcaccattgaatgcctaatcgcggcggctacccggcgcctagcgcctaatgggcgcctaggcggcacctagggccgatttttagaacactgattgtattaatgggctattaagttgactatatatgatttagagccggcagctggctatactattaaacttgctctaagtaatggcttgccttggctctaggttactacttgtcaaagcaaatttttattgccaaagcactttctaataattcctatattgttaataaaaagatatggtatctccattgattcgataaatcataccgtatatccgaaattatcatcgtaggtaacgctccaaacctatttattttacacgagatgggaattgagattctaaactaaatacaacctatagtctttatttattttaaatttcagacttgtccagacaaaaataggctacaaaataatactccagaccaaatacagctcgatcggcaccagttaattataacttttaaaaaatattaaataataaattttttttatatttttatcaatagcactaatatctgtgcattggacgaagtacgagtagtatgggctggtttggtttgtgatctaaatcgaccttaccaattttggcacattttggcataattaattttggaaggcaagttatgtttggattgaagccaaaatagcctaagttaactattgaaatggcctattttcttaagcatactaaaatttggcttcaaaacaaatagacactcaacactattaaaattaaaattgctaaatattggtaagccaaatttaagccacaaaccaaaccagccctatatgtccaattgaaatcgagattgctggcgcacgcggcagcatgcgcggaactatgcgcgtcgtttcgttcaacccagcacgtgatcttattaaaacgtctcgcttatcttaactctttttaagcagtcaaaaagaagccgtcacgctccaattaagttggcgattgcatagtttgagagatcagcatgaagaaatggcgttcccttttgacggagctatcatgagacatgtcgtttcaactttgtcgtgttcggattaaacgtcggccctagtaataagcagcgcatcaaattaacctgacattgaaaacgtgcatcattcatcgtttgctacggaggagacacaggacacaccgtggagcactgccaaaaatttagtgctagtacatcacaatcactgcttcgggggtgtttagatctaaggtcggaaagttttggtgtgtaactatatagggtgtcgtataaaatgttcggatactaatagagaaacaaattgtataatccatcaataaaccgcgagatgaatttattaagactaattaatccgttattagcaaatgtttactgtatcactatattttcaaatcatagagtaattaggcttaaagattcatctcgtaaattagtcgtaatctgtacaattagtaattttttagtttatatttaatattttatatagaagttcaaacgttcgatatgatatggcgtaaagttttagcataggatctaaacctggccttcgtctgttatcgtggtacaacgattgtacgggcctgtgttttttctcgagatgaacaaattgtaccggcatgtttatctcgctcgccgttggtgtggcgtcagaatggatcacacgctgggcgcttcgcctcgcacgtgaaaatattggggtttttgcagtttcgcacgctatcatgtgggctgtggcctctgccgcctgcgtggctgcgaccgtccgtacatgcgtcgtcagctgcactaacatttggacagaatttttcgtcagggcgcactgccagttgatgccgcgcctgcaggatcatcatcaactgccccgcgtcgcgttgcggctgcgcgcgtttcaggcgttgcggctgccggttgatctcgagacgcaggaacgcagaggcgcgagcacccatcgggccagccaatacggtactactacaccagtagaagcagcaggggatccggatctagggcctcgtatagatctcggaaaatttttgctaaaaatgtcacatcaaatatttgatcacctgcataggatattaaatatggagaaaaaataattacacattttacatataaattacgagacgaatcttttgagcccaaccacaccataatttgacaatgtgatgctatagtaaacatttgctaaagacggattaattaggcttaataaattcgtcccgcggtttacagacggaatctataatttgttttattattagtttacgtttaatacttcaaatgtgtgtccgtatacttcaaaaactttacaaccaagaaactaaacacacccctacgatactcattgagtcattgttagtgtgtgtgaaacttttaagcagtagtagtactgcttatcgttgaataccgaattgaacagtctaaattaattagcacaacagtgttagttgcaatgtactaggccctatttcgaagattagcctacgactaattttaagagctaatgtttagtattgaatttataggctaaacattagtctagggtgatatgtttggatccatgagctaattcagggataaaaggtggagagagagatggagatggggctgctttttcatggtctctatagaaaattagccacattagcatctctttaagaggctaatgttttgagggggctaattcactttagccccaaattaacctagttgtttgaatccttaggggctaatttagagctcaaaggtgggggctaataattagcccatgaaaccaaacagggccctggaaaaaataccatagcacaaaatactactagtagtacaaagatagttgtgaatctagactgttgaccacataaatgagaccactatgtactagtattatataatatactagtattatatagtacagctgttagggtagctatagttccatgtaggattgtatccgatcaggattgtaggccaagggattgttggccaagtttagtttcaaactttttttttaaacttttaactttttcatcatattaaaacttttctacacacataaactttcaacttttccgtcatatcgtttcaattttaaccaaactttcaatttttgcgtgaactaaacacacccggaatgtgatggatccgaatctgctgtagttgatactgtgaatgtaacttgtaggcctcatttgattttctagaaaaaaatggaggaaaaacataggaataagaatcctatgtgaattggtactgttcatccctttgatttgtaggaattgaacaaaggaaaagcatggggaaaaaaatcctatgatcatgatttcaatggaatttcatatgaaaattaacatccacctttagcgcatttttcttttcctatgtgtaggatcaaggcaaagcactattggatgatacagtttaccctagcaaaaccattcaaattctgatttgctattcctatgtttttcctatacaccaatcaaacgatcattcctatagttttcttatgttttttttaatcctctgtttagcatatgatttcatatgctattcttgtaatgtttcctattactacgttttttcaatcttgtgattcatcacaacgatggttacgacttgagcaatgatgatattatttattcgttggacccaaattgaacggtccaaactagccgcataagattgttcattgcaatattatagcaaaaaaaattattacttcaaaaggctattcatattcatactactaccgtagttgtcaatttggaccactaatcaatggagtaaaatggaagaccaacaatgcatgcaatccttaaggctcacacatctaaaagtgctaaatagtgcgtgtgttttttaaaaaaataatatatagaagtttctttcgaaaaccaaataaatcaaaattttaaatttgtaatatttaatacttaattaatcttccgcaatggtattttttttgttacgcatgcgacaaaaaagttaggcctaaatgtgctttcaaacaaagcttggatccagatttgctcggctcgtagagttgggaactaatcctcaaacatgtaaaaacagagcaacttattaagtattatctaaagtaactttaaaaataaattaatatgattttttgaagtaactttctatagaaattattttttttcaaaacataccacgtttaatagtttgggaagtgtgtgcgtgaaaaaatgacggaggtgaagttgaaattttgacttaagaacacaacctaagtagtatacttgtttcgcttatcattggatcagaactaaatgatctgaataagtgcaaaacattgttcatgagttgtccatgcttttttatagcttccatgttgagtgctgcaattaacatagaggccggtaaggggacaatacttcatgaacatgtaaaatcattttacatgtaaaatgcagtggcggctccaggatcgattcgttgggtggtcctgcttggcgtgccaaattgtcacaatgttataaaatcaagtcaaaattatcaaatacagtggaaatataattcaaatattgcaatatagctcagaacatcacaaattgattaaaaccatcatttaagttcgaagttacgaaagttattacaacataaataattcaaatatcttacaatgtctctattccttttcatgtgccactgcaatttgcaccacaaattaatgagaaaataagtcgtattgactactaactaagttgttgctaaaaaaaaaaatctaagtttcagttttcattcacattttttcatccatatttttcattcaccatcacgatgaccgatctattcaaagtaaatacaaaagactacgaatgacttaatgagtaactcacatatgccaaattgccaatgcactaggcagacaggcagtaggcagtcggcaggcaggggccagccggccgggggcagggcggctcgccggctcgtcagtctcggccagcaggagggatcagccgtcgcgccgcaaacccgccgccgccgtgcggtgtggcggggggtcatcggctggccgccgccggccggagtgctgccgagtgccgcgccaggcccgggctgtggcggtcgacgggcggcggctgcaggcgtcaggcgagggtgggaggggcagcaggtggccagtcgatggcctccggcgcagcggcgctggccgactgatgggagagcgagaggcggcacgatttggggaggattggagagccgagcgtttgccgcctacgtgcgcctctcctctgccagctgagctaaccctaacacatttggtgggctctttttttttgtgtgggccgtcgggggggggagagggggggctcctgggccaaaatccagggtggtccaaggaccacctggactacctgctagagccgaccctggaactaaaatgtattttaggatgaatttattgagctgtgaggctacctatcccgtctttaatctagttccataatttagctccatgagcgggcctgggtatacatgggacctgtttggcacagctccagctccagctccacctccagctccacccctcctggagctgagctcagccaaatagtttcaactccaccaaaactgggagtggagctgggtctcctggagctgagctcagccaaatagtttcaactccaccaaaactgggagtggagctgggtggagctctctcacaaaatgaactagagttgtggagctnantttangcanctccacaacttttttccagacccaactcctgaagctaaattaaggagttggagctgtaccaaacaggcccagagttgctgcagtttttctgagaaactttagcaccccaaacaataattattattcagattctgagtatttatagtcgtaaaatctataaataaactagaatatagaaactgggttttctagcttcttaaccagttgttctaaaactcccaaacaaaacgtaactaagggtcgatccaacatttgcctaggccttgggctgacccaaggtgcaatctgacccacacattgaatacatgatgaaattagataggctttcatggtacatactccgaggctcaggtgtcctaggaccacccctgaatcctattcatgatggaacgtgttttgtcttgcagactttcgttcctgggcgccatggggactgagagagagaaacatcttgttttccgcgcgcacgtttcccaaactactaaatggtgtattttttataaaaaaatttctataggaaaattattttaaaaaatcatattaatctatttttgaaatttaaaatagttaatactcaactaatagttaatacgctagtggcacacctcgttttgcgtatcttctcaatattctcttctcctctcctctcaaacactcccttaaggtcatgttcatttaagcttatggacttatcgactatacttaccacgatcgtcaaaccatgatttattaaaaaaaaacttccccatcagcattgcttacataatttttctaagttatttatgtttttgagagaatccattatataccactcagtttgccacatttctacgattcgtcgctgactttatcacgttctacaatataccatcgacttttgcttaacttctacgatttaccatcgccgtcctattagcctccgttaataccgtataattttttccaaatgaccaaaattcacttgggacaaaaactttcaaaatttggataataattatgaaatgtcagattttaattttttggccaaattttggatgtttacaatattatgttcataatatgatacaaaaagcaaatagagtattgtattttggatgtttacaatcttatgtttataatatgatattacggaatttttgtctaaattttggaagtttttgtcctagaggtattttggtcatttggataaaattatatagtattagcataggctaaccggacggtgatggtaaatcgtagatgttaagcaaaagtcgatgggtatattatagaacatgacaaagttagtggcaaatcataaacctgtgacaaaatcagtggcatttaatggattctcacttttttttataagactagcaatagtgcacgtgcgttgcaacgggaaaaactaccgtttgatagtatgacatctcgagaacctcaaattggtaaaaatcaagtctaatttgatatattaccaaaattggtagaaccgagtctaatttgatgaattagcataggatttaggatttagtcttagatttatttttcaagcctacttaggagtttatctgatggactttaattttaaaaaaatctgagccatttgatcaaatttgctttcgggccaggtcttcccaagtcagcccaaacttgggccggcccgtcttcgggcttgtcggtgacatgggaccgggggaatcatgactagaggcttgggcaggagcaatcacccacgaggcctgaccccctctgggggggtcgggcccgagggtgatatggtcgcccccctctttgtctccccgaggggtcggaccgctcccgtttcggccccgagggctgaggcgccccgaccccttgtagattttgcgccgcgtgtatgggttaggtga

SEQ ID NO: 8114 - DNA, 24323 bp, Oryza sativa
ccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacaaatccactaaaacacaggagtagggtattacgcttctcagcggcccgaacctgtatacatcgcccgtgtcttgtgtgtttccactctcgcgaaccttccacacaccgagagcttagaacctcacccagggcccccggccgaaccagcaaaggggggcctgcgcggtctcccagtgaggagccccaagctccgtcatctggcgcgccaggtagggggctctgcgtgtgttcttctaagctctcgcactctttcgtgtgcgccaagcttttcctgttcagcccaatggccgaacaagcaaaggctcacaacctctctccgagtgttagcggtgacgacggggagccaaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggcagcacgccccagggcgcgctccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggtcgccactccttcgtcagcgcctccgaccagggaagatctgcgtggggggccggatgcccgtatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgttgcgagccttcggaatgtccgttggcccccaaggttccggcccaccatcgccgaaaaatatgacgggagcgtcaaccctgccgagtttctccaggtctacacgaccgggatcgaggccgccgggggtgacgacagggttatggcgaatttctttcccatggccctgaagggacaggcgcggggttggctaatgaacttgccacccgcgtcggtccactcttgggaggatctgtgccaacagttcaccatgaactttcaaggcacatatccgcgcccaggtgaagaagcggacttacatgcagtccagcgaagcgatgatgagtcacttcgctcatacattcagcggttctgtcaagtccacaacaccataccatgcatccctgcacacgcggtgatctacgcgttcaggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagtgcttctggccgcggcccctactcatgaggcgacgcgccaggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgccatcaaggccccggggatggtgctccggccgtcccagccgattatcggtgtgatgccggggcacacttggccgctaggtcatatcgacctcccggacaccttcggtggatccgccaacttccgcacggagcgggtgaactttgatgtggcggacctcagtctgccctacaacgcggtcctagggaggcccgcattggtgaagttcatggcggcggtccactacgcctacctccagatgaagatgtcgggccccgatggccccatctctgtccatggcgacctcaaagttgcgcttgcttgtatggagcagcgcgcggaccacctcgccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttttggacggcaaataggaagacgtgctcgtctccttcctgcgggcaaacgctgacgtcttcgcatggagaccggcagatatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcttcgcatagattagattgtcgactccacagcggggtgcgaccttttgtgttttctagatgcatactctggttaccatcagattcgcatggctagggaggatgaggaaaaaactgcatttattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaagctgaaccccgataagtgcgtgttcggtgtacctgcgggcaagcttctcgggttttttgtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggagaaagctgaacgtgccctcactcagttgaaggcgtatctcagctttcccccagttctggtcgccccggagccaaatgaacccttgctactctacttagcggcgacccctcaagtggttagtgcggcgttggttgtggagcgcaatgaggacaatcctcattccgcgcacccccaccctgtgctggcttggcccgggaaagagcagggaggagaggcccccgagccgaacggtggcccaaggcccccgacgaccggagcaggccctctgcccgcttgtcagacggtgccaggtgcccccgacccccaggatggcccgggggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgatgacgccaggagcccccgacccccaggacggccccgaggccactgtgggaaggccgcccctatcgtcctccgaccccgaggtcgtcggcacagaagacgagtgcgccccgcgaggccgcttggacgaagagcgccccagggatgcggcccctagcgaagaggatcggccccaccgaaaggtgcagcggcccgtctactttgttagtgaggccctccgggacgtcaagacccgataccctcaggcccagaagatgctttacgctattctgatggcttctaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccatgctatcaagagccaggccctcgccgattttgtggcagagtggaccccagctcccgggcccgtctcagtccccgaggctagctcgggcccctcgcagctgcctcacacgcccactgggtgatgcagttcgacggctccctgtctcttcagggcgccggtgcgggggtcacgttgacctcgccgagcggagacgtcctcagatatttggttcgccttgactttcggacgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacgattgccgacgaactctcacggctcgcttcctcgcgagcccagaccccaccgggcgcctttgaggaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcacgcggctaacggaatcctcctgaagtgcattcctcgggaacaaggcgtcgagcttcttgccgatatccatgaaggcgaatgcggagcccactccgcctcgcgcaccttggttggtaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggagggccccgggcaggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaaactctgcttcgcctcacctgcccaccccagaagcaacgaccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggtcaccatgtactgcgaggctgatcaagatcagcttcgcagagatgacctcgactacttggaggagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcaatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaattagtttatacaagaagggggcccgaaggcctcggaagaagaaaagaagaaattatttaaagattggcgggggcctgggggctcactccgatgcgcccgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgccgtcctcggttccgggagggaacttgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcgacgagtctagcgcgccctgcagatcggcgatggtgtgttcagcagctgcgaggcaggcggctaagtcgctttcgcccgcggccgccccgccgctgcgcgccctcgcgtccagctccttctcccgcgcctcgagctcagcggcccgctggttcagtgcggccctctcggcgcgggcaccttccagattacggcgcgcctgctcctcccgcgctgcctcgcggaggaacaggctgtccgccagccgttgcgccgcggcctcggcctcctcgagagctcgctcccgctcggtgagcgcgtcctcgcggaggcggagcgcggactcctcttcggcgcaggcggcctcgtgcgccgccagcgttgcctcccggatggcaacggcggcctcgcaatccgccaggtccctctccacggcgcaggcacgctcttccagcgccatggcacgggcctcacgggcttcttcgcgccgccgggatgccacctcggtctccgccgcccgccgttctcgggcagcggcagcgtcaaggaccccccaggcggcgtcgagcttcttccctagctccgcctcccagctcccgtattgaaggcggagggtgtcctgcgcctcgttcatcacggtggtggcgatgagggcggccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcacccatgcggcgtcgagctccgcccgctctgcttgtagggcctccacctgggcacttaacccgtccaacaccgtggtgtttgcgatggccaaggcctgcaggaggggttctgcgctcagtggggcaacggaaggcgtggggaagagccgcctcggagaggatgccgcgcggcttggcccgccgatggacgtgccggactcggggatgtcccccggacctggtttgtcctgagcgtcgcatgagggagtgggcccaagcgatgtgcccgcggcctcgtcgcgagctgcctcggaagtcgtcgtcgcctcggcctggcgaagtctggcctcctcccgagcggtttcttcagcttgacgagctcggacggccacctgggcagcttcctcggcttcccgaaggcgatccgctgcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccacggcttctcgccggtcagattcccgcctccgggcctctgtggtcgccgggtcctcggcctcagactggccggacttggaatggcgggagggacgcgacgggatctcgctgaaacaggagaaagaccagaagacaaacaagatgggtgagtgaaaactcgcgttgagggaatgaatacagccacgatgggcgtgggacgaacctgcgagggggtcggttaaacgaccaccttggaggggaaatgaggtttccccgggatggttctgtcccccccatcttgcggagccgcttcttctttcgctccccctcaggctgcggcgtcggcgtggctccctccgggcgcctgctgctgacgcgcgccgccccgccccctcggggaggagatgggggaggggttccttcctgcttcctcttcccccgggcgtcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcctagtcccatctaactccctggtgggtcctcatgtagtcttcggacccggtgtactcccaggcgccccgggcgcgccgctggagcggcgcaatccggcgacgaaggtagtcgccgtacaccatggcccctgtgagcccctgggatcgcaggcccgccaggcggtcgaggacggcgtcatagccatctcccagatctaccggcgcccgccagctggaggcctgcgccggaggctggctcggaagtcggaggcgcgcttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaaaggcggaaccagccccgccattgcaaaagggaggaagaagacggaccgccctaggtagcatggtgccgggcgtccctcgcccagcgtgactatctcctggccggtgcaagattccggcatgaagcggcgcggcagcccggcctgcctctcactcacgatgcgggaaggcggcagcacgctaccatcgagcagagcggagccccgtgccatgacgccggaagaagatatgtttgagagcgagcgtgtgtggcgaaggtagggcacaggaaacaaggagttagggcgcaagcggcgaagacaaggggaataatggcgagaggaaggaagcaaatctcttcctcggtgtctctatacccttgccagcgctgtgcccggctcctcccttctcgcgcccactatctcgctccctcgtttctcgcgcccacgcttccactaatcccattcgcccgcttgcggcgcatgaggtggatatgcggctgtggcagtcgagatggaacatatcgtgcgcgcgttaattacgctcgccaaccgaagcgccatcaccatatctccaggcaaaacgaaccggctcgtcccgattcgcgtgctactcgagtaatgtggcagtcttgaagagaccgctcattattgacagcagagttaccattgccgatgtgcgtgatttgtgaccgttgggtttctgcccaaccgtggagaccagtcccacctgtcaccaggcctttggaagtggcgtcacgcccgatcgcttcccttgaggagggcgatcgccctggcataacgccgggggctactgtcggtgacatgggaccgggggaatcatgactagaggcttgggcaggagcaatcacccacgaggcctgaccccctcgggggggggtcgggcccgagggtgatatggccgcccccctctttgtctcctcgaggggtcggaccgctcccgtttcggccccgagggctgaggcgccccgaccccttgtagattttgcgccgcgtgtatgggttaggtgagcgcagcggggctcacctaaccgcatttattgcgttttggacgagcgcgtcacgccgcatgtaacgcagtgcagcgcgctcgtttatccggtctgagaccagtcacagaccgatcagatcgtgggttaggtggcgacaggcggtctgacgcacgcctcgccccatcccgtcaggacgagagcctctaaacactcgtccctagccggagccggcgtgttacctcctggagatggcacgttggtcccggtcagatatatgccaggcttcatcctaaccattacaagcaagacattgtatgaagaagggcgaacatgcagattgataaactgacgcgtggtggacaagaatgaccgatttgtgaccggtctgacactggtcatgtcgtcagcagacaaccatgttcccacgtcgcgcctgcctccggcggaagtggaggtaggtatgggccgtcccatcagaaggtcattcggacggcaaccatacaagtctccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacagatccactaaaacacaggagtagggtattacgcttctcagcggcccgaacctgtatacatcgcccgtgtcttgtgtgtttccactctcgcgaaccttccacacaccgagagcttagaacctcacccagggcccccagccgaaccggcaaaggggggcctgcgcggtctcccggtgaggagccccaagctccgtcagggctagatgagtcaattcgacggcccgcaagccgagcagccaagcgcggcccacatacgcggcgacggcccgatgcacttccgcggcccattgggcagcataatcagcggtgacggtggcccgacgttgggcgaatttgagccgtccaatctgatagatggctccgatcgtccctgcgtcggatgaagcgccgaccgggagagaggggaaaaacccctagctcccaaatccttctctcccgatcctctttctattcggcaacgagcgagcggaacgacagtggtctggcgagcgaactttgccggctggggggcgcacccgagggcagcaccaagccatgccacggcatcgatggtccggccaggcgggcgtgcaaatggtgacgagcaccgagtggcccggacctcgtcggcgggaggggcgacgccaagccgacgcttcccgtctctggcaagggatggtggaggggtgctccaggacagcgcgcgcacggggaacctgacgcgactgcgaggaggtgaaggtgcggcggtgccgtttcccggaaagctccggcgagcttaggggcttcaagttcggtaagtaacccgatcccttagcttaattgatttggattttgactcttagggttcttatacgaaattagggttctttgaatttggggaattttatcagaaaatttcaatattttttattccctcttttcgagtttggggagtttcagtatcgtttatcccctcttttaattttggaaacttcaatctaatttatccctttgctcaatttcagggaagccattgaagccgatgtctggttttgcttttggttcgtcacctcttctcaacgccttttcaccattttgtttgtaacttgtggggctcgggggcaattcagatagaattctatctcttattttcttatttgatttgatctctgatctctctctctctctcttgctttggctagcgtttcatcgcgcaggtagggacagagggtgccgcttgttccctcggaaagattatgattaagacaatatcagattttcacggacgatgaaagtaaattgaatgggattttttttaattttttcgcccttttttcgttattacggacgacggaaacatttttaattttttaagtagtatagataaagatatataagatgtaatacttaatctatcgctataagcaattgtcgtaatatgttcagtcatccaaaaagtacacggccttataaatcatgaaagaccctattaacaaagtgacgaaaaagctcctaaatttactaaaataaaatccaaaagttattaaaaatcagcaagggagtgtagtcaaaactgagcaaaactaagaattgataggagaaatgcatgcttaacttgttttagttacatatgataaggaatccgaagttgcttcaaatacactattgtcacgcccggaatttctatccaaaattccaaacgcttacatgtgtgtgaaccctcgtccaggaatcagccgaggcacacaataacaaattgataatagagtacaaatattactctaattaataagcgaataatatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagtatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttactatgatgagaggtgtgagactaatcacgaaagacattgttagacccgcccataaccgtgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcacgaaaccatcattaaataatagtgagtcattagttatcccgaatgtgtactaatgtttctaagcagggctaagcaatcatatctaatatctagttgaaccaatataaataaagctcaactagtcaaattgtaataacccaaggtatcaaggaataaggtaatcaagtacgaaagggccataacaaagaataggtcaataccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcatcaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagacggtttattgcgtcagcgggctagggtttggtggaccgggcgcacgggcggcggttcacacgaacggacggccgagatcgaaccaatccaaaacggacggccgagaccgatcgggtccacggcggctcacggcgaacgaccccaatgacgtcagcggtgacgtcaccgacagcggcggcggctcggcggaggagacggctcgaacggcgcacgctcgccggcgaacagcggcactaggacgcaaacggagggcaccaagacgtagaggacaacacggcgaactcaccggtgacctaaacggcggaggaagaccaacggacggcgacggccacgaggaggaagcggcgggaaccttcgggtcgacgacggcgatgctgctccggtgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcaacgggtagaggagacaccgggggtccttttaaaggggctcggaggcggcggcgaaggcccaaggcggcgacaacgacgaaggaaagctcggcttggagagaaggaaaccgatccgaaacgaactcgattccacgaacttccaaaacgatttagccaaagattccaaaggagaaaaggtagaggagatcccggagatcatttcccctctattgattcggccggagaaggaaaggaacggccggatttggaaggaaacggcggcggcgcgaaactagggtttcggcggcggcggccgaaggaggacgatgggtccgacaggtgggacccacctgtcagcgaccgaacgcgcgcgcgcggcggctgcggactgggccagctgggccgaggagagagaagagaggttttgggccgactttcggcccaaagccaaaagagactttttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaactatcgggaagcactgatcggggcattcgatatccacaggcttattagctactaaatggtaattggcacatacaatttgtccggttgcttcttgtggcttttcgtagggggtggctacctggcgactggtcgcgcctgccccatcgcacgcgagtacgcgacccgcccccactcctctatagtctctatagtactagtataatatactactagtagtactagtattactattactactacactactactatcagtactagtattatttatataaaaaatatatttttatatgtatatattgttgatgtataaaaaatatacacatatacaaactttgtatatgatgtgtacaaattttgtatacgacgtgcacaaactttgtatacgtacgtattaaaaaatcgaaaaaacaaaaaaacatcacatatacaaactttgtatacgtacgtatataaagtttgcacacatcatatataaagtttgtatacgtacgtatataaactttgtataagtatgtatgaactttatatacgtacgtatataaactagtttgtatacatatatataaactttgtatatgtacgtataaaaagtttgtatacgtatgtgttaaaaaaacgaaaacataaaaaacggaaagaaaaaaccgggaaaaaaaccagaaaaaccaaaacagaaagagaaccccaaaaaataacggaaaaactaaaacagacagagaaaaaaagggaaaaaaccaaacagaaagagaaactgaataaaaccggagaaaaccaaacagaaagaaaaacgaaaaaaaggaaaatcctcccgtgcggcgcgccatccaccgcgccctctccgcgcgccacactagcgttttcgcttttcgtaaacctgctgcgcgaaattgggttaggcatttgaaatagaataaaaagtatactttgactcccttaactattatttgagcatgattcacgtccttgtcgacgtttgatatcgtgactacggaatttgcatagtatggagattgttagtaccagggtatatgcgagattgaggtaaaagagatggagatagggattttatacaggttcgggccccttatctgacaggtaatagccctactcctgttgaccgaagccggtgttgctcttattcatcataatcacatcagtacaataattaggataacttatgtagccgtcgttgacttagcggcatggataaccaacacgtagtcgatgacagggtagtcatccctcaagtccgcactcagcgagatcggagatagcactagatccctcttgttggcctctgcagataccatattgggtttgtctaggcttatctctgatatcgatatccggcggcttgttttggcacatgttagcttgtgaatcgtgtgtcgatatgttgttgttgttgcttgtcccatctcctcctagggggcttgtatttatacccataggtgtccccttgtccaagtagaactagggagaccaatatggatacaatccgagtagtcctgatagtttccatatataactctatttgtcattccttatccggaactccttatgtatacgaggtatgattccgtataagacatggtatgtggtgggccctaccgagcttagtcaactactattaattatgtggtatccataaccatgacagtcctccaaccacaaaaccggaaatattgactcctccaactattaaaccgatgcaaactatgtcccttggtgattttggctaacgtggcgcctacgtggcggtcccgaccgggtttttgtcctacgtggcgcttacgttacgtagcattattgtaataaaacaaaaataaaaaaattgtgggaccatatatcgtccacacaaaaatgtattgtgggacccacatgtcatcctccctctcctttctttcttcctaatccttccttcctctctccgccccacgcggccacaccagcgcgcccacaagctcggcggcaccgcctccccgtccccctcccccaatccccatcccgctcccgctcccgctcccgcccccacccccggcgacagcatcggccgccgccgccgccgccaccacctcctcgtccccgtcatatcctccccatgtcgcttcctgcctccctccgccaccgacgcctcctcctccacgcaaagggcagaggtggttgccggcagcgccccactcctatgtgcgtcggcgccgccaccgctcctccacaacacacgcgcgtcggtgtagccgcccaaccaccaccacttgtcttcctcatgaatcgaacatcacatcgctatccccatcctatgctcgccccatgtcgtcgcgtccgcctacgcttctgcccctgtgtttcgtctccaaatccccactcgccgcccccgtccccgtggacgcccaaagggaagagaagggggagagagagagaaaagggagaggtaggaaggagaggaagaaggaaggaaaggagagggagggtgaaatgtgggtcccacatattttttttatttttattttattataatgccaagtaggacaaaaacccggccaagaccgccacatagacgtcacatcagctaaaaccaccaagagacatagtttacaccggttttgattgttagaggagttgatatatccagttttgtagttggaggatatgaatcatattcaggcgatagttgagggaatcgaagtatacgttttcctttgaaatacttcagacctttgttgggccttcacttcccatgtttggactctcccacaatttgggccatatcagatgggccctgtattaagcccaacaagaccgtagcccaccacgcgccgtgacgagggccccggtttgcttagcgacacggcaactactactaaatcgtgcgggcccacctcgcagtgtcccaactcacacgcacaatgcgaccgcgaagccgcctccgctaatccacctatttttattcttctctcccaccccaaaatccccaaatcccgacccgatcaaaatcgaagcttccgccgagttccccgtcgccgactcgcctggatcggcccgccgtcgagctcgcccccgaccatccgctcgattggaggccggggagctgcgtctggtggtgaatcgcatccgccgcggagcggttcgatttcggcggcggatttcgcgggggtagaggagatcgaaggggggcagagcagccatgagcgaggtgttcgagggctacgagcggcagtactgcgaggtgtccgcctccctcttccgcaagtgcaccaccgcctccgccctcgatggaggtaaccgaccgatcccctctagtctaatcccgatatgccatcgagatcttacgcggaggagtttcccccttttcttggagtacgactaatcgggtgtccgatttctgcagagaaaaagaagcagaagctgtccgagattcagtccggcgtggaggaggctgagtcgctggtaaatatcgaacccatttctttgggatccctaacctgcatcattatgaggagtaccattctagtattgacttacattctgcggtaggttagcagttaaaaaaggctggtgattttgatatgcggatgcatactttttagtagatacctgctatttataacggtgtaaatgtatgtttcatctggggtacaggtgcagtatttaacgttttatttgtatgggtttgtgcatacagattcggaagatggacctggaggcgaggagcctacaaccgagcgtgaaggccggtttgcttgcgaagctgagggagtacaaatctgacctcaacaatctcaagagtgagcttaagaggatctcggcgcccaatgcaaggcaggctacacgggaggagctccttgagtcaggcttggctgacactctcgcggtgagctccatgatttgtattactagctcaatttgaccatattgcagattttaataattggcagcatctagttttgtttgtccattgtgttgctgtagtttgtagttttaatctatatcacaataggtgttttacgtatatcacgggcacaaacgactgacaggtagcattcatgagctcataatcactgatactagctgtacttatatttttttaattgtgatacttgttattggatggttaattgaggctgaattaatggtggttgttttctttttttttccccaaatctgtaccatttatgtatgtatcactgacaatttaatggttcttaagttctgtattggtatgtgattaatagtgttatgctgaacttcagttagaataaggtatttaaatattttaatatttgtgcaatctggattttagttttttcattgtatttaaaacctttaaacaatgagagcttcattttgtaacatgttcttgccactcaaggtttttcctatatgtgttttttgtgtctgttacatggcaacgttgtaattcagtaggagtgtatatcatcagtttatttccagttgtggtttattttcagatctggacccttactgtcaccattatcaactgtactacagatttcacacaatctcaatgagttctctgtaactattttgttttgaaatttcctacataattttctcattcatttgttaatgtggacacaattgacagatgtgtattatacaagatatttccattctgatcttcatggtacaattctgtagtcgcatgagtagtgagaactgtttcttgtcaaatttgtgtggtccaatttggtccttgatgaatatccgttgttctgattaaaaaaaaatgctgatctgtcaggagaataggaaatcggagttaacaccctcagaaactgtcctttctactttcagtaatctgcttaatgtttttgcgaaatgaatacattatccagccaatgtattcctggatgttgaaaagcttttgggaatgctacctttgcattctttgtccgtcatatttttctgctgatataatatcttatatcataatgcctcagcattacattgattctgatttcttaaacattctctcaaagttaatgccgttttttcttttgttgtttttcatgttgtaactgggattattatgtaaatcaggcgtctactgatcagaggggaagattgatgatgacaacagaaagactgaatcagtccaatgataagattaaagagagccgaagaaccatattggagacagaagaacttggtgtgtcaattcttcaggatcttcatcaacaacggcagtcactgctgcacgctcatactactgtacgtattctgtcataacctttttacacatttattggatttgccttcctattaatgtcatattcattcgtcttctgggcatgtcttatgtttattatttgaaccatcctgtgttgtctggttttacaggtaaatatggcataggaatactattacttaggttctagatttgttgctttgctctatcttggagaattggctttttagcaagttaaggttgccttttgcttggcttttaaagttgacccaattaattccttgtttggtttggaggtgattctacaataggtgtggaataaatcctctccaatccctcctccctcttggggattaaccgaacaaggcctaaaggaacctaccaaccaccacatcaaaaaccacttacaagttaaaacaaaatataagtacttcattgtttatactcttgaatgcaaagagcaaacagtagacgatgcatatgcatgcaaagccatggtcgacgattcattgttgaagtgaatactggaaaattcctgtataaaaaatgtgctatccaaaatatttgcagcaagattcacatcattaacagtaatagatttagctgcaagctaatggcaacagtaatcatgcaatgcagtctacttatttcatatatgttaatggcgtcatttttctcacagttgcatggggttgatgataatgttggcaagagtaaaaagatcctggcggcaatgtcaaagaggatggacaggaacaagtggatcattggggggataattgcagctcttgttctagccatccttctcatactgtactttaagctcgcttattgagcttgctttctggtagggtcttcaaagcaatttccgctcagtaaatgtgtgataaaatagttgcctgaatgttgtacattgggcaacacatatctctgcaagcacacacttgtttccccaaacttatggtatttgtgtggctcatcgcccatgtcatgtaatgtacagttaacgtgcactccaatatgtgaaatgtctaaaaagggcttaaaatgaaaggtgactcatttatccaagtactgctttctgttacactagaggtattgaattctattctggtacactatagggagtgtgtattcctatacctgaactgatgtcactgttgaccatcctatcattgtgatttgccagcgttggccagtttgttatcgttgtcgactttggtcgcattagatgctttctgaattattgtgcagtgtgtgggggctcttgtgctggtgtgcatgcggaagctagcgtagacgatgcagatctgtcatctgcggttgcagggctaggttgtctagtaggggcaacacgatatggctgtatgcatgtatgtcattgtttgattggcctcccgtttgggcaatggacgaggttgatggtgatagtctcatggttgtagtaagcattcgtccaatggaagagaagtcggttttacgagtactgcagcaagccgatgattgatgtaccggccgggttcatagaaggaaaggctttgctctgttgatcagttcggaattccgggataaacttagcgagcggcatgggaagcaatagcgcatctccaacagcatcttttaactcgggctctccaaacacctatatagctaactctctatctaatttggctagtcaaactagttagtaactccaatggactatccatcaacactctccattatgaatctataatagtgggacctgtatgtcagcctctaataccccttcttcctcctcttttctcccctttttcttcacccacttctctccaattcttctcctctcttctctgcagtgcggcacccacttcagtgcggtgcggggatggaggcggtgccggcaggagcggcacgggcggcggaggatgacgtgagcggcatggggatggaggtgggagcggcgcgggcggcataggccagtgggaacgacaactatggtgcctgcacctccctcccctgcgagcggaggacgacgcgagtggcgtggggatggaggcagcgtcggtggtcgaggacgcgagcggcacgggcggcgtaggccggtgggagcggcaaatatggcgcctgtgcctccctgctccactgcctccttccacggccggtgacctccaccgcggcgacgaagctcgagcgccacccacatctctctctctctctctctctctctctctctctctctctctctccctctcgttttcttccttgcgctcgcgatggagcagaggtgcggcgcgcagccacggctcagctgcggggagggcgagcagcggcgcaccgccggggactcaccactggcgacgtagaggcgcggcggtcacacgatgcacggcacggcaacatcgagcacgcgagctcctcagcatacgacggctcccgactttcggtgacggaattgcgtagacaccaccacctcaccccgccaccagctt

SEQ ID NO: 8115 - DNA, 1408 bp, Oryza sativa
gaaagcaaagcgtaacaagtatatactgcatagaagcaccaatccttaatgaatgaatcctcttacatgttaaggctcatcacagcaactgcaatataacaaaaatagcacaatatcaaataataccacgcagtttctaaaattgtaagtactgattccattgtagcagagaacaaaaacatcataacaaatactcactctttgaaatgctacaaaacagtcagaaaatcagcaagctattgaagcagcagcagaatttgcaaacttgaaaccaaaaaaaaaaaaacagaagcagaagcttataagcttctttttgcatcttaatatgttaggactcatcaaatgatcacatcatttttataagcttgatgtgagaatttagatatccaattaaatcaacatgaaaaacaattagacaggctgacttaagcaccataaagttctggtgctaatacctggttcttgacagccttggccattttgcggaactccttgcgcatgacagacttgtggtagaggctagcaggcttgttctgcttctctgtcttggttgtagagaggaccactgccgtttccttaccactggcaggctggaccgtcacggttttcttgtttgccaggcctgaaaagaccaaatgaacagcacaaccagtcaagactcaagagagtgccacgggagacatgcatatcaagagaagcatgccaaccaaccattaattaccagaatgcttgtaagagtggacattgtacaggttgttgggctccttgctgaactgaaccttggcattgccattgccgaactgcttgaccaggaatgaattgttcttcttgacaagctcccagaccagagaatctggaatcgtggccatttatcctaacctaaagaatccacatcaacacccggatgaaatccaaaaccgaaatggaacaaaacaggaacaaatataagactcctaatataagagctgtgtccttctggcagatgggaattcagacagatatcgccgccatgtctgatttggcgactcttcagagccccccctccatcccaaccaagcatttcagagttttctttcttctctgtttttgggggctatggaatcaccgccatgatgtaatttttaggggtatgcaaaagtctcttcccctttggtagccaaatgtttagatgaggcctccttatgggccgaaaggctaaatgtaagcgatcgtattgtggtttccgcctggaaggaaaccatctcttcctccctcagaacctcttccccctgatgtaatttgtatcatttcaccgtaacctagagcttgcttattcttgtagcaccaatggcgttctattcagaggttggagcaattagctcttaacttaccgaagaagacatccatttagcatatgattaatttagta

SEQ ID NO: 8116 - DNA, 3748 bp, Oryza sativa
cggcaataagctagtaacccaaaagctgaaaagaacatggcctaaacgagcatatatatgatgataagaatcgaacacacaaatcgtagacctgaattccaatttccgaacagaccagtgaatatcccattagcggatggtgataaatgatttatcactggacccacataccatagacacatgaagacccacatattatagacagcgagtggtaaataattaattgtcacatcttgaaagtggccaaaagttaaatgtccccacaccagcacgtctcaagcgactctaagcatttgggcagtaacaaagcgagcgtagctacgaacgtcgaatgatctaattcaagtaaaccaccagcactggatggatggagagggcaaagctaaaatcgcaaaaatggagtctaaactgatcaattcatgcagcgaaacgaacgcataacaggctaacgccaacagaagttacagaacaagccatgctacgagaagattgcaatgagtggtttcttcttaccggagattggagtgacgcgcgccgccgatctgcctccttccggggtcacgatctcgcggcgctgaaaaaaaaaccctagccttgaggtgggtggccaattcatgggctgtagcctgtagtaaggtggaatgggcctgtttggtagcggacgatgttggatgggctgtaggcccacgttagtgggacacgtgaactcaagtttccagttcaaagatggtacaagggggtcggggaattaaactccgaccccgcttgactgtcgtttgcacgaaaaattttagaacaatgacagtaaacatcgaatgatattaaacaaaattataaagtttactaaagtatttctagaattttcagtccgcccgctccaaaggaaatatttttggcttcaacagtagtgaaacctggatgaatctgaacataatttgctaaaattcagaatttcgaactttttggccgaaaaagcttcctgttggtggcttggcgctactggtagggccgaaaaaaaacgggaaatttcagtgcaaaatctgtaaccctggtcaaacctacacattatttttaggtcaatatttgtagtaatatcatttttcacctagtgaggatatatccagaaaatatgcattacgacttacgacaatgctgaaggttcattatcatttttatatcattacacaactaatgcatgaaatcgctcattcgtgtgactataaccatcatgttataaatggtgtgcaagataatatattaacgataatatgaaattaaataattagttattcaaaacgtataaaacatctattcgaaacctaattggttgatataaattaaattaatcatatggatatacacttgtatagatatacaattttgagtattcttaaggttaggaatactcatgtttaattaaatctgtagaatttagaatactatggttgcacagtttagtttacaattatctgaatttgaagacatagttgtaatataaatataggcaaatgattgatttgtacttatacaatttattatatgactaagtgcaaaagtagaatcacatctctctacatcaagctccatgtgtccacatgtaattacttgtctccttatatacattatgttttgattaaagtaagcgactatatatctctatttgtaaattgcaatacctttctgccatctcaagcaagtagctctttctattacctgctagaagctagaagggtttatcaatgaacaccatatgtttttttattactacttgagttccatcctataatcaaaatttgttttagctttttgtcatttagtgaatccgataactaatattcattggatggtgtggcaaattctaattacatgttgagtttcacttttcattagttaagatacggtactgtatgtcaagcagtaaaagtccaaaacactgccaactgctttcctgttggctgccagttccaacattttctgaaagcatccaaggaatttctcaaatctcaaatgacatgcataaatcaaatctcaaagcactgccaactgctttccagttggctgccagtctcaatcctccaaggcttgcataaatcaacaaaaactagctggacagataaagctggatatgttaatcaaaactcatgttgaacaaatgtagtaagtactagcaactagctgggatggtatggaatatatggaaacaggttcctttttcaaacagaatatatgaaaaaaggtaaacctcttaagttctgtaaacgtctgtacatctgactgcataatgtgcttattacacgctaacaatcctttcataatgacaatacctaagatgtgatgaacatgaggccaaaatagaacgaaagaataatagctcgccaaaaagaccaacatataagaccgagtgctatgagttgatatactgtacaaatgtcaactcgaagctatagaatgtatgtatccctgtgtttgtaaatacgacttcttcacatgtaaaactcaactggtatgcgatcataaaactagcggcgattggtccgaagagacataaaatgtgcagcaaacgaatcatagtctgtcggaagcttggggtgaacatgcgacggagcagtttttgaggtgctttctttcggagtttctgctgggctttctgtgttttcctcctttcctgtgacagaaactgtattcagatcagcttcttgtgacttccctttgcccaagggaggttccacacgcacaggttttggtgaagttcgtggtactggaaccctggagtacacaggtgagtctctcctttgttcagtaaacctagaaaatgacccagcaggtgatttcgcctcagtttcatcagcatgctgcactccaactcggacaccggtttctttctttgtatctgatgtcatctgagtcctgcgtgattgaatctgctctctagaccactttgtctggacctccttgcgttgtgccaattcgtcctcgctatcatctgaatcaaagtaacttttggcagtttttgttgtagttcccctgcgggctccagcacctggcttttcatggtacagatcttgactggaatttacacctccagaactcttattcatcacagaacttggagcattataagattgctcagataacttccctctatcaccttctgacccatagtaattcctcatggttgatctagcttccacacttgctccaacactttgattttggtcatgaagttcactgttgtaatctgcaccgaacgaactcctggccatacctgtagaagtatttcttgtatttccaaacgaggtatcctcttcagagtgcactgatttttcaatggcggtaggaaccttatgcaacgaggtattcccagaatcctttatgtacggaggaggttgccggagtttgtttcttagtccaggagttagccttccaaagttcaagcctggatcgccttcatcatagtcagcagatgatgttgaagtttgcctgcctaaagaaaacagctgattcttattttctcctgttgtcaatgatgatgcaccttccaatttatgtggcactctttcttcttcaagatctctgatttttgtacgatccaattccccatcaacccatgagtaatcagatctaggtgaactttcactgtagcgctccttattgaatgcattagaaccagatgaattaaggtaattcttcctggacatggatacatgatcttcaatattttcattaacatcatggacaacctttccag

SEQ ID NO: 8117 - DNA, 6327 bp, Oryza sativa
tcaaatgtaggtggcacattatcataagaatgaggtgaggaaacatcttttctgtttgcttctgttcctgaaaatagtgttgagctgctatgattaactggagattcatttctatgctgttgaccccaatctgcacttgagaatcccttgtgatcttcaacagtgggttcttcagtgtgctttgaagagaaaggatccaataaattttcttctccgacatcagaatcatattgatcaaaaacaacagctgaagaatcaggtccagctttatcattctgactgtcccaaatggtactgctgccatgggtgaatgtaccatgggaagagctatagttgctgtagtagttgtctgtgttctcttgatcaaaggtagcatgcttgctttccgtgtccttgatgttgtgcccaccaagttgagcctcggacaatctttctccaggtaaattaaactgatgatcctcaggtcttccaaagttgctttctttctcagatgaatcatcagaatattgaggatcgggtgaatgagaacgatgcggatcagttggcatgtcatactcatcactgtgaatatgagggctatatggtggggattgacccaaggaattagttggcatattctgactacctacacggcttgtttctgttctccccccatccttcctagcatcattacttgagatgagtcttggatcataagcccctgaactctgctcattagaactcctctgcccatccttcattaaatgttcagcttgttgcttcctgggtgtagtttcatgggtataagcaggtgactcaaaagctccagtattttgctccgcagaaaggtttccacgactagcaagttgggcagcagccctagcagcaatactagccatctctgcggactctgctgctgcttgtgctgcagatgttgcatccttgaattctatattccaattggaaccactaactgaagattttctctccctagagtgattgaactcttccctcctggacgctgtatctgaaaataacatttaaactaggaatgaacaagaaagcactaaaaaattggtaatgttcagattatatgaccttcacctgtatctggaactgttgcaccatattgggagtaaggtctagaaacatttgaacctccagcagtatcatgagagaaactgttaggaccatgctgggacctaggggacattggagcatcagaaccccttctgttttcttgggggaaagcattagaattggcagtgacatatggagccctattgtctggaacctcagctgatgaatatgaatgtgccgtagacatgtgagaattggaagattccatatatgaatgagaaggtgcagcaggctgtgaagttggcatgccagaattagaagcagatgatcccctagttggaatatttcctcccggatatgttgaggtcacatgctaaatcatcaaatgattaatccagttagaaccataatacttgaacgcttaaataaacttttatgtcagctaatttaccagaagatcatcattttgcttcggcaatttctcctcaaatgcttttggctcccatttgatgttgtgctcctctgcaatagaggtcaaggttttgattttggtctgtgtatcaggtgctccagctgacagcttctcaatgacctgtatccaattattacaaacataagctataatcatggcatatatttattcaggccaacagaagtaaggaaattattttcccatacaaaatacttctaaaagcagcataaattaccagtcggctgacaccactgtcaggtcgcacttcaagagctgctgctgcaaactcttttccatacttacttgtgaaatgcttgcgaacatctgcaagttctgtgacatctgaacacctcattgatgcaaatataacactggctatggcttctttcagatcaatagggcaagtccttcaggtaaaaaccacataaacaaggaaaggaagagaacagatcagttccaggggaacagaaaccataaaaccaataaattaactaagaaaaccaaaacaatgcatagttttcaatcaatattaatctcaatttattttttatctaagctcttttcttcctgtcattatcttaaaaggtcgcgccacagcacaggtcctagataactaagatgcaatgagcatctaacaccctggacattagtatgttataattagacaatcgatttgtatagttttcgtttaagaaagcatagaagcactcatcttagtggctattattttgtatttcttaaaatgagtgtgccaattgccatagagttggtagcacttgacttaattagactattttagaatagtttgattagttaagatgagaatgagtaaatgggaggattcagctcctttgaaaccatgaaataatacttggagcgtaaaactcatgtctaggctaacttgatattttcagataatggaagcttaattgaactcagctaaataaggctaacttgatatggcagaattgagtccataaaacattccactctggaaccagggaagtttcaattggaagacataaggaatttacatttatctccagcaagtaactaagtagtatatgactgtgccacaaaaaaaataaagtgggttcagttccagattacactcacgaggaaaaaaaaagaggatgccaggattataagcagttttaggaggcccatatcaatcaggcaaaatcatgctttgcttataagaaaaaagtaactcttgtgatataagaaacaatctgaaggttgctaataacatgaaaaaaattgtttagtatcaacttaagaaatcatatcgacaagaaataagctatgttagaggtagtcctccaactaacaaaatatgcttctgttatctatgataatgaagcaatttctgacataagaaacataaatagaccagcaagtaattggctatatgcattatatacaataaaggggaaaatggcttacttctgtgagtcaataatggacatgcgtgccaccataagttcacagtatacttcaattaagtcatatgcttgcatgaacttctcttcccttatgacatgttcaacctgtggaaaaagataagcaaaacgggccaaaaagaaaatagatgagcctttggtcaggaagtaccatcaagacacgttaggactgtgtgtgcgtctttgattcactaacaagtagctggtcactctgtggctcagaacccaacaggatgccctaataatatactcacagcaagataatacttgacacatgcattcgcaacaagcaggcatgtaaaagtaaagaaaaaccaaatactcaaatggatggaactaaaaaacgaatcattcgttgtaatgtagctaccgagaggcaaaaccaaacacttgtcagataagaatccaatactctcatggaattcaagagttcaacggagcaagtcaatacagtgaccaaattgatggcactgctacagaacgaattgtaaatggtttctgtcaagacataaaaatgaattgcatttgagccagcaggcatatacagggccaacaggcccaaggacttctatggcaattccacttataattgcagtagttcatcggcatatccaaagcgagcagatcattcgtaaaacatcactactactagtaactaacaaaattttcccatataaacacctaaggcacactaagaccaagcgcaagcggctaaacaattgatgctagcatccaaagcccatctgattccgcgtcaaggcaccccaattacccgattccgtcatcaattgggggagctaaagagacaaattgagaccgcgatagagacggaggcaagggaaggcgtaccctgatgcgtgcggtctggtcctgatcggcctcgagcagctgcgcgacctctcgacgcatctgccgcacctgcacctccttgcggttcctcagcagcttgatccgcgccagcgccatccgcagcgccgtcttgctgcggcatccacgagacccaaaaaaaaaaaaactgttagcccttgcaagcacgcgcctccgcggcgcacacaaacgcgcgcggagagttagcgagggcgagatgatctcgggcaggcgggcaaactgaccacttgtcgggcttgaagcccttgtgcaggacgccggacagcttcgccttgctcctgttcatctccgcctccgccgccgccgccgctgccgcttccgcttctctgtgtacctagattcgaatcgaatcggctcccgcgaggcgcggggggcaggcgaggggtagctgggcgcgggcgtctccggttggtgcaggtagattggaaaggagggaggaggatgggttcacgcggatgcgtgtgctgcgctaccgaccagggaggaagaggccaaggagagagggggggagactttcgctaggcagggaggaagagaggagataggaaaacggatgcggttttttctcggaggattccgtgacgacgaaaccgcagacagaagcccaggcgcaggcggcttcttcaccgcttccgtcacgtcgattcgggagattgaccttgaccggtggcgcgcccggttcgagggcggggcgcgtggggaggattcgcggggatttttgggggtgatacgcgccgtttctgctggggtgtacttgggttggaaaacccgaggaacggaggcatatattgttacaaacttagtaaaaactttctaaactgatcatattaagtagatatataaaataaggtaagccattaatatataattaattaaatattaactattttaaactttaaaaatggattaatatgatttttttaaagtaaatttcatatagaaatttattttttaaaaaacataccgtttaatagtttaaaaagcgtgcacgaaaaaacgaaataaaccaactcactctcacctcccctagaacgcagtacaataaagtaagagctagctataaacacatatcgagaaaataaaagaaaagagaaaaacaacaagctacagattcgtagtcagctgcagcatggactccaaggcaaaacgtgtgtatgataagtgggaccgattattaatattgtagtatatgtttataggtaactattgtatgtattggctatatatatgatttggtgctagttgttaactatactattaaacttgctctaattacatctaaattagtagtagattctaaaccttaatatataaacatgagaaattatcattcctcgtaccatttccacaacatttcactcaaaccaaatctatccataatttaacgtttaacaaatcttcattcatatatctcacggtaaagcgcgaggcattatatccataacatttcacttcaaaaagtctatccatcatttctacgagatatatggttctatccaccatatatagaaaaaatggttatatacacctgagagtacctgccctgctcccgatccaccattgatcagtgcaggacaccgattgagcacccacgaccttgctatcagatccaccatacatgctttggttttttcttttccagaataaattgctggaattgttaattatcccttacggcttgactgacaactggagagaagaggattgagagtttggagtagggaattgatgatgagattaacatgggaatttgatttttaattctaatatcttgtttggtagagatggtgggaattaatagggagtttagtttgagattagattttaaatgaaaatggatggtcatatttgtttaggcaaagtaaaggaggaatttcctcccaattaccaccctatacccaaaagtattgaagagggagttattactttctcaattccccattatcatcctaccaaaatcttccatatcttccaccgaacggaacaattaatagcctcatatctctaagctcctaatcacttgtaaaaacccctcctaaccaaacgtcccgttaatgatcggatctagcaacggcgctgagctgctagcatatactccctccgtcccaaaatatagccacttttgtttatgaatctaaaagtggctatattttgggacggaggtagtatactcttgtttcaaccgtggcgatgggttgcggcgattcggtcgatctcccctgatatttcccatgcgagattcggctgctgacaaatcgatccacctcatggaagaaacatacatggcggcacgacatcgtgtacgtcatcgtgttcggcatgcttcactagacgatgtgctttgttcgctcaccgtgacttcctcgttaacaggcggcggcggttggaatatgtcaacaccagcatctagcctttctacgcgtacgtgatgctgatggactactg

SEQ ID NO: 8118 - DNA, 1143 bp, Oryza sativa
tcattaatccaaactcatttttgaaacatgcttgagatgaagcagataagtgctacactacctaattgtaacgatatccagattgtgcatgaaaacaactttcacatatcataacaatacacaatgatgtttcaaaaaataaaacatgaattatattgtaataacagaagctatatatgaagccgcattatcatttattttgtatatacaaagagttgcatctaatcatttaaaacattgattttattcgatgataaaactagcaaatcccgcagcaaggcgcggggtgccaactagtaaacttaaagcctaatggcataagaggtagtaattctgatcaatcttatgacttgctgaactcatcctaaattcctggaaggcaaatgacaaaaattacagcaaaattttcatgatttgcattgtacaaccaaatgatatagaattatctaaaggtctggtacacgttgatttaccccttaacacatttccattataaaaaaataccagaatatatgggtgtgattgtacccttcaggttgctgctcctccattaagagcattgatagcattgtttagatgcatcttaagttgcttcatcaatactttattaaatttaagaaaatggattggatttttttaaaaaaactgttaacatcatacattacctaatatacattgcacaacaagatacactacgtcaggacaggtttatagtaacacatttttgtgttacaataaccccaaaaatgtattactagtgcctacagtaacacaattatgtaatgttactatagcctatgttactatagctgggtataccgtaacacatgtagatgtccttaaaaataagaaaaggtgttaccaaaaaaagttatagtaacatatgttattttgttacaatagatcatagtaacacctttgtgcacttatagcaacactgtaacataacacgttttttctagttccagcaacaaacttgtaacacctttctatatactgcaacatagtaatagtatatgacgaatggtgcctttaattcaatattattataatagtaaactgctctgtattatcttcacaaactttggagaaggaattagcaagacatcacacaagggcaatgaccacgaatgagtagataac

SEQ ID NO: 8119 - DNA, 18354 bp, Oryza sativa
  unsure (1)..(18354): unsure at all n locations
acccactttctctcttggattactactcataaaagtagcatatgccacatgttctttgttaggatattttgcagtcatcaaaattactgtggtacctgcctacaatatgattgaataagaatcactagttagttgcataaacaagaatcgaactgtactatttgaccttcatcacagaagaatgcatcctgtttgaaaccatgggatgtgtagtcctgttcagaccatcctttttctctctactcttcatagtcttttgttatagatattgttatcggatgaagggatagtaacattgttatatatattgttatcggatgaagaaatgaccaaaataaaatttatagatattgatgagttatacaactttattgttgatgactttttcagttgaaatcatttagtacttgaaaatattgtctaaagttgtcactatttgaaattcaaattcaaattataaaaacaaagtcatatagcaaaatgatcaaaacaaaatttatagatattgatgagttatacaactttgttgttgatgactttttcatttgaaatcatttagtatttgaaaatgttgtttgaagttgtcataatttgaaattcaaattcaaattattcaaacaaagtcatacagcaaaatgacaaaaacaaaagttgttgatcttgataagttatacaattttattattgacaattttttcatttgaaatcatttactaccctaaaaaatatttgaattgagaggaaggaggcattatagacttctcggcgagggaggagcaaaagggctgggccggcggcccaaagagggaggaggggaaggggaagccggcccatggagggagagagaggctgcgggctgtgggctaatagtgtatactttataccttatactatggtattttgctgtaatttttttagaatatttgttatgcaaattatacgaagttatagaagaatatatttttctgttgagacttaacaattagacttcatataattgtgttttatgatgaattgtagactgttaagacttgagaattgaacttgacaaaagtttgaagctcagtttgaggggtttttgtattccgataaattttcgttaccgtatccgcgccggttcgttttcgcttcattttcggtttcgataatattcgtttccgttttcgtttctggggtttccgattccaattctgattccgaaaaaatatggaaacgaaaacgataaaggttgttttcatccgtttccgtaccgttttcacccctagtgctatagtgattcgtgccaaaacatgccatgcgattcattgcaggcagtgggtgttcacatctcagtgaggcagaaaaaatacgattggttattggagatagccaaagacacttctctcgaagatccatttgaaatgtttgattgatgacttcatgttgttgtgagggagatgcgcgtattctgattgaatgtgccccttttttgtcatacaacttccttaatatagctgctgtaattgcatttgaacaaagttgttacctcttgtacctgggaacccaaactgctgctcccggtacacccgcttattggattttaacacggacttggaattagtatgcacactaactttgcatgcatctcatgaagtcattcactgcataattccatcccgtcaattttgttcttccgagctctctgtttcatctcgcctattgcttttttatatattgtgggacttctctcgcatgttgctgctccagagtatcttatataatgtgcggaggcgcgtgcgcagctgcgcgtaatagaaacgccccgtgtttctatccgttctgatttgagatcggttgcagtcccaactacaactaactgcacgttagaggtactgtacacaatctcatccattttttttttcattttttttcgatcgaaagtacagattagccttgctatattaattgtgcggtgaatgcctaaagaaaatgagccaaaaggaaatgatttacctaagtttgagtttattcgtgcatgaaatagtctatcaattttgtggaacagtaacatttactagggaatgtctttgcaaaagcagctaagcatattgtttgtttttcagacctacctacctagcgtctagcaggcgaaaccgcataacagaggttcacccgtatggccgtatgcccgtatcagcaccacacggctgtttaaccagacggattttgcatcgaccataatgaaaaggacacacagcagaagagaaaccaaagataaatatactcgtataacaatcgacttggcagcaatgccttagtcaattcggacgcagataatacacatcaaatgggaacaaagtttgttctgagcaagttcatacaaaaatgaatatcgactgccactataaaattcattccttggtgaaacagagataattggcagatatagcaaaacaaatattggtggtagtaatgttttgcatacagaacagaaatgctcacaacttcatccctgataagttcaacttaataatgatagtacagaatacattactcatgcaatattcagaacctaaacagcccaaagtcttgcatgtagataaattaattcactagattattaacagctagagtttcagacctctgtggtcaaaactcaaaaggatcactacgagataaatcagatgctctttggaagctccaactgccgccttcttcgagaagggcatgtgtcgagtacactacttgacaatttttactcgcaggttttacagaatccagagccttcaaaaccagcttattcttctccaaagttgtgcaacttgcattggtggaaataatatcaatcttttgcagcacctgcgccctctccatgacaaacttgatgaaggcaagctcactctgcttcccttggaactcatcgaaaaccatctttttaacatgtgacttgatacattcaatttcaccagctcccttccagaacatggccttgtgctccccagtggcattgttgagttcgtcagctttgtcagactgaaaattaaaccagtgcaaggcaatcatggatcatgtagttaaaaagcaatcagacaccgattacgactcaaatatcaagtggagcgagtgggttcaccttgaggtgcagcgtttcgacgttgggaaagcactggaggaaactgcacaacatctgggcttcgttgagggtaccaaagtacaccttcaatgctaagatccgcacgcttggaaccatggtacttggggttgctcttgttctagcctgcaacaaaatccaccaaaaacagttcatattttggcgaaactgtcagcagtgggaactaacaaaagagggtttgcaccttgatggtggtggtgccgatctgcagcaagtgtcgccctggctccaggtatcctagtgacctcaacccctgggcaaggccgatcttgatcctcgtcgagaattttctcccttccgtggcccaaatatcgctcagtaagagccgatcgaggcatggggcgtccacagctgcaaggtccgccacgcaggagaagccgagctgcacacaacgtaggctgtggctgacaaagcggaggcgcactacgttctggctgagaaccacagtgagtatctcaaggacagggctcctggagataatggattcgagatcgcggtcctccatgagtacacagcaaaggccaagctccagcaggtgcgggaaggcggtgctgcattgggggaggccagcggtgttggggaacctccatacgccgatgtagaggcgtcggaggtatgtgcagctgaagagcgtggccgggaggcgcaggttgatgggccagggacggttgacgaagacgagctcctcgacggctttggcggcgaggagctggagccagcggtcgagctccgggaggtgtgcctccatgatgctgcaggacaggtcgacgcggtggaagggtcccgggtgagcagcgaggacgcgcgagaccgcattggtgacggagatggggtgggtgttcttgttctctctcagccacgtgagtcgtgaccgattcggacggatagctagccggcccatatcaatcagtttcggttcctacctaaggattctgaatggatcatgtccatgatcttttttttttgttttgggattattaactgcagtttaatttggaaagagtaaatctaatgtccctcatcttatcatcgagttataaaattatccttaaactgaaaagctagatatatgacatccctcaacctaccaaattggatcacttaagatgtgtttggttggatggatgagatggccgcacgagttttcgtgcggtttggttggagggcagggtggatgggacggcccagaatagggaatattctctcaatatactggatgagtgcatccggtcgatttggctggatgaaaccattcagttttgttattctgattggctgtggttggtttgatttcctgttaagcaaggttcaaacgatttttttcgcctaaaccgtttatctaatttatgatttgattacaccattatttttgttataattaaatctttaaaataagatctcggatgattatattttgataaaaaaaatatatatgacaaatgggtcccactaacttttggcttttcccatccatgatatatcccttcaaccaaagaaaaaattggatcgccatatccatacaaaccaaacaaaaaattggatcgccatatccaacaaaatatggattgccatatcttgtccatgtatgaccgtgaatagagatggcaacgggtgcatacccatcgggttcctttgcctcatacccacacccgcaatgtctaaatattcccacttaaatacccacacccgtgcgggtaacgggtatccatacccatataattgacttgtagcatttatatagttttgtactttaactagctatattagagttgtaaaccatcgatattttctctagcaacaatgctattaacattagcgttcaaaggtgagtaaaaaattatacaaccgcattatataatcaagaaatcaaataaaaattttatataactagactagaacaatgcttaagatgtgaaaggagttttatgctatgatttagtagtcgttgagactcatattgctaatagttttaggttcaatcaacgggtttttttttcacccacgggttggtgggtacgggtgggtaaagaacggaccatacccatatacccaatgggtaggagtttttgctcattagtggacccatgagtataagagttagaacacgattagctcctaatagagtaaaaacccatcgggtctcgggttatgggtccccagtgccatctctaaccgtgaaccaaacagacccgtccttaggcagttttgttcaacgtgacagctgcgtcagtatgacacccatgtgaaccccgcatgtcaatagcctcttcccctcatcttctcctcttcccataaggaagtaggtggagaaagcaaggctagagggagtaggcagtggcgggtggcggggagaatagaggtaggccaccatcatcaaatccccatccttcctcctccaccgacatcgacgccttcatccacaccgtcgtcggttgctgccacccgtgccctatggtcggggcaatgggatcttgcagccacccctaaaatagaagctaggtgagtggtcgagagcggggatgtcgtgtggtggccaagctccggtcattgatgctccagtcgtggtcgatgccaactacggtggtggcgagaggttcttgcccgagggcgagagagagagaggagcatagagcagaggaggaggtgtggagcagtggatgcagctaggggtgggcacaaaatcaccgagccgaatcgtcggttttttcggggctcggttttctcttcggcttttactccgttgtagttcgatcgttggtatcttcgtcggttttacgtcttcaaatactgaactgtacgaatattccaaacaaaccgatcccaggccaaacaaaccgatcccaggccagtgcgggggcgtgggcgagcgcccagtggccagtcaaccttcccccttaactccctcgaggactcttaggccccgttcggtctccaaaactttgagagaaatttttttcattagaagaaagaaaattatttaaaaggtattaaagaaacaaaaggggcttaaattacaagatttgtaaccaatcaaggggcttagagagagaattttgttgcacgtaaaatgaaaaacctctttagcacataattaattaagtattaactattataaatttaaaaatagatttattctttttgttaaaataactttcatatataaacttttgtaaaaaaaaatacaccatttaacagtttgaaaagcatgctaatgaaaaaaagaggaagttgaagttgggagttgaagaatagaaaaggacatcaatctactatagcatttcattatctttaatatccgtacagttctttttttcctaacgagtcaagcacatctcgccacgagaataattacaatgcgtgtcagtatcagtatcacagcatgcagcaaaagccctggatttcacttgattaaccggacggacaagctaagtgccggcggaaaacattacgatgtcctcttactggcttctagcactattgatcctcaagtcttctgttgctacggcaagtattcgtacgtacaaccctccttgcgagcaagataattttcggctacaagatgatcgatcctcatttgtatgaggtcgtcatcgacctgcagcgaagaaaacttcgtcatcgacaaagaaaaatgaattaaaagaaaatccaaagatcaatctaattttgttctacacaagcagtttcgttctctaaaacgaccacatgtgcagactaaaaaaaaatgcaaataatggacatcttttcagaagttgcactacatatggccagaggacgtgcctaaaaaaaatgcgccagaaagcaattaaggaaaactgccacaagcattctttagtggaggatatactgtagtatgttagtaccttgaaataaggatcacacaacttcttgcattcctccacgagtttctcatgatccaatgtcttcctatccttcattatacgcacaattgcgcaatcgacattttgcttccggtacctcctgacatcttccatggtctcactggcacggaaatcacccctgtcaacatgatgaagcggtacctgcagcacacattacagtcacctcagagagagagagagagagagagaggcgctaacagaagttctggttacaaaaggatcacctttatctttcccgttttaacactgaagttattgttgaactcaaatatgtcgtctggagcaattgttttgttgctcggctccttttttaggatgctgtactttccacatgataaagaatacagcattacttttgcatcattgtccatgatttccaacttagccacaatgtcattataacttaatcgatcatcttcattgaatagcagcagcaatgcagcctggcaaaaatagatcaagggcataaaaaggtcatgcttagcccatgtgggcgtggctctgtgttcaaacttaagggatttgaactcacctgcattggtgagacaatcatctcaactgatttgccttcaaagtttccaacaatattgcaatttccaagggaatagatccaggtaagcgttctacccctcctatttcctgtcgcttgtccatgaaactcttgatagaacttctcgaaagcttcagcacaattgagctgagaaaaagaacatctcagatcttaccttattagaaatatggataaccaaaataactccataatgaactagaaaatggttaagagaggcaccatatcaggggggagcgataaatgctgtttttgttgagaaggaaaatgaccctgtttcagaaccattgtgtccatgtccaccagagtatttgattctgggttcatgctcatatagtctttgaagaatttttgtagttcttttgaaattgaataatcttctagcatatcttccaggattgagacgtccaagactagttttagctttgtgataaagcttgtctcgacctcaatgttgcaaccaatggatagtcttcctaagagcctgttcctgcaatacattttcagggggaaaatggattcctcaaacttcagttgtcttctaaggagtcaaacaaccatagctcccaagttaaagaagcaaccacaaacctgtacagctcaacaaggtaatccttactgtgcaggtacggtagaagcttaacgacctgaaaattcagtatccacattggcaaattgtttccgtaagcctaaggatgtgagctttagaattgcaaaaacaagccagtagtagcatacctttgcaaaggtatcttcaacagagtcatcgtctagcttgccacatgtacgttgttcaatgagtctctcaaagaatattatgaaaaattccccatcactaaaatcagcaatgtttctgttgcagatcatcctanagttctcatccagagcctgcacaaagacagaattccctagtaaccaacatcatactatcatgttttagcaagtaattacaatgatctaaggcaatgttcaaagtattgactatcgagtcattccaaccaagcaaaccttgcgaaacaaaatgtgattgtcaaaattattgatcacatgcgcttcgtatttttgaagaaccttcatgattctcaatacaaatacctaagatcaagatgctatgcattagtaatccccctaaagacgtgtgcaagcacccacacacatgaaangggggaggggaggggggaggggggagttccgtttaaaccaggattctacaaatgctgacctctacaattgaatttgatggttccttaccctgtggattgcacaaaacaaaataatatgttatttcattgcaaaaaagtggcgcatataaatcataataaactggtggctaacatgattgttgcatatattaagatagaagaattatgttaagtaaaacacaagctaagtagcgaactaactggcaaaactgtcactttggtatcaataaatgaaatagagagcctccctctgttttccaaaaacaaaacaactaacacgtaaaacaatcaagtaaattacttttatggtaatagcagtagcagaacaatgatatatgacaactcttacaaggagaacaagcaatatctcttaagtcatatttacctaggttagagtagaggtttatccaaactttaaaaagcttattttcataacatctagttcttttttatcttatccttttttttgtatgtccatcatgtacttttttttttagtaaatccatcgcgttagtatgtgccaataggtgtggaatcttgtgataattatgctctttagcagttagtctcaaagacggctaaacatgcaatacactgtttaacaaggtatagaaaagaatacaatatgcaaggatgtattaagtaagaaaacaaaacagaacataaaacaacatatggtaaggtccatgctctgtttcatacgataaaagcaatctgtgttatcatataggtgctcccacttcatattaaacacatttaaagaatttgaaattaatttttcgccggacaaatttgaaattaaataataaggggaaagtttcaacttacaagaaaaatatcatagatcagtcagtgggttatcaagataggattgatgattatgttacacacaactgaaatcttcacaattattttacacgtcaagctattgaaatttggatgttcagaacaccaatacaaggaacatgaaactagcaacagaaatcatccatcacggaaaaggccacatgaagttgaaacaagaatggatatgaagtacaatgtgcgagcacaagatgcatcaccttttccatgtgtgcagcaccaactgcctgttgcaggatgtccctaatatgctgcagtgtacaaaagtaacatattaaggtcactgatcttgacaaagaaatatatatcattagcataatgtgaagtatagcttacttgctggaaggctatggccatgacaataaaccaccagaaatcctggagaaaactctgaacatcaagttcagttcgttaccctgtagtaagaaagacatattcatttaaactgattctacatatttgctcatatagtaaggctttggtctctttctatcaaacctttccatcatctagcagatcattttctgccgcaaggatacctctaaaacctgatttatcatcatcaagtagccattcagcttgcctggatactaattccaggagtactgtctgtaagtattcaatgtaacgggttggaagttaaattccaactgagcaggcaatgaatgcgtacatgataaaacaggcttgtgaagaaaacaagctaacaaatgcacagaagaaatgggaaaataaataaacctatcacaaacctttgacagtcttgcctcagtccatggcttcaaataattctggatcctttcctcttcctcttgtatagattttatcacctgcagaacataaaactcatgacaaagaataagtggtatgctagattacagagaatattgcaaggacttaacgtagataccttgaccaaatatttagaacaagaaccacgggacacccaagcttgggcctttcttcagtaatgttctgctgtgtttttgaggaacacttcttcgaaaccttcataaacatccattccattaccacctctaccaagttcagcttagacactgagagtcatcttgatcaaattgcaatccataaccttccctgccctgtcctcctcaatctggtaaatcaatgcaccagcaccattgtaacatccttttatgcatcttggacaatcggtcagaaaacgaaacaagcaggaggaagatattaccatttcgatgatgatttgtcattttcttatttaactcttcgaaaacctacaaccaagggcagtaggcagcatgggtttagctgaaatcttttgcacagcagaatacacgtgtaaacttcagaatatgcttcttaccacgttcttgaacaaattcagagcaatatccattataggtggaagtgacctctgattagtgaatgccaatcgcaagtacatgcagacggatttgagccatttcatcaacaccttgtggttttcccagtgatgaacgaagttctttaaaaggggctctccctgcatatcctggagggacggtagcacctgcatgatcaggtaacaaagacacgaacataaagatatcaacagcgagcgttctctcacacaggtattagctaagggcaactgcaggatgcatcaaacacaagctaagcaggttgggaacagattaacagatatcgatcgatgcaactgagaatacttcacacattgattaggtgcgcagaataaaaattgatgataatcgcgggggcagggggaaccggaaaaggcggcacatacctgataaacgatgtgatgcctgattgtcttatcccaccgatcatacatctccgcggcgtgaccggcaggactctcgtaacacagtttatatgtgatcctacgccgcggaagacgccccatgtcaatgtgtgttagattaaaccccaaagagaacagaaaaaagcaaaaggaagtcgagaagaacagcgttccatactggagaagctcactgtactcggcacccgagaaggatagcctttcctccccgtcgagaatgcgcaacagtttctggaacccggccgctagccggcgccagccgtcctcgatgtccatcggaggcggccgcgctatcgccgtccttgtcattgatccgagagaatgaaacctaggcagccgcgaaggaggggagagtgtcgtgggattggggatttgggcttggggattgtgtcaatatggggtaaaggagagttgtaaaattggaacttggaactggagatggtgcttgatattgctcgtgcacagcgagtgactgaacaaagccagctgtctagagcaaactcaccgctttcgtgggctgaatgcgcggacaaatcactcacgggcccgaatccccacatctcgggctgtggtcggaaactcggaatctgaggacttgtgcacttttcttaactcgccgttacaacttcgtttttcattcgcatattatttaaattattaaatgatgttttctttaattttactatatattttagatctattttaaaattttataataattaacacttaattattgggactctctgtatagcgaatccctaattattaatgtgctagtattttactttattctacgtgcaactaaaaagttaaatctaagtcggagattccaacagatcgcccaatacgtcaactgatgaacattgatgtatgaaatactaatgggctatatctgtaggctgtagccaaacattctttttgtgccccaagggttctagggctgttctcgatcgaagaacttgtagaaattaattattagtagtactatctcaatttcatattataattactccctccgtttcacaatgtaaatcatttaatctagacatatatatatatctatctagatttattaacatcaatatgaatctagaaaatactagaatgatttatattgtgaaacggataaagtagttttgacttttcttaagtcaaacttttttttagatttgatcaaatttataaaaaaaatatagcaatatttttagaaaaaaatatgttcaatattaaatgtaatgaaactaatttggtgctataactgtttttatatttttctataataaatttgattaaactttgaagtagtttgacttaaaaaaagtcgaaacaaagtacaaatttcaacgaccgagatcatcaattacgccggataaccctattgccttcatggtatttctctgagactatgacctcgtttagggaaagctgaagataagaagtttctccatggctccgttctaagaagcagctgatgaatagagccagttggtgacaatccaaacatctggaaacagctgatgagtatctaaaaatctaggtttcaattagctagtgctaatctcactgtctgcatcatatagcaatgcggctgacagagtgagaatctaccttatcaaagagggctagagattatgagtgtcaaaagctttctaaacagttcctatgcagctatgcttctttcccatacttcaaattctagtcaaatagacctttccaacttcaaaaaatctaaattcatccaaggcaagaggggaaaccaaacaaaatcctacccaaaagtaaaatcgaaaatactagaagaggacagtgaccctttatggaaactccgtgcattgctatgaaaagttacgtgaaaaatggtaggataaggtagataaacatgagcggcaatgtagatttgctttgtacctcctaggcatttgacaagagaattcttgacaaaccaaaccacaagtatggatcatggcacattatctcccaactagaaaatgagaaaagtacaggagcggtctaaattttgttcaaaaagtaactgtcaagtcatcatgacaggtgatgggactaactgtaaaaaaaacaataatatggtcttagtaggcattaaaacaacagatcagtttttttagatattgaaacaacagatcagttagcttggcacaaataacatattgtgttgttccttttctgaagttcgtcaacaagtccagcatcctcttcccagtgtccaaaatgcttatccaattgcactttcaagctccaaatgtagacagcttttgacatatcctgcaaagcacaaaataggttttatatttcgagacagtacagctgtttgacagtccatgtaaaaagtatgtggcaaaatatttcagaagccgcaaatatgtggcaaaatatttcagaagccgcaaataacttgtgattcatgtccacaaagtacgtaacactgatcgatcacacacaaatagcaatccgcaccaatcaaatattcaaattacatggcatacaacaattgatcaactaatctaacattgtctgtgaaggctgaacaactacccaaaccacacaatcatacacacccttgccccaatttcatctcctgcccccaaagccaaaattaggtaaatgcgtagtcagaatagattcaatgactggtgtttaatcaagattttatctgactgcaattatttaagagtccacctctatcaccctctcccctggcccggtctaggtgtttgggtctggttctaactatgcttctaatgagtctggccatccgtccctcccttcctagtcagaattggttcgatggctcatgtttaatcaagatttcatctcactgcaattgcttaagagtccacctgctatctccctttcccctggcccggtctaggtgctttgatctggtttttgtaactatgcttctaatgagtcccaaatcctaatcgagcagtgataaaaggaaagctaaacataactattagctattttcactaaacaaaatcatggaataaataatagtcatacagcaaatgacaatatggacgttggcttcaatcaacaaagcagttagcaagtatcgcaaaaatgagaagagaaattctgcataaaagtcattggttagggttacataaattagaatgatgatattcatgctgagcacatccacttgagctgagtaaatcgaatgtgcaaatctagaattcgtgcagaaatcctaagcttgacctaaaaaaataattgctaggcaactgaaaagtataacaagccatgccttattgaacattcaacattgaaaaaagcaaaacaagcaccacatcatggtccagccaacactgaaatataagttacctcatggtttagatgctaagtgatcggcgtttagggcttcttgtagagtccatgaagactcagggcatgcacaaaagttcaactcaactgtggcaccgagcatggctgcttgtaaggaagagtgtgacttgttgattactaaatcactgatctcacggtcatagaatatcgtcattttttgcagggaagggagcctctgcaataacacggatgctaagcataactcatggtcagaacctttaaaagcctcatatacaaccatcatgatcttacgatcttctattggctcaaacaagtcaataatgcgatcttctgttagatctatagtgacattgtccagtttagtactctgcaaatcaagaggcacgtgtcatttaactcaggcatgatggtaccaagcaagtaaaaaaatatgttatacctgtatgtataggttctccacagatggaaagtatttcaatagacgccgcatggtgtgaaactcattatcatgcccaaacccaagttgaactcccaaagtcctaacagacttgcaagattgcccttcactcaatagtggcacatgggagttcaggtcaatgtaacctaaaacttcaagatccatatcgatttctgagttcatagataacaccatggttcgatggtcgccaggatcagggtgctcatcatggggctgaggctcagaagtgccaacattatgcaatatgagtctgcatagttttggggccacaattctaacactgtctcttgcagaataattccagagcaccatcctcttgaggctattagactcaaagtgaatcttggtagaaaactcgagaaaagccagagataacctttcgagctttgggcactgtgcaaccatcttcatcagtgtatcatggtggaactcacaattgacaatccccaattccgcgagattcggcaaatggaaatcaatggttccagaggggtccttgaacctgatttgacataaatacagggtctcgagcctccaccacttaagaatgttttctggcacaaataaaagtttagccgttggctgagctctattgagaaagatgaacttggtcaccttcttcgagttaaagagattaaaccaagacatcagaataataaatgcagactcatcatcgtctgtacagaagagaaaattagaagaatataagtgcatgatactttaagcagcgactcatctttaacaagcaaattgatgcaaaacgaccaaagcttcaagaataattacctatgcaatgtaattcctgcaccccaaatggctgaaagcacaagttggtgagcctcaccgtagggaaaggcccatcttgtgtggaaaggactgacccaaccctctcaatgagatccacttgctcgccattctgggggagcagctgttcgtcgtcaatttccataacggtggatagccaaaattcgctggcgaataagggacctaactcccgcaccatctttaccgggagatgactgagaacgtccctcatcaccggggtaccacggatatttgcagcgactggagacgagcgtgtggcaccggcataattgaggttggtgacggcggcgggggcggggtcggagacgacggccatctccatggttttcctgcgggcgagcatcttgcggtgggtgatggtggtcgccggcggcggcgggaggcaggagattagctcctcgagctgcaccatgcttacgagtttttcgatcctctctctcgaagaagcaacgtggatacgagtataggattagctttgccggcggcgggctagggaggcagcggcgaccggtaggggaggggacggtggaggcgggacagtgaggagtgaggagtgaggactgaggggggacttgggcctagggttgtgacttgtccgtgcggatcgacggcctttacgggattttcttttcgtccttccatgtcatatagcccatgaacaagcagaccggcccaagtcactgttctgaagccctgtctacaacgaataagttcactgtgagtccctcatctttgacgacgagtttaaatccatcctaaaccgtaacaccagcagacttgagtcttgaccccttaacatgcaaaattaggttaaattagttcctttaaaagtgtagatggatggttttgctaatatggtaagtttatccggggccactcgtgctgactagacgtttacgtgacaagaacaaaaataaaccccacatgtcatacagtcatactcactcccctccactcttttatctccctactctctctccccctcctctcagtcttcttcctcatctctctccgtgtctcccctctcttctcatctctctcctgcctgacaaaagcgaagggaggcggtgtatggcagcgtcacattattattattattattattattattattattattattattattattattattattattattattattattattattattattattattattattattattattattattattattattattatgctgaaaatgatgccacatccgctaaaacagccgcccatattaccaaaggacctaatttagatggtttttccaagatgagaggcgaatatttctatattgcggtttaaggatacaaaattaaactagacataaatataagggaactgcaagtgaacttattctaactggagtatgaaacaaagaggcccagcacaagcatatgacggcccaattcctattggcccagtaggcctcatcacacccttagcgcagaggaataagttcaccggatgtccctcaatttaacagcgagattttttaatatcatttacccctaaactctcacacaccgttcaccggaggtccctcggcactcggcagtatttttgcccaattttgttgacgtggcatcctagtcagcaaaaaaaattaaaagaaaatatgtggggcccacatgtcagctgcacttttttttttctctattttcttctcctttctcctcttttctccgcgtcgggctggccggacagtatccagaagaatcaggtcaacgccgacgacgggcgagcgcgggggcggagcggcgccgggctgcaggcgaagcggaggcgggcatcgaagtagagcgtgggcgagtggacgcgggagagcgacgtggtgttgacggcgccgggctgcgggcggagcgcggcgggcgagagcggcgatgggcgggcggcgggcgagctccaggtcgctccgtgcgcgccgcatcaccaggggcgcgacgactgttgggtgtgggcggccgccctcctccggctttgccccctactccccgcacatctccacctcctgccggaggcaggcgggcgcggactgggcggcgatgacgacgactcgcctcctcctctccccatctcccgccggcctcctctcccacttctcccgccggtgcggtcggccggctcccccccccccctctcccgcgggcgcgctacaggttgacggagacatcggcgatggcccatagcccctgctcaatgctatgagctttggaga

SEQ ID NO: 8120 - DNA, 5836 bp, Oryza sativa
gaaaatgcttgtggcgtcgaacagcttggagaagatgctgtcgtaggttgagggtctcgcgggcgtcgccgccggacacgccaccgctggggctcttggaccagatgtgttcgcctgcctgcgcgagcggatcagctcgtctccccgacgagccgccgctgaggaggtcaaggtctagcgcggccagcacagccgggctcgtctcccttctcccgtcgacgcgggtgacgacctctcccctttctcccgccaatgcggtcggccgcctctcccgccgacgcccccacctctcgcgtcggcgcgcctcctctcctcctctcccgccgcctcgtcacgccgaccgcctccgcttgccgctgcagccgcactcgccgacgcccgccctagcagccgcgcttcccgccgcaagccgcgctcgcccgccgcttgccctcgcagccgctccgcctgcctccgcccacgcccggagaagaaaaaagaacaacagaaaaatgtgggtcacttatatgtgggccccacatatttatttttattatttgtgctaaccagatgtcacgtcagcgaaaccgtttttgtatagtttaggggtggagatttctggttttgtggttaagcaaccttaaaaaatctcgctgttaagttgagggacctccggtgaacttattccttagcgccgaatatgtcgggccggatagcccaggagtctcgtcctcttcccctacccccatcgacgcaggcggcgctgtacagcggttaggagttcgacagagtggggagaaagccggcgagggaagccgaagcatcgccgccttccgccagcgccccaccggcggccggcatggacgaggagacgcagaagaaggtggagtccacggttctggagatcctccggggctccgacatggagtccctcacggagttcaaggtccgcaccgccgccgccgaccgcctcggcatcgacctctccatccccgaccgcaagcgcttcgtccgccgcgtcgtcgaggggtacctcgaatccctctcccaggaggatgagcaggagcagcagcaggagcaggccggcggcgccggcgaggaggggaaggacgaacaggccgaggaggaagaggaagaggaggaggaggaggaggaggagcggggaggtggaacgaagagggagtacgatgacgagggagacctcatcctctgccgcgtgagttcttcccctcgcgtgaaatcgctgatactcctttgtttcgctagatttcgcggtgggaatcggtgtgatgaggtttgcttttgcagctttcggccaggaggagggtgactcttcaggagttcaagggcaagacgcttctgtccatccgagagtactacttcaaggacggcaaggagctgcccgccaaaggtgatgcacatattcctgatttgttagctgaaacattggatttctgctattataatagaggacttgtcttagaactgctcggttaaaatgcaccttaatattacacatatatctcgaactttaccagttttattatgggtgggactgctgcaagtcagttgggttagattttgtttagacctcagaggaaatattacactctaccaattctgacatctgtataatcgaattgcatcataactgtaaattctctgatagctcgatctgtttaatattttgatgtgttttctgtgcttatctatcctcttctttcttggtctatttgatcacactctcaaatgtcacggagcatacctaggttttgttttgcacatgtatgagctattgtttatattccagtgttgttataaggatcaagggtgagttgcttaaagacaaaggggtgatgataagaatatagggaattgtgaattgggtatgaaaatattcttccagcttatcagtcctaaaaatattaacttcgtgcaaatttccctagttttttctattgtacttgctaatatcaatcttgagtgaggccgacctgtcacttgtctgttgtcatttgccatcatgctttgattgtgtcagcgacactatttttgtagatctgtgctattgccaatttgtaactgcttgattatggttaggattctccatttgccaattctgcaaatatttatcgtacagtccctgttatggcttacaagttgttgttaccaatttgacttcttgtctttactcttagatgattcatattggtagtactaggatatctattttaccttgggtttgcaccatctaagtctttagtgtggtttggaagttgttgtgcagtttgttttcttattatttgtttagtccagctgaacgtagttgctgaaaaagttaaatatgatgtcaggttctaactagtttataggatatttgaataggtgcaatgtgattaaatcttatgcaacagctacccagctctatttatattgttgtccaaatttagttttatgggaggaacatttaagcttagatgtctagctgatcctcaaaagtatctcccaaccttatgaagctatactacaatcttaggcataagcgaaagataaaagaaaagagtcacagttactccatagcctgtacacaggatcctaatagtgtgttgatttataatgtttggaatacgacatcacccctcagattgtacttttatcacaaatccttatattgaagtctaacatctgacaattgtttcacttgggacaccttccttcctaaaggatgagcctttgtaccatgttttttattttaccaccaaagatgaaaaagttcattttcagtttgctttgtgcctattgcatcctcttcacaggcattctttgtgtagtggtgctaatgcaatgcagttttgttttactttcatgacgtaactgtacctttgcgtgtgtgttgatatgtttgatttcatgtgcttcatttcttattttgccacgctgctgaattgcagggataagtttgacagttgagcagtgggaagcatttcgtgattctgtgccagcaatagaggatgccattaaaaagcttggagaatcatcggactgaaagcatgtttcagaagccccttttgcctgtatcaaatcaagaaggcctttgttctggccctttacttagggccagtacaggctgtaagtccgctatggagggtctggaggtactagggttcctataaacttttgtaaaacttatcccttagtcaagctgcatgatgctgtgtagggtagacggttggagacttggagaagtaatttcttcatatgctcgtcttaatattggagttagtgatgtacactgacatgcatctggctactttagaaaaatcagacatgggttccagcaacaagcctcttttgtttggatcatgaggcactgtcatcggactaactcatctttatgaagaattagttctccgccgctagatgttagtgtttttcgttcatgcccttacacttgacaattgcgtctttttgtctggaagttgcaatactgatatgttttgggcaggtgatctgagccctttatcattgtttctcgaaactgatttttaattaatctcacgggtttcacaccttctgccatcctgatgccaggataaaggttgtactataaactttagttggtactccatagtttccagcactagactttgtttctgatttgagcgtcacctccctgaccaggaaagatatgctcaaaggaaacaaccaactaacatcaattatttgcgtacgaattatagggaactatgatgtgagcttatggtattgataaagactgtcctagagtagtgaaggaagaaacggttgattttatagtgtcttggtagtatcatccaactcgatagctcattatggtctatttggaggagcttaataatttgagaatctgctagttgatagttaattactgagaatattgagaagctgagttatcttgagaagctgagttatctagcttctggcttctagttcattttctgtcttttacaactgcatattcttaaaatctgggtgacaatctggactatttagaggagctgaaaattctgtgagaaattgcagctgctagaagctcttccaaacatactctatatatgatcatgtagatttggagtagcgatatgcatatagatttggagtagcaatatggggaaaacaaagttacatttctagtttttgcctaccagttcatttatctgaattttgtagctattaattctaagaccaattgttacaatatgttctcgccaagaaagtgttgcacagttataaacacatatccctagtactccctctggtaaaaaaaaaacttaaatcctaaggatgaacatagacacgtactcaaatcctagggataaatctaaacacatatgtgtatagattcatgcctaagatttatatctttttgggacaaaagagtactccctccgtcccataaaaaaccagtctagtactggatgtgacatattttagtactatgaatctggatatatatatgtcaaattcatcgtactaaaatatgtcacatccagttttagattcgttttttattggacggagagagtgcagacgagacatgagacgaggaaccgaacctttgcaacttgtcaaccatcttttcaattcttaccaatacaccatcctcttgtaatgctacaagttgcacgttgctagaccaatattgaaaccgccacacgtcatgtcatgctacaattattctggagtgtacgtccaaggcccggaccacaaaaaatgaaaaacatttgtggaaaatgacaccgggaaattgctataactggtacaactttaattagacacatgatgataagtagtatgggcccccaacaaagttctcatagctgtatgcccaaacaagcgaaacaaaccaacgatcacgtaggcgccacacccagtcggcttgctgcgatgatcgatgcctcttatagctatttatggacactaaaagaaatgaccgttcgttgcaacgggaataaaacatgagaatttaagaaaaaaaaggagaaatatttacattacgtaattaattaaaatacaaatttcagcatccttactataaataaactacatatatttatatttatttcatccccactacatataaaatcgcagttacatacgatattacgaaaagaaaggatcatgaaaatcaaggtaaatgtgggtaataaattttcccaagtaataaaattaatttttattaaattttccatgattaattacgttttatgaatataactgttaaatgtagattaaattcgacaaactaaaaacgaattgaaagggaaaattacagggaaaataagaagaaggagttgggaatcgatttttgccattaattaaaggaggaaacgcagggaaagacatgggtataggttcagattggaatagataaaaagaaaatcgaacaaaaagctggcgtgcgcaagaaaaatccgattccaaaaaaagcaaaaaaaaaagaaggaaaaaccgattaaaaaagataaaaatgattaatccgatcagaaaataaacggtgagaaaaaaaagggaaaaccgataaaaaaagatggaccaaacaaaaaaccataagttttattttaaagaaaaaaaacgctcatcagcggagggcggtcgcatgcgcaccctcgtttcttccagccccacgcgcctcatttcttccgcctgaccttatcctccctctctctttcctctcgctgtatctgctccgcccgcccgccatatctccttctctccttcaccttttctctccccaagcggcgacgccttccctctccccaaaccagcgacgctgctctccctcctcctccccccacggcgacgctgccacccctac

SEQ ID NO: 8121 - DNA, 7105 bp, Oryza sativa
  unsure (1)..(7105): unsure at all n locations
ctcctctagcacgaatgtgggtcctgcctgagactaaggaactcgtagctaaagttggctactcggacctgagcaagttccgtgctttgacgatatggtatggaatatccgttttttggtgtggaggctaaatgccacaaaacctaccgtgaatggcctttaaggcgcgaccttctccacacgttgccgatgacggaattttgcgagctcagacacacgcgtcggccgatagtgcaacgaccccacaacgtacggctgtactgcagatcgacacggcaatgtggtggtgggggagcgacggagagttgctggttaaggttgttggcgcgtcacgtcgacccatcggatcgcccgatacgacgtctaagctcaccatttttcctttttcctttttttttttgagaactgtctaagctagcagagctcacctcgactgcccagtgcccgtcattcggtattcccgtgggacaccacgcccgtcgcactccctccgttttgcgcgacgggaccgggtgagagcgtgcggtgtgggatcgagccggccggcgagcgagatcgcgcaatgaggagggcaggaggcgcgacatgtaaagtactgacttgaagacgcggaacggccggttttcacacgagaggcagaccggcttcgacgacgaggaaaacttccagatgacacgaacgtgcgccggcgtgggacgttgacgatgcggaatctgagggagggagcacaggtagtccgtggtcggtaggcagttggtcaaagtaaaccgcgcgtgaaaactgtactagtgcttccaaaagattgatcatggactgcacatactaagcagttttgatttgtagtgactaagcagttctcttttttttttttccttaacacgccttgagcgaaaacaaaagcttatccaacaacgaggacatgtcattgccatatcaaagtatggaaaacccctatacgatgcttcaggctaaatttgtgtacatgcatcttaatctaacatttttttaagacaatgatctaaatctaacatataaatcaggaaaagaaatatataaatatcatctttgcttccattaattgcttgaagtcacaaggagttgcacctacctaggattcaaagactgataacagttggcagctataccgtacgcacgagtactgctgtactggtagtacagtactaacttactgcactgcactgtcacggggagggagtggtgacgctcaccccccgcgacatcgccgcgagcaccgtctccgccgtgagccgctccggcccggccgaccgcaccatgagcgtgtgcgtgacggcgtcgtccgacaccgccacgtccgacgccacgacgctgatctgggattccctcatggcgtggaacaccctggagatggggtgctcgtccaggggcgtggtcacgcgcagcaccacctcgtcctgcattgccttcacctccacggccggcccatccgcccgcgcgggcacgggcgcgtcgcccctgagccgggcctccagctcctggatgtacgcgatggcgtcgctgagcagggacgccttgtccatcttggagatcttgggcaccaccgcgcgcagcgcgtagaacctctggttcagcttctcccgccgctgccgctccgcctccacgtggttcagcggctcctcccgcccgttcgccggcttgcgcccacgcttccgcggccgccgctcctggccgccggcctgttcctgcacgttcgccttggagaagtccaagctcttggggggctcggctggtttcgccttgaccacctccttcttggctgggcgcaccggcgtggtttggacaacgagccgcggcgtccatggggcgtcgcatcccatgggctgggacggtcggccgggtgagagatccttgccgaagattctcatgaaatcttccggcggagctggcacggcgcgcatggcagattggatggcgcgcaagacctcgggggtctcgcggatggctacgacggaaccgagctcgagaacgccgcccttgcacgggaggaagacgacggtgcgtaaccccgcggactgggcgagagacgagcgaacgtaccaccctggcgcgctaccggagccggaagggtgggggtctacgtccgcccaggcgtggcggccggaggccagagcgcggcccggtccgcccgagccctccgggaaggagaagtacatggacgccaggaagtacatctcggcgccggtgacccggtccagccggagcgcgtagtcggcgccatcctcatccccgcctccgtacagcgcgtgcagccgcagcagcacgcgcttccgcgccacgctcctctccgcggcgccgacctccccgtgtccggcaccgtcgcggcagtggccgtcgccccagccgagcacggcgcgggcagcgcggccgctggcggcaccggcgccgcgggactcctgccagaagatgccgtacgtccaggcccctccctgccgctcgacgaggtcgtgcaggctcgcctgcagctcggccgacgacggcgacccctccggcgcgtcgaggtgcggcggcgtggtggccaggtgatgcgccgcgtcgtgccccagcaccgccgcgaacagcgcggcgtccgtctcggaccacgacatgcccgccggccccgctagctcgccgcctccgcctacgcgcgtcggtcaaacaaatcaaccgcgtgtgcgctctcttttttttggccgagacaagatgcgcgtggccttgtgaattttttaccagcttactacgcttttatatatagcgccgagccgtcgagcacgagacgtcagctcacgggagcttattggccacggcaagttgcttggctctcggctagctcggctgccactggagtgtatcggtggcgagtgctcggaaccagtgaagcgtgtggtgtggagtggatgcgcgatgtgaagttgcgatcgagccgggggctaaaataaggggggagctgacgtacggcgaggtacaggacttggagcgggttcgatgcaccaaggacgcgggggtcggccgccttacgggattgtgcggtttttggagcgaggcgtcgcggcatgtgattcatgttggccttttgggtggttcggccgtttcctttccgtcgatatggatgttgtcgcccctcgaccaaaatcgctatcctaccgtgaatggcttcagttcccgtgtagggaataccgtccgatcggcatagagcatcatggaccgtttgattctctatgtgaggaaggagagtttttttttaatagaactgaagggagggttaagcgaccatatatagtcctcccgcctttgctacttgcactctagagtggattttaaactctctagatattttcattgttttttatgtcacttaaataattataatcatacaacttaaaattcaacttttacatgccgcaaaaaaagatttgattgtaaatatacgttaactagtttaatttgtcttttttttggcaacatgtagaacttgaattttaggttgtatgtttgtgaaatgatatatcacatattaatatatcttctctttttttcaaatatttttatagctatttaagtgacatgtaaatgacaaaaaaaatatcctctcgagagtataaaatagtttccctctgcgtggtaccccttttttttcttcctgatcaagtgcacccccttgtcagctgtcacgcctctcaatcaccctctgatgtgacgaggaaataaccaacgtgtattctaatggctgttaaaacatactcatttcccaaatgggacaataacgcataaatatacttgtctgttcaaggtaatttaaatttgaaagttgttctagaagttcgtttgttgaaagctagctaggtggtcagcggggcggattcataatgggggcggagaggtcttgaaaccccactaccgttcccgggacagtggagacccccctaagcccccactaaatttttttctatagatccataagatgtggggactggaggttcgatttatactgatatagtttatttagcttccactattatttttttctagatccgtccctggtggtcagtgtggtcttaatgcacgacccataaaccgtagttatgatatgaacaaattatatgcatgatggttacgacaaaccgttcgttttgttgtggctggccacatcaagtcactcgtacaagcatatcttctagtgttacctatctactttagagatctcggaccaagtgataccccgactacatataatgtccatgccggatcctagcttccttggacttagcctcctagtgttatttaacacataagtcttttgctaaattgcagcgaggtgttcgacattggtttgtagggaacacaacacttgcgtttcaatgggatcaaccattctccttaggacgtttcatgtaatatatatggctgaaaattggtggacgagagacaattgtgattttggttaccacggaaaaagatctgttctccactagtgattgggagaaccgtttctacttgtagggcaacaatcatatttggtgtatccgtgcattaccatcttttcaaaatcataataaatttaaggcgtcattttcactggtttggaaaaaaaatgcaccctttactttctcctacgctaaaaaggctagaaaatgtttaattaggactacgattgcctatatgtttgcatgaaaaggaatttttgctcgagtgtcgatgccatcaggctcgtgagaaaatacaagggatggaggagatgaattgtgtgctattagcctattactgtgttcagcggttaacaaaaaggcagacccttttttccgtaggatagagttattaaccttttggtttctttgttgtaaaagtactcactccgtcaaataatataagagattttgacattttacttgcactgaccactcgtcttatttttaaaaaattatgcaaatataaaaaataaaaaattatgtttaaagtactttggataataaagtaagtcacaaataaaataaataataattctaatttttttttaattagacgaatggtcaaacggtgcaagcaaaatgttaaatcccttatattatgagacggagggagtaataaatatatgaatttaaggttgactaacccctcaattaaaatacaaatggtataaaaactcataagctaaatcttctactatgctggacacaactggaattaaggagcactggagcacaaatcttatcacataaaaaaattctaaatatatatacaatcagatgggctgagaatagagtggcaagtgctgtggaaggttgtggttgttgcacacttgcactacagtcaggcgtgctgaaaaggatatatggtcgtcgccaataatagccagacagtgcagtgaactggcggactcgtcgtcacctcagtgaggtttggttggtggcctaaatagccttatcaaattttgtcaatactaaattttggcaagttttgacatgactaattttggtaaggcaaagttgtgtttgaattgaagccaaaataacataaattcactattgaaatggcatattttcaatccatcagatccggatccgtcgtatttggcccccttttttgtccaacgggagagatgcgcgcacgagagggattactatttgacatcagcgcggctccggccgagaggggacagagagatgaagacggggacctccgcctcctcgacctcactgtcgtgagaggcgtgcgcccgcagcaaacccccctcgcggtggcgcgcgttgcggcaagccggcaacaactgaaagtggatcgtacgcgagagagacgcatacgggggtgggccagcgtgggatcggagcatgcacaggggggggtatgatcgctgctgccgttccgggcacgggaattcaacccccgtacgggtgcagtctggtccttttgaagatgctaatgatccagcccatgtgagagtatagtttcttcgcaggcttgcggatttggatcagggcatctttgcgatcacttgagattaatttcaacctttgcgtctggcgaaccatgattctttcctctttgtggtgggggtccagcatatgcagtccaaagactccgaactcgtccagatctgagcttggacacaggtgccatcatattcgtatatatggcttgatattttaggctcaactttgatagaactcctacttagtaggccaaatttcaaggattccaatccaatcgttggttaggagcggtaagaacaattggatcgcgcacgaatatcgcatggccgccagattgcacctatcagcttcgacatggcaacagatcgaccatcctacgttacactttgaactccacagtcagaactgttgctgctgctaatgaccttattaattggaagagattagattcaacatgatgatgattgatctatccctaggaatagagaagagcggcgccgctgtgcctttcaaggccgcgagattaggatcgttcccatggcacacgtacaacacactaaaaaagcatttttcccaacatggaggtctcattttcgcaagcggacatgacctttagagtcaaatgatcgtctacaaaaatataaattaaggtgaaatttacggtcagcatgtgaaaatatacttgaatataattaaatagatttggataggagtagattttttctaaggctccacacttcacccctctcttcacccacttcacccctctcttcacccacggccggcctctcccttccccacacctcacggccggcctcccctcacctctcctcctctcccctcccctcacctctcctcctctccctggccaccagaggggggagcgatggtggctacggcgcggggtggcgcggaaggcggcgtggccgcgcggctcccctcactccctcccctcctagatctggccggaggagggatgggggaggccggcgggggaacaacggcagctacggcgcggggccgcggcggtggcggctcccctccccctccctcctagatctagccggaggagggaggggggaggccggccggcggcncggggcggcgcggcttcccctcccaacctcctctcccaaatctggccggaggagggaggggggagg

SEQ ID NO: 8122 - DNA, 467 bp, Oryza sativa
cagcccgcaagccatccagcaggcttgctggtctgggccttgggggttgcggccaagtcccacctcagcgccaggtgtgctggcgctgagtgtcccacggtcagcgccattatggctggcgctgaggtcccagcccgcaagccatccagcaggcttgctggtctggccttgggggttgcggccaagtcccacctcagcgccaggtgggctggcgctgagtgtcccacggtcagcgccattatggctggcgctgaggtcccagcccgcaagccatccagaaggcttgctggtctgggcctggggggttgcggccaagtcccacctcagtgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgac

SEQ ID NO: 8123 - DNA, 1179 bp, Oryza sativa
gattctaaataataagttctatgatcgaacccccagaaaagatagtgtcaaggctgaaaaagcgcatcctatttctgtggaacatcaacaggagccatctcaggagcgtgaatctccggcaatttgcaaactcattccttacattggtctctgacaagctgagaacagctgccagctgatgaaagccatgaccagtgaggagaacagctcgaagccaaccacctttggagtctgccactctaatgatctcctcaagtaactgcatgtttagcacagtgaagaagaaaacaaaattaatgaatttggagaaacatgacccctgcaaggacagaacctaaacaactaaacgaatgaaacatagtaatgaacaaacaaaatactctggttatagcacatatctaagaaacataagtccagacgaatcagtcctagcttagccttcgtaagcaataaataaatatcacaaactagagacatactactcaatcaccattggtatagccatctgccagaaaacattaacttagtttgcatgctttatcgaagttctcctttgggcttactcaagcgtccacattcacaaagagtaaaagaggagacgagtagaccaaaatattccatacaagagtactaaactggcattagatttagaacagaatagaaacttggaggcaataattgtatgcaagataaaaggaggtttcagattgccaaattaagaaatgatgaagaatgagggttacccaaaactggaactgaaaaaatgatctgtcagaaatattataagctggatatctagttcttgctgattagatgttaaggttagaaggggcattaatcgaaaatctctagattgacacacatatgctggaggaaccatggaagtatggaacgttgtgtttcaatgtagtcaaacgttgtgtttcaggacatttttctagaagaacataaacacatgatcgagctgataaaaaaggagtaacctggtgatagatggcattgttgccagaagcaaagcacatgcataaattattggcaccaaagtcctaggtttgtttttcctcagccacatcaaggatcctaaagcagcaagggacagcgtcataacctggagaaacataaaagtaagccttctgggataataaggtataagtgaaatacatacaaggaaaatttttt

SEQ ID NO: 8124 - DNA, 6648 bp, Oryza sativa
  unsure (1)..(6648): unsure at all n locations
aaaaatatccactgtatcagtgatagtcagatagtggacaggacaataaaaactctgtgaatgtccattcaattgtaacagtccgaaaccacgagcatggataacaaactccatgcaactaaaaaattgggacaatatagtaacaagacaatgcatacataagaatgacatgaggaattcctcttgtctacaaaaagaagtgcacagtaaattgtaagtaattcgaatgtgaagtaaggcagatgaatcttaacactagaacagagattaaaaatcagataaggaaagatgtcaccatggatcagcacgataacttggcaggtttaacttcagttaaaggcattagatcataaagtgataacaaaatgtccttaccctgtttgtttttataatacatatagtttcctcaaatttcttgtgaaatataagaacacatgcaaatttattgatcctatcactgtgtatctctcctgtatagcagggatacttttctcctctctctcttggttcctcactttcatgcctttaatccttgtggccactaaaaatacgaattattgtttataatggagggaacactcaccaagaccaactgcctgaaacttgtgattctgggagatgtttctatgagtcaactgtgtcaaagcaaaataaagaccagcaacatctataaacccaataaagattttcatcaattcctgcaaagggagataacatgcaaattagataaacgccaacatgttaaacacaattaggttttgctaaagaaaacagaaaatgcacctgataaggatcaaagctatcattctcaggtactttgagcaatgtcgctaagcaaacaagctgtcagttaaatttgtcaaggttagtataatctcctttatttgaatgaagaaataacagtgataagaacatatatttaagaagcatgtgaaacaattaaaacagaaagtaggtaaaattacaagaacattttaaaaaaaatgcaaagtcgaaaagaatcaggatgacaaacttggatgagtttaaaattaaatccatataataaaaactgcatagatgggaagataactggtccataccatgcaaaatgatatatatgcaattgatacctttgtttaactaattaaggaatatcacaacaacaatcaaagatgaacatatatgcaataagtgttccatgacccttaaaactggtatgttacagaaatataccactattccacataagaaaatggtatctaatggctatgccaaacatgtgaaactttctgaatcaagaaaagtagatcacaagcgcacatgatcaaacaactaggaacacatcatttgagcctagcaagcttggcacttaccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatatgttaatgagacatcgagcttgctctgattagcataagaaaatttacatgctctgggggaacagggaatttaagatcaacatgggagcatggagtaggttgggtccaagggggaactccaacatgtacagcatggctttcaagagggacatgggacagaaatccaaatacccaatatttgcaagtctgaaaatgattgatattttattcaatggttcttatttctagtgtttgcacacgatagtatgcaacaccttattactagagtacatgtaaccaacgtttgatcaacaacaaccacaggaagagagttggaagttgacaggggccatgttgcacatgtatggcatctgcatcgccatcttcatcatctgctgctgcccgagtccagcacaaataacttgttgcatgctctgcatcatctggcaactggtgccacagtggcactgaggcatcatgccttgtagctgcatgcaacattgctgctgcaggagcgccattggctgcgacatgaacatggctgtggagctacccatgcccaacgtttgcatcatgtactgcctacacggatccatggtgcccatggctaatgttggtgggaaatactgcatagtggtgattgcagtagtggcacttgcagaaagagcaattaaggcaaacagggcaaagatcttgctggtgtatgctgccattgctgattctacaatactagtgttaaacaagattccagatggtgtagacaatattgttgaggatgatggaataatggttgcctaggggcctatttatacatgctggtagctgtgtaagccaggaaagagtttggcctttgcaaaaccacctagtggaggccacataagctggaaatcatgaggcatggaatttatttggacatttattcaaccaatacttttggaatatctacacaaagataattctgccagtgctttaatgcgtggaaagaaaatatgatgataaggttgtgccagattgctttggcattttgcagttttgtaaattatgagctggacaaagaaacttttgtgaacagaattcgtatgggacttgtagaatgtgttacacaagtcacagcttacacagataacaattaagagtttgagtcatcgccatatgtgaatgattgagtaggtaaacttggagctttgtaaatgtgccttaatagcatacatacatatgcagtttggcatgtatttggagttttgttaataagaattggaagtaaagaacattgttgtaaagggaaagaagtaaaggagaaacaaattttgggtccatcccaaaaaataaagcaaagattagagtttggccatactctttgctatcctactttccacatatctagttctttatcttacaaataaagagaaacgaggaagtaaacatatttcatgtaatcatattatgacaagacacatttcttaggcaggcactactgacaccatgcaagtatgaagttgcattattttcaattttaactgatattataattatccagtgcagcgatcactgcagggtgaattgggatggagaactatgcaatgtccatgttcagaatcttcatgtttttagtactagagtagtagagatgtaccaaacgtgatgtatagatctcaaaatttccatcctggattgaagaaagattcgaccccattccgaagccatacaacaactcacaaattgcaattgagttcaatgtggtctgccggtctagatgactagattgtgataaatctagggttaaggcttcatagaagatagaactgattcatatgctcatgtgtatgagtattgttcatcgcttgagtagataagttcaaggacaaatgattttcactgaacttggatggagaaaactgttgcacaaggtaagatcaatatattgctgaaatagaaaatatctatctgacatgctgccaggtaccaatgtgctatgaataaaccatcctagctacttatcttgctaacatattatatcacgaataccttcaatgtgatctcccctcagctagaatgaagttttctttcactgtcacgaagttactctactaatgagatgtatatggttggcaatttggcatgcattttccagtttcacaacaacatgttcatcataatatcaagtggcattagttagatcactttatatttgctgcatttgcctcataaaaattgtattcccagatcgtgatcccgtctagctctgaaaacgagctaaccgctcatctgaacttacttgatactcggaggtagacataaaccaatcagattcaattcgagcaacctagttcagaaaacagagcatccaaaccagaacgagcaacgcgatttcatgttctccaacaaacggtcacacgcggaaccaatctcgtgccaatccaaccgagttgagcaaaatccactgaaattgcactgactaaaccccatctcacaagccaaaaacacacagagaaccggcagcatcagggattcaagcacctccttccgctgacgacgcgacgaatctctgtccagaccgttcactacaagcagatctagcacgttcgtgatacggatctcgcggcgcaaggggagatggaggggggggggggagagggagtatacagcggggtggccgagtagtagacgacgtgggggccgaaggtgagggcggcgcagttgaggaagtggaacaccgtcatctcgtccccgccgccgccgccgccgtcgtcgtcgtctccggcgtctgagcaagcaacggcgaggtcggatcgcccgaggtgcgcgacgacttgggctggactgcttgagtgatcgagtcgcaccccatcgaggctaagtaaaagtatctcgggccacgtggatcagttaatgggcttcgcataatcactcatgggcttggagcgggaggatgatggcccataaaacaacatcccgcaagtcggtgacagtacaccatcccggcccaactaacaggccactgttagtcggttaggcttaggcagcaacgttgtttgatccagtgatgggtcacactcccacgtgggaatacaagtgtaaatattgaacataaatcgaaactttatttcatgattcttattctagccagtcgcacacgatagtatgcaacaatttactgttggagtacatgtaaccaaggtttggttaacaacaaccatagggagagagctggaagtaggcaggggccatgctacacatgtttggaagttgcatcgccatcttcatcatcatttgttgttggccaagtccaccacaaatagcatattgcatgttctgtatcatctggcaactagtaccatacccacactggcactgtggcatcatgccttgtagctgcatgcaacactattgttgcaggagagcaattggttgtggcatgaacattgttgcgtagctatctgtgcccgtcgtttgcatcatgtactgcctacacggatccatattgcccattgctattgttggttggagatatggcatggtggtgattgtagtagcggcgcttgcagaaagagcaagtaacgcaaagagggccaagatcttgtatgctgccattgttggcactacagtgctactatgatattgttgagggtgatggtatcgtggttgctgaggaacactatttatacatactaaaagtcgtgcgaggtaagtaatattttggcctttgcaaaaactacctaatggaggctagataagctataaatcatgaggcatgacatttatttggacaattgttcaactaatattttggaagaatacatggtagatactaagatgacgttgtagatatattcaaaaggctatcttttgccaatgctttaagaaatacgtggaaagaagttatgatgataaggctataccataaaagtttggcacttcataaaacttaatttgtagtatagttatttatcgaggtggatcaagaaacttttttcaacagaatttgtttgtgtcttacaaacatgttaatcaacaattcacatataaagtaccttttcaaagctttgtaaataggctttaataatagtatacagacatatgtagctaccatatatgtttggaattttgctaccatgtatttggagtgttgctaaagaaacatgagtgagtgaggttttttgaagggaaaagggataagctacttctgtgactacttgtttttatctttactcattacttgtgtatgtttattcctttatttttaaaaacagaaaagaaatttgagaaactcaaagtatttgtttattcaaattatgaaattaaattttatttaattattccagacactacaggaaatatggagtctttaaactgaaaatataactatatttttaactagtaagtaaagtcgtgtagggatgaccaattcttcttttggatcatcacatgtcaaattggaatggtggggtggtgaaatttagaatgcctgtcactcttgatgtgattagtaatggagacaccaaaaatgatgtctagattgcaaacatttcatcttagataggataaacatgttttgttcaattacaatctcattatggaagtgatacgacagctcacaaaattgcatgagttcaacgtgttctagacctctagattcttatatataaaggtggggttaatgtttcaaagaattatttcacatggtccttgtgtattgtgattgcttgagtagataaggttcaaggacgagtgagttttgactaaattaacatgataactagatgagcaggggcaaaaccacgttggccttctctgataagcatgacccaagtnnnnaagcttgcatgcctgcaggtcg

SEQ ID NO: 8125 - DNA, 4923 bp, Oryza sativa
  unsure (1)..(4923): unsure at all n locations
taactatgaagaaaaaagggggaagcaccatttgaatttttttaaaattcatttaatttaatggcaatttaaaatttaaaactgtacaaaaccatatccattccacccagtgcggcccaactgctgcccgaggcccacactgaattcctccctcactttcctcgcatcgcaacgtgcggagatgcagcaacgtctcgacgagtcgacggcgccgcgacggggagcggccgtcttcgcatctctcccccattcaaattccaatactccaaagcaccgttaatactactacttctctcacgaatccccaatccctaaaatccccgtacgccgcccgcttctctcctccgattcctccgccgccttcgcgccgccgccctcgcctctcttgcgcctccaccggccaccgccgcggcgtccgatggagaagccggagtggagcatggacgacttcgagatcggcaagtacatcggcgagggcaagttcgggaaggtctacctcgcccgcgagaagcaggtacgcttccaagccctagccctagccctagccccccaacaccttcgatttcgtctcgatttcgccttcgttgggagctgattttgcccggggacaactgcgggtggtttcagagcggctacgtggtggcgctcaaggtgacattcaaggcgaagctggacaagtacaggttccacgcgcacctgcggcgggagatcgagatccagcacggcctcgaccaccccaacgtgctccgtctcttcgcctggttccacgacgccgagcgcgtcgtcctcgtgctcgagtacgccgcccgtggggagctttacaagctcctccgcaccgtccgccgcttctctgagcgcaccgctgctactgtgagccccctcaccccctagcgcctttcatcagttcaatttcctcccattttcttttgggattggttttgttgcaatcgtgtactattgattacgttagcaaacttactgttcgcccgtaatttttatgacccaaaccattcgaaaattcataatcggcataaaccctgtatgttaaattctatagctctacagacatacggacggagtagtatttaatttctttcattgtcaaatcttttgcaagtggttcgtgctattggatctgctagaaattcccatgatctcatcagaacattgcgattcacaggctctaacanttttccagatacacatcactttttttttgcttccattacatgaaatgaactaaagcattgtcacctttttatgtctataaaatctgacaaagagtaacacaaggatatgctttcagacatgaattcatggaacatcatgagtaccagttttccattaaccaaaaaagatgaacatttcctttgattctttaccataagctctgaacagaacaacatgcacctgccttgccatctatgatatctcaggccctataattatgatgtacatatgttgctttccttctgattttctaatgttcacattatactttgtgatgaccttgtaccttgtttatttttagtatgttgccagccttgccggtgcactancatacttgtcataagaagcaagttatccatcgggacatcaagccagagaaattactccttgatatcgaggttggttcttttatctgcagttttgcacctcttctactgttacccttctcaacaccatcttccataaagtgttgcaagtgaattgaatagcatcttcctcttaaagaaataactgaattgtgtcatgttaattagtttgaaggtatcttcgccttttttttcttcttaatttctactgtctttgtaacaagtttcacaacctgatggtctcagatatgcacatgtaaatataccagattcatgatattttaatctacagttgatatggtgtttctgaatgaaacattttctttgcaactttgcatatctgatttgattcacattaagtgtaaattatagagctttgtatatgtgaaaaaatatggactgtcaaatttgacctgatggaactttttaaatggaaatggcaacttgaaacacatgtggaatggaagaatatgtatgtaaatataatgcatccagattatgcctgagtagtagtagtagtagactagtattatggtacagatcttacatgtaaataatgatgggacatgacagagaatgcctctactgaattccacacgatgttgctggtttgaatactgtatatgtggactggaagctaagttattacaatagaatcctctcattattattgaagaatggatagtgtcaccatgaatatgatcacatgctatcatgtaactctagttttcttgcctcaaatataagagtagaaagttgatagataacagtctcgatgtgttcatatgttgtgcctgatggttgatgtgaccttaactgcgtgtcggtacatgacatgctaacatttgttttaaataactatgtacctcccccttttccagggccgacttaaaattgcagattttggatgggcggttagatcaaatgctaaacgacacacactttgtggtacaattgattacctggcacctgaaatgatagagaaaaaggctcatgaccatgctgttgacaactggactttaggaatcttgtgctatgagttcttatatgggtcaccaccttttgaagcagcagaacaggatgatacattgaggaggtaagacctactgtgttgaatgttttgtccaatcttaatttgttacatgttttcactctccttaatatgaattctgagcaggatagttaaagtggatttgtcgttcccctcaactccttatgtttctgcaaaagttaaggtttttctttgcaaggtaaaatttggggtattgattacccctattgtatatgttacactaaaatgggttgaacttttgagttttgagcttcgagttcgtatgcagcttttggtgaaggattcaaacaagagactttctcttgatgacataatgaaacatccatggattgtgaagaatgcagacccatcagggagttgtagtgaccaaaaggctcgcacataatacctttaagaaacaaggtacattgggaggcataacgtgctaatgaaatacacaccttaccttcccagtgatcaccctagtatgctgagctaaacattaaactttatacacatttggtcaggctacattaaaacgattctgttctgttctcattatggactataataatttgcttcatttgtttgtgaagcattttaggcctactttggattgtaggaattctagatgatattcggaggtttcatttcctgtattattgagttactgttcacccctttggattggaggaagaaggcataggaaatttggaggaatttttcctttgcctttgatttcgtaggtagtccaagcaaatcaatgcatgttactccaaatgatcatagttttaaacacatactaaggaaaataatacacattttatgcttatttaggaagagtcctgtgttttactctatttatgtgttccaaacgatatgtatcatattttcctatgtttttcaatcctatattttgcgtatgcaatcctatcgtattactacatttttttctattcctgtttttccaattcctgcactgcgaatgagcccttgactaccaatagtgtccttcagctttcccaaaccttgtctgagactctactttggaagtggcaggttaagggcttgtcctgtaagatttaggtgctgtgagaagttttgaaattagaccaaagtgtagtctgatgcagcatacgaggagttagtttttccaccttgtgcccgttctgaatttggactcaaatccttgtggctttccctgctctcttatttgtatttattttttggctcttttatgcaggttactccgtgtcattgagggacctggtgaaggctggtgtagtattttggcgaatgcgttgtttgccagtggcccgtatttttttagctaattaagtaattatggatgtctatatgtatccgctaatcccacctcactgggaagccccaagctacctaactacactggctaatgcatgacgtgaagtcctaccatgtttatgtttgctgttgtccgctcctaaaggaagttggctggtgtagccgtaccagtttatgaccctaatcctcatcagtcatcggtgatagcatcttcattaccctaagtgccatgttgttgttgtggataaagttacttaacggaaatataagtataccaagtgcatgtctacctaccttaggaaaattggttcatatcttccccatatttggtctagttcggtgtggttgcgctaatgatttaatctaatgtagcctcatgccgttacacgagaaactagtgcagttagaccttgaacaagcaacatagaaagttgattaggtcataaaagtcaatttatcatatgcttcattttgaagaaatttagtgcgaattcgagtaatttctgtaaagctctggcaaaattcctgcgtttggaagtgcaagaaagaatattgtgtgcctcgctaatccagttatctgggcccaccagtcagcgtctgatttactccattaacgtccccccatctaatcctccgtcttccccacccttccctccgtgaagagagatccccatccaccttcggggaaggtaagcctcgagccctcgactcgagacctacctctccccgagctcgaatccttctcgaagcttccagattcttccacccccccccaaccctagccatggcttcctcctcctcgcctctgcccttctctgcctcctcctcctcatgctgctcccctccccctcctccttcggctcgttctccttcgccaccgcttcctccaacgcctccctctccaccttcagcgacagcgacccggagccggagctcgcgcgggagcctactttc

SEQ ID NO: 8126 - DNA, 11101 bp, Oryza sativa
gtgattgaccaaattacaaaactgatctaggggctgcaattctctcgtaaaattataactactcccccttctctagttgttggtgaatcaaattgcttgttgctgtttcatttgaatgctaaactagatcaatagaatcccatgtttagcttgtatgctgccaaccaattaccatgtattggaacagggcttccaagtattagatcgttttatgctgaaggctataacataaagtgcaatatttctatgtatgagcaataccatatgaatctcttcacgtactaatacatgcaaaaccatttggtaaagtgagttgtatagatgcaatgatggactgcttttttcaattgatgctatgtaatttatcttaaatgtgacattctggctgcttgagctggaatttagcttaacgacaaaatataagattggatggcagttggaacagaacacaaacattttctttaccatattatttggacactaccggttgttctgcgtggaatggaagggtcatggtctcatagatggcataactaggcatgcagatgtgtttttgtggttaataccaagtgtaaagcctgtaaattctgttagtaagagagtgcagtgctttaatgtgcatttggaattctagaaatattattagcagcagaatgcagttgtgtaaatggcattttaataacatgctattctatttgatagatagttgtaccatgcaatttagagaaaggctatcaacatgtaaataacaaggcagatgttgcaactctgttggcaaagtttctcgtttaagaactttggtagagatattttagatatttgatttagggttatgctattgatctttctttgtttgcaatatagtaatgtatacaatggttctctgtacgtaacagtcaccaactaaaaattacttaaaagagggtatctgttttccatatcctgtaatcggggcaagttttatgtaactaaaagggtacttttgttttttaaagaccggtcatctgtttcacgcaatctttgttttagcaatttccagcatttcgcaacatatgttgtaatcccaccttgactgcttcagattcttatgttgcacttcttatgcagcggaatgctacctatgcaggactgaagagggtaattgttgctgctggcgttgcattgaaggttattggtgcgcagaaagttatctttacccatcctcacagtataggtcttttaacaaatggaagcctattggctagtaataatgatccaagtcgaatatggcctctcagctatgcaacttgtgctccgatacttcaagtcagtgttgtaggatcagtcatgatagttgttaatgaaagcaatgtgcttgggaggcggagatcacatgacactgtggagttattatcagaaaaatgtgaagtggatgtagcaaaccggttgatctcagtttgtgtgttctgttcaattagttcaagactgccaaggctagataaaatcttgaagacttggtttagcaataaaactcaggatagcaaatcaatgcagtttatccaagctaaagtgacatcaatacctttgataaaattccgtttggagcttgagagggacatcactgaagaggatggcatctgggaaaatatttccaagtggaaaacagtacctatggtccagcgcgtcgcacttgatgttgtagctaaggttgaagaagaaggcaggctgaaggctatgtcagtgaagaaggttaaaaaaccttatccagtagtggacgcttcttcttggagcagcttgacttcaaatatttctttcacaaagttcatgtctttcgttttgccaccagaaccgttgacactggatgtgaagtggtgatattttctggttctcatttactcatagggtttataggaaattgcccatattaatcaaatccgtgtataattgactaggctgaaagaagttgtacctgaaaatggggttggaatgtactactatattaaaattttggattttccctgactaactgtgttgtttcaacctcattctttatagatgttagttctcttgtgcaacgaattttggatgctagttctcttgtgcaatgtcagtgcttacatgctgggattatttctaatgtggcaaggaagattgagattagagttgctccaatttgtggtgttgcgccaacttttgtatgtctagggatgccattaaacgggcataaatgatcgcacaatgatggtaccaaattggatgaggatcctaggttcatggcaatatgaaacggcacttaaacaatggacgtttcaaaacctcaaattcattcatactaggctcacagcgagtgtccaaaaagaacaatgagttgacccactttgcgttgtacaagagcaaaatttaccatcataccggtacaaaccacacaggaataatacatcaattcactttcaatcaacaccgcataaattgacaaggcttgacgaggaacaatgcatcatgctttctatttcttttacactaagatttgaacatcatctgacgcccactctccttgtgtctgaaacagatcatccggagctaagcctacaactatggatgttcatttatccgcgttttataaatatgaaggaggtgccttcttacattactgagtacaggaattgctgccttttaaccaagcatctgccaccagggcaggcaaaaaaactgatagtcagcccatctgccaaagggtatttgaggcaaggcgacgtccagcataacaaaaattaagaggaaatgtggctcagctcacattgaagctcggccaaaagaatggattggtttctggtctgccacaataaatatttctcaggagatgcctgctgtgcagtgaactgcatcatgctcaaagaccgtatgttattttcgatggaggccagtatcgaagcacagatctgccaagaatgttcttcacagggagaggtcccctacaatgacacagaaacataagatacttgtggcaaactggcaactgggttaacagcttaggtagtaacacccattgagattttgcataccaattatgtgaatcgaagctgttgtttctgttgtcccccagcacaaacacgtaaccttgaggaacagtctggcaaaagtaaccacgattgataagtatgtatgctccactatggtcttagcaaatgagcattaatattaaagcgacaaactcatattcccctataaggccataagcaaatgaagggtacataacaaaaatgatgcagtcaattcccacatttcaagcatcttaatgtctgatctaacagagttggcactttactcaaatacttgatgccatcaaactgtgacactaactgaaagcaaataagtactcctagtacattacaacatcaagtacattagtatccaatataaagagatgttgccataccacttgatccatttcatagttgagtggctccagcacaaattcctcatcctggactactccattaaccaataatttaccatcacgtacctaataaaagcagggaataccaatggtcattactcatgcaaatggcaaagaaaagcatgaaattttttggaaaaaaaggaaaacaaataggagtcactaccattcggataaaagcttacttcaacggtatccccacccttggccacaattctcttgatgaatacatctcctgaactgcaccccaaggcctgaaaagatcattcaactactagtcataacaaattctattatgaattaaatcaggcaacagataaaagggagaacatacctgcagaactgggggggcacggaagatcacaatgtccaaaatattaggctcccggaaaacgtatgaaacctaataccataacaacatcagcaaacacacatcacaaactattcttactcatagaacaatcaacaacaggaaattgactttaccttgtcggcaaggattcggtcaccaacatcgaatgtcggatacatagacttggatgggatggaccttggctcagctaaggatgatctatataacagtggcacagtcacagcggcaaaaacagtcttggcatcatccgaacaggagctcacccaccttgatagccagttcctcctgctcacctctgcagcagcaccaagtgcaggactgctctttctcaccattccagcagcaccggagttaattgcgccactaccaaccaatggtttcacgcccacgcccacattagaagaggcaccactggagttgattacgccggagttgattacaccactaccaaccaatgctttcacgcccaccttagaaggggcagccaccgcaggcgagggcacatgtgcaggacggggcgaaggcgcaggtgcaggcttagttcgtgacacaggcgtaacagcaggcgcagcagtgggcgctttagctacatcaactgggcgagccgatttgcgggatggcgccgcggaggtgatgaggtcactgcaagggagccacttggtcccctgcaggaatgggaggagcgccgcggggttgaacgctgacgatattgacggcgaccccgagagcgatgaggcgcccacgcggccagtagcggagcccatcccggaggtgaacaccatcagcaacccgatggccagcgatgatggcgggtcattcaccggagccttcgttgcgcacgaccgcgagaggagcagcgaatggccccctccattggcggcgatggcggaggcggcggggagagcctttgccttgggcttgggcttgggcttcggatggttgtgatcgtcggcgtcatggtggtactcggagtggcgggaggaagcgaagaggcagaaggggcgggagagcgcgtcctggaggaagcgagccccagcccccggcgccgcaccggaggaggcggcggcggcggcggtgcagcgcaggccaaaagacgaggccaggctctgcgccacatagccggagtacgacatggtgatgcggatcgccatcgcgaagctggactcctaatctccgggatcttactggagatcgtcggtcactttcataccgtcagccgggacggcggcggcggcggagaggggcgcggggtatcggggggatctagggttctaccgagtaggaggcgaccgctacaggggttcgtcgcggtggcagcacgcagatcgaggatgcggcggtgggaagggtaggcctccggagatatgggaagtcgccgccggtggcggcggcggcggcggaggaggcgagttggggggaaggagagaaggtgggagatggggatggtgggtggtggaagagacgcgtcggcttttttatgtcgaggcggagtcgcggaggccgctcggattttccagatcttttttacgattgttttttgcccgcaaaggttggaacgaggtgggtgtataattggatatttggatatgtgtaaattcgattttgcaagtgctgaaaagttttgaagataaaagagggaagtggtgcgatcgtttttaaatttgaaatgtgtgtttgactgtttgtctaggaaacaaataatcatccgcttaaaacttaaatcgagttcttttaaacaactcgatattttttttcgttttacattagcacgtttctcaaactaataaaatgtttcgtaaaaaaaatttctatgtaaagttttgtttaaaaaatcaaacaaatttatcttttaaatatataatagttattaatatataattaatcgtgcggtcataattcatcttttttttggggtcgcgaatagctaccgtcaaactgcttattcgtactggccctcggtcacgcggtcacgccaacgaaagttgctagctaggctgtcgttatgcggtagtattattgttttcaagaataaaaacaaaggatattcttaggtactttttctgtcaaaaaaaattaacatgtgactcctcttaggatagtttatattcgttattctaggaggcgtcacatttttttctaggttgaggttttttttttttttagaacggaggggtaggtgtacaggtgtaacatacacccctttacaatgagtaaatattatttatatttcttaaatcagaactcattagtcattacaaccattattttgtgcactttatatctatacttgtagctaagatcatatccacacacaaagatcaaggatgtatactgattccaaaagttgcgaaactacagtacacagcaccacaaaaaagaatggccaaagatgtgcaaaaatcagagaatccccaccactagagggacagatcaaatcatcaaattgcacctcccactatggtatagggcatgaagcggtataatgacctgaagctatgcagacaacgacatgaaacacattttcactaacttagggtgtgtttggattccagccactgtctgccgaagttacagtatttttgtcacgctacattgttttgtgatgtggacaaaacgtccgccacacatgtggcgagccacgtcgtggcatggcattctatgccgccaaccaagcaaacccttaatattctagccatctaatatcagatataatatatcataagtacatatagtataggtgttttaaattttcggagagagggagtaagtgctaccatgaccaccacgtcaattcctatagctaaaagcaacgggggatgctgaagttgacaattcgcaagaggttgccgggtgctgcttcttctctgatgcttcttcccctgcataaggtccaggtcatagagattgagtgagtagtatttgattagtacctcgtaagcatgattggtcctaagagatagcagtgtatggccgtgatctgatctccaagctgcatggatgaattcaagaaacatggtaagttcttatcagagttcaacgtttcaagattgcagtaaatgtaaatagcataggatgagctttagttgaagaattcagatttcagagacgaaagacgtgcggacacgggataactgagaaattggcgtgtatatattttgtgtataatgatgatcatcttgtaagctgtagatgccaacaaaaaaaaattcactactttttaggtagctgacgtttgaactgtcgtaagcactcacgttgcacaaagtaacggtattaacaatttggttaaggaggcaattacaaatcaagatgccgacttagactgggcaaagcaccggaattttataatgaaatgacagcgagccatgaggcaaatacttcagagaacttttgcagtataatttacttacagtatataactatatattgtcaatataaaccattgacgggtatagattgatcatttgatctgatctccaccttaattgggttgcaatataaaattaaatgaggaaaacttgacaactcggttctgggatcaggagtggaaaactagccgcctgacattggcatgatcaaaccagagagccgattccatcttgagctattgcgatagtatgatttaccccttaaaaaaagagatttcgagagatacgtccctccaaatattttttttaaaaaaatcgttaacatgttggggattgaatacagaacctcgaggttaaaactacaccccccctttgccccttaaattaggacattcgacatctcaaactcttaaatctggacgaattaccccccgcccccagcactatcttgggcggttttaggctaggctagctgaccaaggagaaaagcacaacctcaaatgccatgttgaagaaagacctatggcgtttgaggttgtcacgtcaataaactttaaactttgtcatgcgaacacattaactttgcgtggagaaaaggtcatcttcttgcatgcaaacgggaaggccatgggctcatgtatgggaaattaactcggctgcaaaatcgaacagcctttgcaccaaaagaaattaaatctgcatttagattgtacaatacgcttattaatttggatctttttgtttttgcttatgcggcgatcaaacgtgaacagagggactattaattattttaaatttagaaaattaatatgcttttttaaaacaacttcgtagagtaaagttttgcaaaaaaaaaaagcgcacaaagcttggggaagcatacgcatggagaacgggagtttttttttatctactaggaaagaacacagcctggagttttttttatctactaggaaagaacacagcctaatattagattagatttgctagatatattttttacattcctttaagaaaacaaaactgagaagtgagaaagtatatcggtttccaagtatatgaaattgattggcataatacgggtctaaattatcgggagcaatagttaattgcacgcggccgttgtttttctccatggtgtccgtccgtagaccccaaaatcgtcacccaatcataatctgcctaaaaatatgttgttatgtatggaattggaaacaacgacccagataacccaaagcctcgtggcttccttcgactatatataagggccacccgatcaagagacccctgccacaacaaaaaaaaaatatgggaaattgtgtaggcgctagcaaccgcagtacctcgcgagaaaacaagggaaatcaccgtgtcagccgtcggtacggcgtggacggcatcaccgtgttcggtcgagcacacgaggtgaagctgacggccaaggtcgacggccgagtttatcgctgcatcaaggtcagggaggggatgttcctcacgctagcgacggagtacaacatgcctgcgctgatcggctgcccgggggacgaaccgaggatgctgaccccgtacgtggatgacgacgaggacgaggacgacgccaccgagtcaccgaccctggcgcgcggcattaccgtgtgttttgcaagaacctgccgttggaggtggtggtccgcgggggccgcattgcctgcgtcaagattcgtggccggaaacaccgtaggcattactcgctgcgttcaagtcaaactactccaaatttaattaattttataaaaaaataagtaatatttttaatccaagacaaatatattatgagaatttattcaattatagatataaaattatactggtgttataattattactattttttctacagagttcgtcaaactaaacttaaactagattagtttgactttaaccaaagtcaaaacgtcttatataacttaaaacagatggtgtattattctttcaattacttcatccgttcaaaaaaaaccaatctagtactagatgtggcatatactctgtccagattcgtagtactagaatatgtcacatctagtactagattcgtttttcgtgggacggagggagtatgttctaacgaatcctatgcccctatcatttcacttattccacaagaagtgatactacctctatcccaaaataagtgcaaccatgaaaatccgtgtctaacgtttgaccgtttgttttattaaaaaaattataaaaaaatttaaaaaatagtcatacatgaagtattattcatgctttattatctaataacaataaaaatactaatcataatttttttttaaataagacgaacggtcaaatgtttgacgtgaagtgtaaaattacacttattttgaaacgaagggagtatttgcaaacgaaaagtgatctacgaataaaacttctatttgtgtgtgagtttggccagccgatcgtatgcatgtggccatgttatgtcgtcgctttgatctttttcgcgaacgcgcaagaggatctttgctagcacgaatgtatgcatcactacttaaaaaaaacttcgtgttatcgtgctactactgtcgtgttacactcttggtaagcgttggttggcatttttcaggcatggtaagtgacaggatggtgcagtagtcacaatttacagattgtgtagaatacgtttgaaacaccagtgcatctgcaaatattgctcaaacaagtcactgcaatgaaattaagcatcgagttcttttcacaaccaaatcagtgagaggaaaaaggaaaagaaatatcatcacgctgaccagaagttaagtagcttgtcaaataaaatcttataaagcaactttacggtttattactgagtacactcttgtttcgatgagcacaaaggttttcatctgtaaggtgaggcagataagcagtgatatactctctctttccctaaatgtttgacgccgttaatttttttaaacatgtttgtctgttcgtcttatcaaaaaactttttgtgaatattattcaaaaacttgagtagtagtatatttaacaatggatcaaatgataggaaaataattaataattgtttaattttttttgaataagacgaacggtcaaatatgtttaaaaaagtcaacagcgtcaaatatttagggacagagaaagtacattataaagaagaatcgtcatcactttttctaatatgagcaaaaacttctaaagcaatcttatgctacactcttttttgagaacatcttatgctacactcgaagggcgcaaagctgtggtgtactagagccacatataagattccaacaccaacaaccaaggttgtagtttaatttgtttttttctttacgatatgtagatattaaattttaagttacaactgatatattacatattaatatacctttcttttcatgattaacatgcaggaacatccttcgagagcttagaatagaatagtttccccacgtatattcatatacaaaactaaggatcaccattcacagctagattcacttagctagctctaccatgattgctcgctaaacaagttgatcaagaaaacagaaaatgagctagatcaagaggacagaaaaggagcagagtcaaaagtacatgtaaggagtttgtgttacacatctatcacctttttggggtcatcgtcctctgcaacactgctaattggtatcaaaaattgaaagttgaagcaatcaagcaggatgggatggaaactacagagttctccgtactaacatcctgtcagtgattaagatacaatgttatataatattcaatacgtaacatgaaagcgaaaataaataagattagggaaagtaacttcataatgccagtaaggaagctaacaggtttccattatcgaaaaagtaagaaagctaacagacagtgtgaaatacacaatgtt

SEQ ID NO: 8127 - DNA, 12284 bp, Oryza sativa
aagaacgcgttggttttacaaatttagaaagaaaaagctacacgacattgactaaggatgtccacacgggttacatgtcaagttaaataaaaataacttctgaatcaaatggtcctttaatccgttctatccagttacacatagaatattatgtgtacctccaggtggtgttctgaaaagtgaggtgccacccaaagcagaagacgcaaatcttgctggagtggatcctagtgcaagtgtggaagctgagccaaatggtgtgggctgcagcatagacccagatgaactgaaagggctgggtgatggagcaggacttgtttgaatgctgaaccagggcaaagcagaaagtggtgttctaagaattgcacgagtactagatgaagttacgccagtaggggatgacaattgcaaaggttggcttgccagcacagatacatcaacccctgtaggatggactattctggcagtggcttcttgtttagctgcctctcttctatctgcctccaaaaaaggatcgctacaatcacccatgagccgccaagcattccgatagtgagttctcattacctcagcatattgatgaagattttccacctggacaaacaaaaacatcagagaagctcagtattctctgaacaccaaacaatatagttccatacaacaagaatttaatatattttagcgacacataaaaacaaagtgaacctatcacttggggtatgtttctgttgtgttacaaaacgaaatagatatattagcttaaatatgctcaaaactgtaaataaccaaccaccttgacaactttaattacgaatttaaattgaacaacttcagagtggatctgagcaatatataaagaaaaatccatgcagtattcagaatatgtaatgccagtgatcaatacatgtattcatcataaattacctgggtagcaacatggatgagatagtcgtacacattaggcactactgttgacagggattcgaacgcatttgaatagttcttatcattctttatttgaataagctgctctagctctccgaccattctgctgcattcctcaagacggttctcaaacttggaaacagtgtgttgcataaaaggagaaggccgcattgcaacaccactgtaaaaatcaaatgttggcacaattgctgaggggtgattgaaataagttggagccccagatggtccagcatgatgagcaaaaccagtatttgcagtgtccagaatatctacggatgaaatttggtctcagcttttgatatgagcggaaagccgaatctgtgttccgcatcatttcttcgaccacagccattaagctccgaatggaaaccatctccctgtccatgatggtggaggttgatcctatctcctgtttcagaaaggaaaatcctcctgttacaaacaaagaataaagttgaacgccctatttcaactagtggattcatgaactattccttcctcttttagttttgaacatattttcaatataaagtagtttcagaaagtagcctaatcaataaggaggctgaagtcaaggccagtaaaatccttttttgtactgtacaagtgtacattcaacaaaatacatcatatcgccccccaactatttgagactgataattttcgtgctgcagaatattgatatcttgcacatttgtgaagtaacattaagtcattactcaaccaaagatatgcgcattacacttaagaacattgaatatcagctggtactcaactgatctgtgaagactgaaaatatagttgatgagtggtgactagcgcaaaagctatatacctaataaaaagcatacaagcaagtaaagcaatgatttcatggtattacactaatatgtggggaccaaaacatttccaaagtaactagtagtaccaaataacagcccaagaagtaaacaaaacctgagaaatctgcgtagcatacagctcaaaactcctgctagagactgatgggtcgtagaggcggctgcactggtccaacagatcgctctcatgcttgtactccctcatcttgttcctgaaaatcacaggttaaccaggtgacgatcgtagagcaatggaagtttagacaaagcaattaacacaaagcacagagatctttatcaagggagacatcaagaacacacggaaacccccattgatctgcccttgccttctttcagaaaagggggaaaatgaaaagaaaagaaacccatagtgatccctaaattctgtaaaaatcgccacagatatctcataaaaacccagaaaataaacttcgacgacaatggggcaaaaagaagccaaaagattcagaccgtctcccaagaatatcgagaacgcgatgcgacgaacaatttccacgattcacatcttaataatggaatgcgttctcctgttcaccttaccgaaaaaaagggaaaatgcaaggcaatctcgataaagagccccaactcggattcccccaaaaatgaagaacgcgatgaacatcgccccaatcccccaatagaagatcaagaatgcggagcaagccatactcgatgtgcagcagaagctcctgcgattgcggatgcgctccacccacttcgtcccgtaccccgcagcccttccctccaccgtgtacagcctcagctgctgcgactgctgccgcgctgcctcccacacctgaagctgcagctgccgcaatgccgcctccgccgccgccggcgcgcgacgccgctcgaactccctcaacgccgccgacacgggcacggccacctgctgctgctgaggcggggacacggacgcaacgggagactcttggaacatcgtccgcgcagccggcggcgggtgcctagtcacctgcctctgacccgtcggcggcgtgtgcagtgcacgaaacggctgagggctatccacctccatctggccgcgcccgcgcggcgggcgagacgaccgagagccaccaccgcgtctgacccgtcatcggagcgtgcctcgcgtgaggcggcggcggcggggcgcacgtagaggttggtgtccgcgtgcgcttcggcgtcgccgtcgccgtcgccatccccgccggtgggccattctccgggattgtggggagccccggccgcttctggggcgaccggcgagggggaaggggcggcttccgcgacgacgaaggcggcgagggcgagggcgagggggaggaggatgacgagaagctgaagcgcctcgccaaggcctgcaggtccgcctcagcttcatcctccacgaccctgaagcgcgacatggcgggaggttgtctcgaggaagacgaagagttcccggcgcgtggcggggcaaatggatggacggatttgcccctagcggttgcgccgaattgcgggcggtcttggcggtgggcgctacggggtttcgcgcataacgcgggggtatttatgggtcaagagtttctcgctgctgacgtcatcgcccgtcggtgaaaaatgacgcaaacgagaatcgcctgcaaaagagagaacgggattgctctctgaattctcttcttccgtggccaagatgaaacaagtgaaatcgcctgcaatttaggcatggcctgcgctgtatttttctctgaactcaaaactgtgctgcaagcatactctgttcaactgggatacaaccatcgaaatcctcatcatccatccaacaggtgattgatcattaactccaggaaacagattcagaaactctattccagaacatatatatacagaaagacaaatttgtgcaagctatctcatgggacattgcttgagtttacagggaaggagctatctgaatcctgaggggaagacctgaacagcataaaacacacgccattatacattcagtaaagcaagcaacagcaatctaacctggatagctaccacgctgctgaaccttagtgcattacccaaaccacagaacttcaggcatcataattatccggcaaccaatacaaaattttcacaaggagcggtatatggatgcttggtgacttgattcagtcggtttcatgatctgggcgaggcgtataccaatcaggaaatctccccattcttctcagtagcctcgtataggaggactccggcattagggcctcctgttcttcagcaagctcttcctgtgttttcggcaatccgtcaggcacagggaaaggccttggcttcgcagcttgccccagggagtttgatgatagtgaattatgagatttctcagccatcttctttcttagatctgaacggtgatggatgctattgatcaggtacctcggatctccctcggagtccttcaccatccttgcaatttcctctttgggtagctcttgctgtcacaaatggagaaaccctgttaattcgttgagtccaagtagactgcaagcttaataatcttgatatgattgtacaacaatcaatacgaatggcacaaacctcaagtttattgagttcaaagtaagcatcccaacagctgcagcactcatcaccttctagggttgtgcaataatctgtatccagatcagaggaacaattgttaggaaatgattagacaacttcttatgcagttgatgttgcagagacaaacctacttaaatcaggttctaactgaatcacattcacacaagctgaatcatttttttccacaaatatgcaagaggattgtgtatccttgtattaaggagggtatcagggtaagcacacagaatgttggacaggctcaaagagccaacccagctgacgttttacataggtttacatctcacaaaagattgatgaaacgaccaacagcagagaagaacctgaaaaggggacaagcctacagatcacgacaaattgaattttctttgtgcatttccattctcatttcatctagttgaaattttattcagatcactgtattagctctgtacatttggcctcgaaagccaataattgcatataatgattaaatgatttatatataatacaaaacaacccttcctctgtttgactacagcacaaccttacagacatcagcaacaataatttcatcttacattgaaattaaagcatctatttaagaccctcaatctccaattgaagaaactgttttacgcctctacatcttgcattacacgctaattgtaggcttatagcactacttaattcttatgcttgttcacacaacatttagtagggatatattttagtttgatctggcagcatcactggtcctaagaagttatcacgaatcctactaagaaattaccacgaatcctcataaattacccctaattaactaaagcaacttagatctcagaactggagcatgcactgctactaaaactaaacagcaagtggcctaaacctcggcaggaagccgcatcccacgcagtaaaataatcccaaaatattgctagaaaacaggcagtgaggtgataactcgggctctcggctaaagcagcaacacaacccagcagctttacctgtgatctggtctttggtgcgctggacgagaggcttctcctgcctgaggaactcgtcgaggacgctgcggctcgagctgaagggctcccgcttcgggatcgagtcgtagttccgcaccgcgcgaaccactacccccgccgccgacccgcgccgcccagccgcggcggccgtgcgggaggccgagaaggcggtggccgtggccgtggccgtggcgggctgcgccagcggccggagagcggtggaggacagcatttttttttctccggcgtggtccccggctaatcgtcttcttctccggtggattttgggaaggatggaactaggcgagtggattagctcgcggcctatatatatagcagcaatagcggaaagcgcacgaaacggataaggattggccgcgagatagtttattttgtttgttttggatttttgttttgcaattctaaccttcaagttgtcctattatcgaaaataaagacgggagggattaaaatatcttgggatacttcggctttcggagacttttccatcgtctgcgcacccgggatccaaaacggtgggatctgagccgtcggtttcgaacttggttacagctacccgcgtataagagcaggtacaatagcagatataaaccagcttcaaacatattttaagaagataaatgagaatagagaacagcagtgggctataaatttatagtcagctgtagcacgaactccaagacacggggtgtgtattataggtgggaccagatattaatagtgtagtatgtaactattgtataaataggctattagattagttacagaaaaattggagctactagtttgctactagttggctgtactattaaaattgctctaataaaccacggcaagaagtgtcgacgtgtacagattttgactagggagtcgtcgtatttgttattgatatatacgtgtagttgatacatttgatttagtctagcttaagtctagcttatttggccaaatgatggctgggacccaggtggtgcgtgcagctcgtagaaactagtagaaagatatggtcatatggagcaacattttcagacagaatcagaatgctcatttgaaagctatacatgtatattagcatatctatgattagcgcaatatctgccaagctggcaagcttgatatacacggaccgtgttatacgtgtcctgtaattacagagtcgcagagtatgacagggctctgcattcaggtaaagcacatcttcacttgatcactttcagtcatgatctgccattcttctgagcagcctggtatgcgtggactccggcatggcagcttccgtttctccctcgagctcttctgccgtcttgggcagctcgtccggcgcagggaagtaaggtttggttttggtggagtgatcatcacccggagacgacgacgactcggcggccgtcttccgcgcctgcgcacggcggtggatggcactgatcaggtggcccatgtcgccgccggcatccttcaccaccgtctccagctccgctcttggcagctccatctgcacatcaaatcatcgaagaactaacagtggttaatgcaaatattattagtggtaatagattgatactactagctcgctagattgcccaaacagcacggttaatttagcacacctcgagtttattgaattcttcgacagcgtcccagcagctgcagcactcttcgcctttgagcgtcgtgcagtaatctgcgaataaggctgtgtttacttcgtgtgatttttttttacacgaacacatattttacatatttgaagtattaaatataaactaataacaaaatgaatttacaaattccacatgtaaactgcgagataatttattaaacctaattaattcgttattagcgaatgtttactgtagcaccacgttgttaaatcatggcgtaattaggatcaaaggattcgtttcacgatttacatgcaaactatgtaagtggtttttttcgtccacatttaatgtttcatacatgtgttaaacatttgatgtgatggaaaagttaaaaattaaaaaaaaattgaatctaaacacggtctaagtacttcaactggttatgaccactggtgtcctgtgcccatgtcagataatcagatggcacgagaaaaagttcaccggacgacgtaccggacatccggtccttggtgtgctcgacgagatgcttctccttattgacggactcgtcggcggcgccgcgccagctgagggcggcctcccgctccggtgccccgtgtctcccgacacggacgacgcgcccgcgcgcgcgcgacgaaacggccgggaagaagagccgggccggcgccgctcgcgccagcggcagcggcaacagcgtggcggtgggcggcaacatcgcggcgcgtgcgtgctgggtgagtgagtgtgctgtgtatgttggcgcgtggctgcctatcgtgcggaggacgagcaggtgtgcatggtggcctttatacgtgtacgtcgcgcatcgtcgtcgcggccgcggggcaaaaccggcagggaagccgtaacaccgccgctgttcggggatcccatcggcgcggcgcacagccacttggcaacgaccgcgcgacggcgcgacgggacgggagccgttggtttggcggattcccgtgggcttcccgtgtagaacgattcggtcgtgaaacgggtcgcgggaaagcgctccgcgatcgcgatcgagcccgcccacggcccatgggcaactctggagatgggctaacgacggttgtggctgaaactgcagcctgttccgggacgtcacacaaggaattttttttaatttttaattttttaataaaagttgtggcaaaaataatttttcattttgaaaattgacagaagtggtcgcctaccgccctctgggagggcgatttttaaaaatcgccatcccagagggcggcaaaagtgacttggcaaacggccgttcgctctcggacaacggccgtcaacaaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaatagtcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcagtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatagattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccgggccatctctccctctccccccgagcgctctcccgctcgctctctctctctctctctcttccccgcccgcacgctgctcgcgcgtgcgagagcctccccgagcgcctctctccccgctcccccctccgccccgcccgcgcgccgcgcgcgcgtgcgcgggagtcgcccgcgccgagcgcccctcccctcgcgcgagctccccgctcgcaaagacgcttcccgcgcgccgtgttcgcgtgcgcgcgcccgcgcggacgccacccgttgtttcccgcgcgcgcgccgagtggccgaccgcccggtcgccgccgtcgtcagcgtctgccgcgcctgtcgccagtgtcgccgctccgctccaaaccgcccgccgtcatcgccgtcgtcaccgcccggcccccgccactccgcgcgcaagccgccaagggaaggaggccgcgcccctcctctctctgccgcgtcgcccccgctcccctccccctttttcccgaatcggcaaaggggcaagccccctttctccccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctgaccgttgccgccgccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcagtagtagcttgagtagcctccccgtagttagccggcgccgccccgaccgttgccgtcgctcgccgtgtgtttgccgccgtcgccgctcgagctccgtagcacccgctcgtcgccggcctcgctcggcgtagttccgcccaatccgacgctagcgtcgagctcccgaagccgcatagatgctctcaccgccgggaatcgatctctcgtgacctcgtcgccgtttccctcttctcccgccgccggttgccgccgccgcaatccgccgtcgtcgagcaacctccgacgaatccgagccgttggctcgtctccccttgtcacgtgcaaccgcccggtgtgcacgcttttgcccgtatcgccgtggttcgctccgccgctcgccgccgccgcccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcacgtgggcccgccgcacctgcgtccaccacggaccgcgcgcgtgcaccgcgtcctttccctgcccgcgcgcatgagccacgtactccctccgcacggtgagccgagccgctgacaagcgggtcccacccgggaccgcgcgtggtgagcccggtccaccggactctctctcctccctcccgcgcgcgcgcgcttgggccgtcttgggccggccggcccgttaagctcggccgagccgctccatttaccttggaccgcgccctagccgcccgaggaaaagtctaatttccatccctctgttctttcttttcttttctttttcaaaaaggatttaattaaatccttttcctttagaccaaaaatccaataatcttataaattcaatatcttcccaaccgtaattccatttgactccattcaacttctaaaatttcccaaatctcgagatctatctagtggcacgcttagaggtctttaatagggctttattttcgccgtttgttgagttgtcccgtttcgcgtgtagtttcggagcccgaagacccgcagtgcaaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccccccagttgcacct

SEQ ID NO: 8128 - DNA, 2026 bp, Oryza sativa
aattggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcctatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgttggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataacccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcgggaatagttcggggcgtgacaacaacggtcaccacaacgacactccggacgctcacgccacgtggggagtcctaggggatttacgtaccattctaaagcctcagcagcaattcgacgttcatgctcatccttccgccttaggtagtccgatcttgtttcactacgtgggtaagcacgggttccgtcgttttgtgggttctccatgtctacccactcaatgaagttgcacattggacgatatgtctgtgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtacccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacagcacagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccat

SEQ ID NO: 8129 - DNA, 768 bp, Oryza sativa
ctatcaacacacattatttcataccgatgcgcttgtgtgccttgagcaacaactctatgtctccgtgcctttttgattttatcttccatgtactttgtcactacgttgccaaacactatgttgttatcggccatggacagagtgaaatttctccttacgctcattctcaatccactgagtgaaatttctgatggacgaccctgacctccttctcattgttggtgggtcatcatgtaatgcaccaagaagtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccatcgactccgaacatcaggccacttagctggaagtcccttctcatcccaaccgttctgcaagtagtcaatagcccgcaacatacccgcatgacgatcatgtataaggcaaacgttgggcctcatacgcaccactacaatgtgcactctctctaggaaccagtaccagctttcagtgttctcactctctacaaatgcaaaagccataggtagaacctggttgttcccatcacacccaattgctgtcaatatctgacctcgatatttacctgtcataaaagttccatctatgcatagaacaggtcgacaatgcacaaaagcatt

SEQ ID NO: 8130 - DNA, 8943 bp, Oryza sativa
  unsure (1)..(8943): unsure at all n locations
cccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacatgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtctgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatacttacattgtgtagacttcttggtctattctaaatcctctcaacaaccaactataaattgactgaaatattctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctatacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgtttttttttggatttttagtgaatataatgaaatttcagagaggggggactgggctttatagggggaggcaaaaatcgccctcccccagggcggcaagggggccgcctgcaaaattctatgccccctcgccgcccatttgcaggcggcccccctgccgccccgggggcgggctattggagcccccccctgtggcgccctgcccctcctcttggcagtctcattcctatcactaacggtccaataacacacgattgagagcgaggggtgggctgccgatggggagcggcgacgccctgctggttcgctcacttaatccttggttngctcccttannnnnnnnnnnnnnnnnnnnnnnnnnnnnnnnnnnnnnnnnnnactgaaaacaattctcacacatgtgattaagcccaatcgctctcctccagtcgcaactcaactggcaacagcccaaggttctttaccgttttgggggacggctaccatagcaaatagtgaaaaccaaataaaaatttatcagaaagttcttttttaacttggtagggttactggattcttactatttccgcatcgacactgcaacgtcgttaaagtgataagcgtgaaatcatttatagtgtacatctctcattatctgctcattagtttataagccacaatcaggatttaaatttagggcttattcaactgtttgatgccataaccaaccggaatagtgctacaagtagtaggcaacaacagtgtaaaaacgtgcaattacatccacaacctcgcctattgaacatgtaattagtaatgaagagtttattctagatacttttcagacttcagtcctagcttaggcagttaagaataaacatataattactttttattgtttaatttattttttaatgtttatctacaccttctataaagttacaatccactaactctaaaattcaacataggctaacatgtcatctcatcatccacgcactagcaataactgcttattaaaaagttcatacaagcatgcaatatcatatataatttatttaattatacaaatcaatatgtaaatatgttgaatcatcacctctcacatcatatccacaatatttcaacatatctatccattatttttataatacttagatatatttatccatatattccgtattaaagtgtggagtattatttagtttattatgtttagtaccaataaatcctagccttttttatcttccgcttcttgcgataaaaatcttggccaataaccaaaatttcatctacaatcttccacggagtctattaaaattatttctttccaaatatggcttggcaaaccagttatatttgttgttaataattaatatcatgtatactccttactctattgttgaaaaaaatagagaactactccctccatttctgattgtaagtcattttgactttgaacataatcaaattactccaaatttaatcaagtttgtcgataaatatagtaatatttacaacaccaaattagtttcattaaatctataattaaatatattttcataatatatttgtattgggttgaaatgttattacttttctatagacttagttacacttagagcaatttaattttgattaaagttaaaatgacttataatatgaaagggagggagtacttagtaattcccacggcacggcaaaacgttggaatcatacaatgttgataacttgtacaaccggagtatcgtgtgcctgggattgaggccgagataactaacgtggttagttgacggcttctagtatgggctccatatgtccagtctggaacagaggtacagtttcaagaacaagtgcttacagcaaagttgcaggctttaatcgattatcctagatcaaaggagaaagtaggcaagcagatagagctacttttccgaaaggcaaaatagcctcacatattaatccatctggaacttggacccctttttttcttttttctaaaccatctgaaacttggaaattggaagtaaaaacacaagctcaagctactagtctacaagtctacaggggagattatgtaagacgatgtttttctaactgtctttggaccatcagttgatttatatcagatagttagacgaaattaatcagacagctgcaactgcacaaacgaaatctttcctcaattgcagctggccagccactcatgggccatggctgtaaagaagccatggaaagcagttgttaggtacccccaatacatgctttggccatgagctttttttgtgagttgtgacaagaaacctttattaaccttttgatggtgaggagaaaaaacacatggaccctgagaaacaacataatgacaattagcagcagtgatatcatggtaggtacttcctcagttgactgctccagagaaatattttggcttttgactcttacttatatttatcgaattactatatgcaataccacgcaggcagaaccaaccaagagccatgacccaaagcccaaaggttacatctttttgtacaacatctggttgaattaaatggattgttcttaagtcttaaccagcaaagcttaattccttgcaactaacttctgaatagactgaaactatacataattggtagggttgagatcgttccatcagaaagaaagctatgccgccatgttgttttataattaaatagctgagtaccagggatgctccacatgggaagaaaaagaatatgagaatgatcgtcatccatggtcattgacctaacttagtttaatttgtctccagccttttttttttatcttaatcaataagtaatctaattgctgtttttttaaggctgtggtcatgcatctattccctttcccatccagtagcattgcaaccttagtgcatcatcagagtcatcacaccatgattggctataattaagtctatccatgcatgtatattgccactgttacagagtttgacaccctttatgtcttattacaggacacattaggtgttcatgcacagtggaccaatagaatcacaaaaactaatccaacatagtacttatcttgatcagctcataaccaattattggaggctcaaattagactttgccggaacagcagtggaacctacatgtctgcctcatctggttgacgaaatggcagttgatgtgggcctgaaaagattgaagaaatcagaagatgaccttctgatgcttctaatggagctactagagcctagagcagccatggtgatcgccaacgttgacgtagtgcataattaaatgttaccccgatctcgaagagattctcttcgcataggacatagctgatgactacatcaaagtagtttggtctgaatttaactgtttctactccttccatatcatattataactttctctagcatttaaaattgaatgatagaaacagtactttaaatggaaaaggtagttgtgatataggatgaaggtggtacagtaatagatatggctccaactaaaggcgacactgtgtttgacaagtttaaactgtaaacattattttggagaggtttaatatgggatggaggtagtaacagatatacaactccaacgaagtatcacatgtttaaactgtaaacactatttggagaggcttaggattacaaattattcatctttctaaaattgctttggccaggtctctcaacttgagctgatgtactttgaacattctgtacatgaccataaacaaaactaagagccaaactgtatgtgcattatgaaattgagctcatgtctattctttaaaagacggtgtcagaattacgttataccgataagaaactcaaccgggttttcagattgaccctagaccggttgacaattatatactaccaaaccttgacataagttaatcgtgcttggacaaatgcagcctgaattttcaatagtcgatggcagttcatccacgtcagagatgtgcactcgccgctcgcacgcaggccgatctgtcaatagtccttgagtcaatgatcggagctgttgggctgcgtcgcttttgcaggggagcgacaaaatcgatcggtgacaattctttcagctgaaaccaactactagaagtttctgaaggagtgttggcaggctacaaattgttgtgttttatggttttgcaagtttttatttaccttttttaatcgcccaaatttacattgtaatagtattttgcgagactggttaaccactgaggtgtcacttaaaacacgtgaattttacattgatttttattgacttatcagccgcaaccaaaataaaaaatttgaaagttaatttaaggtttttcgttataatttattttttcagtattgcatttaaatcttaaagaacacatatataaatgttttatgataaagttatttttggtttcttcatattttaaatgttatttataaattgtatagaaaacgatgagaggcttaattcttacaggagtctgaacattttccccgtattccaagtttggacctcatggtggctctgcattccatcagaccttcacaccctccttcgtcacaaaaatttataaaaccaacacatgtgggacattcatcgcttcacatggtttcaattctgaacccattcaaacaaattttttcatatggaaaaggatagtctagtgagaagcaccgaaatggtgtatagtcaaaagcacttatccaatatgcttccatttagaaggtacaattccattgcgacacattgacaaatttgccactcgaggcatacacaaaaaagcaaaagaatccacctgccacaactctccaagggcaccaagcttcaacaatttgacaaggcgaggcaacaactactacttcggattcatatataagacgctttcaccttttctagctaaaacttcttatatttgatcaagtttattagaaaaatataacaaattttacgatactaacccagtttaatcaaatctgtattaaatatattttgatagaatgtttattttatgttaaaaatattgctatgttttactataaactagattaaacttacataagtaaggagaacaagtaatgctttagaatatgagacggatgaagtagtagagatttggtacggtattttgcttgcatggcactggccccgtcctgttgacaatcctgctccttgtaatcgaagctcagggcatgcatgcctgcatgctcaggatggagctgcatactatcgctgtcactcctggtcatcgagagcgcatttctccggcgtttacttggcagaaaactaaaaagccggtttcccagttgatcgacgaccaattcgccgttccacgcgcatggcaggatcgttttcactgcgaaaatgatgtgttttctctgaattttcgagttcagatacttcaggtagatagagaagcgttcaatttaatccgtcatctccccgattgttaacaattgctcatgtgaagttctgataaaaaaaaataaagtacttggatcttctactgtattctttctctcttcacgttcagaggcgctaagatccaaagagacgataaacctgttactcttttatctgtaacttttcgtcaggaacacggacaaaatggagatcctgataacactttcacactccgttcttttaattttcttgacccgattattcagaaacggagttcatccacattcagaccagagcagcacacaagtcttcagaggagacgcaaacatgacacggacgcagcaaggacatttttggccgatcgtttttgagcattttgacttcctgggagcagtgcaaaaatgctgtgtgatcgagcggttccacgtgtgagaagctgtgtgtacgaagacagtgacatggacgcttcaggggagcaggggacttgttcgtatttttttgcttctgtgtttatttctgatggagaaatttggcccgtttggagtccgaaactgtgtacggatcgtttaaacgaagcttctatctatatggaggttgtctagaatttgtgtgtacttgattatggctaatcattacttatcatgcacttgactctatttgctttttggaacttattattgtttgtagtttagattatacttcatccgtcctaaaatataagggattttgggtggatgtgatatatcctaatagatttctagtattatgatatgtcacatctatctcaaatcctttatattttttttgacggaggattagttttatattacctatttttttagaaacatattctagcggccagagccttgttatcttaaaaacacgtcaacaatcagatatcataaatcctgataacgaattttactgcttctgcactttcaatgtacatgttttatcaattttcctaactatatatttataaaatctattaataatataacagtatggaaatacctttcatggcaaatctacccacgtcgtgttataatttcaaatcctaatatttatatattaattaatcatttaaagttttaaggtttaatcacacgcattctagcacgaacgtctatttgagaattgggtagtacccaacatcacctcacccccactcttattaactaaactatgacttatgagaaaatataccagcccccatatcattttcacatgtaaaagaactatatttatacatattaatgagttaaaatgttatattgtgcctatcttaaaacatcatcttgtagtactcgataacggaggaagccaacagataacggccctgtgttcgctgagctagttcccatccggaatagtgcgcatggaaaacgaaacgattcattagcgcgtgattaattaatattagctattttttaaaaaaaaatggaacaatatgtttttttaaacaactttcgtatagaaactttttataaaaaacacaccgtttagcagtttgaaaagcgtgcacgtggaaaacgagggagatgagttggaaacgtgggataagaacacaactaggctgtgtttagttccacgccaaaattgaaagtttgactataattgaaagtttaaagaaaaaagttagaagtttatgtgtgtaaaaaaggatgcgatggaaaagttggaagtttgtaaaaaaaggaaaaagtacgaattaccccccccccccccgaactatcgcggtcgtctgaattacccccctgaaccacaaaaccggacattcttcaccccgaactatacaaaccggacaaattacccccctcgactcaatccgcggggttttggtttacgtggcgtacgcgtggcagtccagtcagcgttctatataaaaaaaatgtggggcctacatgtcatacactcttttttcttactctcctcactcctctcgcggttgagggctgcaggctcagcgcgtaggcgg

SEQ ID NO: 8131 - DNA, 2339 bp, Oryza sativa
gaggcgccgtccgcccgcccccacgcgccgtccggccgtccgctgtcgccctccaccagccatgcctgccgatgcctctcgtgccaccgcctgtgagagagagagaggggaagagagaggcaggggtgccgccgtctccatcatccccacctctgccactgccgcccatcgaccatccgcccccgcgcacccgcgcgcccgtcctccctcgcttgccgccagccgcgcgggccgccgctcgccgctggccgcaccaaccgctgctcgccgccgccgcctccgcgccgaggccgccgccctcaaccgcgagaggagtgaggagagtgagagaaaatagagagaagagtgtatgacatgtaggcctcacattttttttaataaaacgctgactggactgccacccttaccccacgtagaccaaaaccaccgcggattgggttgaggggggtaattcgcccggtttatatagttcggggtgaaaaatgtccggttttgtggttcggggggtaattcgtactttttccttaaaaaaaagaaactaaactcgtcctagctcggattccgaaaatactcccttattccttaagctatcctgacattctgctactagcataatctggaccaaaataggagcagtacagcatagctgacatagtaaaaaagacgttacctgtgcatcagaaaaaaagtgtcatttggatgcttgtgcatataaagctgattgcaatgtctctcaagggcatatataaagaactagagtggtctttgcttctccttcttttcccccacacccactaattaccctaaaacggtctgaacatgtataaggttaccggccaattgtctcaagtttacactagatatgcaatctaaatattttttactgtttgatcatattcctccactaagcaaaccctgccacaattcataacaaatgttatagcagatgatgttgggaaaaaaaaaggaaagatgatatatacaaaaatgttcatccaatgtatagccttgataatatcgtaaggagttggaaccaaggggaagatctgggtcttagaagagccgagttatgttccatttttttttgttctagtatgcccaacactatgttttactgcatatagaaaaactggaaatcattttctctgccgcaatctcttttcttcatatatttggttgaatcatatgtggcttttgtgaaaatatacttgcatgatgatctgtttaaatattttgttcgatcgatgttctagaagaaaagatatttgtgcataaatttttcaaaataaacatgtgggattagatataggagcccactagcatgataattaggccgggccccaattcttgagctttttttgaacctgaaccaggactctaggatgcaaaaacagtaagcctagaggactgccatgaaagatctcccatgaaaaaggaatatctctgggaagaagtcaatgatcatgaccatcaaaattgcatcccattctttttccaccaaaccaagcctccaattattcaaaccatcacagattattcaacagcctcccagatcatacaccaaatccgaagtgaaaaatcaaatgcagtggactcctttttgaaaagtaaaaaatcacatcatgtaaaatcattagtggacttaattaaatttgtctgtgtgagctgggataggatgctgcagtgctgtacccagtcagtaaagatccgccaatataagatgggaattaaatggatccagtacaaagttcatttaaacgagaggcaaatcaggagatgaactttaataaatgaaccaagtaaaaaaattgaaatagagatatgaaagaaaaagaaaagaaaatttcaacaaaatttattggaatcgacattaaatgcccaaatggaccccttgcttttaattccgtgcaggcgagttggtgtgttccaattaactcctctcctctcctcttcttctcttcctctcactcctctcctctcctctccccttctctgctccgttcttgatccagaattccagattccgtacgagggagcgcgcatcccgaacccgatcgttcgcgttcgccgatcccctgagtcgcgggggggattcttgctttgcggcggaattcgatcgcggtttggtttggtttggtttgatcccgaggaggaggaggaggagggggaatcggatggtttacgaggggaggggaggtgatgcatctgtcgctatggaagccgctggcgaactgcgccacgctgctcaagaaccggccgccgcggccgccggcggcgggaggggcggcggggggaagcgggcggcggctgcaggagagcaagctgcgggaggcgctgga

SEQ ID NO: 8132 - DNA, 3158 bp, Oryza sativa
tgcgggcgacggcggtggcggcggagcgcgcgttcctgtcgcccgacgcgctcccggcgctggaggaggcgctcgcgacgttcctgtccatgtaccccaagtactcgtcggcggcggacgtggaccgcctccgcgccgacgagtacccgcacctggacaaggtatgcctcgactactgggcttcggcctcttctcctacctccagagctgcaacccttccgactccaccgcgtccttcacgctgtctgagatcaccgccaacctcagcaaccatgcgctctacggcgccgccgagaagggcacctgcgagcacgacgtcaaggcccgcatcatggagtacctcaacatcccggagtcggagtactgcctcgtcttcacggtcagccgcggctccgcgttccggctgctcgccgagtgctaccccttcggcaccaacaaacggctgctcaccatgttcgaccatgagtcccagtccgtgaattggatggcgcagtccgcgcgcgacaagggggccaaggcctacaccgcctggttcaagtggcctaccctcaagatctgctccaccgagctccggaagctgatctcaaccaagaagcggcggcgcaagaaggactccgctacggggctattcgtgttcccggtgcagtcgagggtgaccggagcgaagtactcgtatcaatggatggcattggcgcagcagaatcactggcatgtcctgctggacgccggggcattggggcctaaggacatggactcattggggttgtctttgttccggccagacttcatcatcacatcattttacagggtgtttggggctgacccgacgggctttggctgcttgctgatcaagaagtcggtcatgtcgtgcttgcagagcccaaatggcgggacgggtacagggatggtgcggatcatgccagtcttccctcaatatttgagtgattcggtcgatgggtttgatggtgtcctggatggccttgaggatgatacaatcatcccaatcgaggagggttcagcgtcgaacagtctccatgctacgcacttgcctgcattctcaggcgcttattcatcagctcaggtgagggaggtcatcgaggatgaaatggaccaggacagctctgatagggatggtgccagcacgatatatgaggagaatgagagtgtatctgtaggggaggtgatgaagagcccagtgttcagtgaggatgagtcatcggagaactctttctgggttgatttgggccagagtccacttggttcagaccattcagaacagtcaagcaaggggaaattaggatctcctctgccagcgtcttggttttctggtaggaagaatgtgaagaagacatcgccaaaggttctgtccaaactgagaaggagccctattcctgacaaccatgttgtgtcctttgatgctgctgtgagatcagtatcacaagagctagaacatgggaaggattttactgaggaagattgttcacaaaatggtatcaagaatgttgttcctatcaaggtcagtgagattgaagaagatcaagatggtaaacaaaacaaaaggtttgtaaagttctcttgtgctaatggccctgcagaaggtagctcaacctctgtttttgggggttgcacagcccgtgggaatggctccacttcggagatttgttcagaagccaaagatagtgccatcagaagggaaaatgaaggggacttccgtctactgggaaggagagaagcacataatagcagattcaatggtggtaggtttgttggagtggaagaagcagagcgagtgtcaagtatgggccgcaaggtatcattcagcatggaggatagcaggctgtgtcgcaattcggaaactgcagaaacatctggatatgcaatgggagatgaggatgatgatgaagaatacagtgactatgatgatattcaggatggcaggcgagaacctgaaattatttgcaagcattttgatcatgtgaaccagctaggtctcagtaagactacgttaagactgcggtaccttatcaactggttggtgacctcactactgcaacttcgcttgcctgattccggagatggtgaaggggtgcctcttgtttacatctacggtccaaagatcaaatatgaacggggagcagcggttgcattcaatataaaggactgcagtactggaacttcactgatcaatcctgaaactgtacaaaaattggcagagaaagaaggactctctttgggcattggctttcttagtcatattcgcatcatggacaaccaaaaacaaggggtggttgatgtggggctcagttcttccttgtgtcggcctacgtcaaacggccgacgtgagaagaaaagtagcaagaatgatataattgggattgaagtggttacagcttctcttgggttcctcacaaactttgaggatgtatacaggttgtgggcatttgttgcaaaatttctggattcatcatttcttgagcaacagaggctatcatcaattcccgaggattcagagagatagtatttagagggtttcaattatgcctgttgcaactacatacatacaggaggatggcggcgacggcaatgtaattgtgaggacataagaagagatgtcaaggagcttttgcttggagcttttgtatcccaaaaatgactccacttggcataaaggggcaatcttgtggtgcggctggtatatttcttcgttcttctttttcccttttttctaggatgcagcttttttgcttgtagattttgttcaagatttatatgtgccacctaattattttgagcagcatcttttccatgtactcgtttgtaaagtggctccattggccatgaagttaagcttgcttgtatgattcttgcaacatgaatagcatgatgataggtgatcagcctcttttcagttctcctgtagtcctgttgagctcgacattgttgtcatcagtcccaacttctctgtactttttttttttgctttactgctggcattaagctaccatagtcctgctctgtcatatctgtgtacaataaacttatctgcgggccaacattgctatcttcttaatgtgctgtcattttctggatgctgttttacattggaagctttctgttgttgtgatcacctgtgaaacttatcagaggcttgttactgt

SEQ ID NO: 8133 - DNA, 1052 bp, Oryza sativa
atacaaagcacgttccctagttagatgtaggttaaacttcccgttcaaaaaactttaccttttacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctttggggcaacaaacagcaggc

SEQ ID NO: 8134 - DNA, 11372 bp, Oryza sativa
tttggttcccagccacactttaccattatttgccaacaaaattgccacaccttgtctaaggtgaggtgatcaaattgttacccacaacttactaagcctaagggaatcttgccacacttttttgagccattgacatgtgagacccaatttgttggaggggaatcttgccacaactgtggctacaaccaaatacctgtcaaatttgtctaaccttaggcgtggcaaactgtgacaaactgtggcttgcaaccaaacacacccggagtacgtaacgttgattacgttatgggcgtaatctgtttttctcttctctagctcgtgtcgtccgaggcaggcaccactcttcactggctcactgctactagtactgtactgtgcatggcatgcatatttgcataatcgatttgatctatggagtagtcacaaacacatgcacagaggcacacagtcgtgctatagctgctggtacgtacagggccctagctagcgaggagtacgtagcgatcgattaaacaaaaagattgggcaaagatctgatgcatgggaatgttcttggagggcgatgctgataggcagcaggaggtgtgtcttctccccgcgtgatgatggcgtctcccgatcgaatctttgttgcctctggcagcgcgccccgatcgacggattggaaacaccaagtttgtttttaccaagccggcttctgcccctgcctgcctctctcttccccgcgtggtgaattccgaggagagaacaaaagcgccgcgaggtgatctgataaagctgtgacgtatcccgcgccaatttgttactcctccgaccatcgagatcactagagttagttctaaattcatcgtcacggtttacgtataaataatcacgatcaccgatgttaaatcctaccacactagtactagattgatcagtgcatgtgatttgctcaatcaaaacccatgtgatcggtggcaaggtttgcagagaggaaagaccgaaaattggccacaaagggctcgtttgaagttgagcttttgggtcggcaagcgagcgagcaattctacgagagagagagagaaagccagcgcgtgcctttgcagttggtgcctttttgaacagcccaaagcagatggcacgaatccccagcttgacccatcatgattaggaccgtagcacccagcccggccggccagcatccatctgtaatccgcacccggccccgcccccgtcgtcgtcgtctcctccgtttcgcgcgctccctcgccgacgaaaagacaccgcgcgccccacccccaccaccaccccgatattcttcttgacgcgggcatcgatccccgcgcgcgcgggcgaggaagaatgggatgaataaaaagcaaggcaccggatggtacaagagtttgtttcctcatgtcacgtcgcgtcgttcagctagctcaccgcggttgaatgacaggcacggtggacaagcgagcaggcaatggcgcgtacgaggctcgctccctgctatgcatccatccgtgatccgtccgtccgtgtccatccatcgactcccatgcaccgcgcaagtgcacggcagacacaacgaatgaccggccggccgcgcgacaatccgatgtggtagtcagctagctgcatgcatgcatctatcaggaggtatccatctatcgatcgatcgatcgatcgccacatgccggcgtgagtgacgtgcattcagcggcattccagcgtgccgtgccggcccggactctgattgtaacgtactactacagggagatgcgggtgcatgcatgtcgtatatcagtatatgtgcatgtccttttcatcccatgtgcactttattatcgatgctacgatcttactttgggaaccttttgatgctctgatgatcatcagttcccaatctcgcaatgacaccgtagacagttttatccgattcagctaagtacgtacttgtacttaaaacttgatggcagagtatttttgtggaagagtgtacgcctttataaattactcctgtggcaaagaaaggtactctccatcaagttcacatactcttttgattaaggtatggtctttgcaattatcgactctcagtggatgagagaacacgtacgtcgaatcgaatgacggagcaggggatagctactcctaggtacgtactcctacgatcattacacgccatatactagtactacgagagagagagagaatctcgctatctcgtgcccatgatcggtcgccatgtccgggagaagagaagcagcaaggcaacaaggtaaagcaggcccgagccggagtagtagcagcccgggtttctaggagtcaatcggcacaaacacacagcactgtcctgtactactactggctactactcctaccacctagccggctgtagctcctccttttactggccactagcttaggcctgtgtcactttaccgctttgtttccctgcctgccttgccgttgaacggggtcggcccccgaacaatcgacgtacgtacgcactctacccacacagtctccagcctcggccgcgcgcgcgcgtcaccggcgccgcaccggccgtgtcacctgctcgacgagacgacccactcgcgcgccgcgcgtcttggctcggggatgagctgtggaggatcagaatctggccgcgcgcgcgcgccgttgttttcgccgggtacggccgcgctgtcggggcgcgccgcgctgcgtctgcctgctgccgtgtccccgggcggcacggcacgctgcaagcggacgccgttggcgcagaaacggttttgactgggcatcgtcgcgtgcccgcgcggtgtgtaaacggtcgttttcttgccggccgccgccgtttcccatcatcatccagacatccaaagaaaaaaaatgaaagttccatgttacgacttactctctccattacataatataatattttcaagcattactcacgtttatatatatactaattaatctagacgttttaacatatatataaatataaaaaatacgagaaattcttatattataaaacggagaaagtacgtgcaaatataaactagctagtgccatggcatggtttctctccccaatttgtataagaaccgaggccatgtttggataataggtttgtgatatgatttcccacccctcaaagggtaagttttaatcttagtcatctattctccccactccatttcattctatccctccattcattttcatttcccaattccacatctcctaaccaattatccaaacacaccatcgaaggatatggccctgatcatgataggcgttactactggtactaggagctgtgtacgtacagtactctactatctgcggtggcggtgggcctaggtcatcgggaagtgggccacaccctgaccgaccgagaccgggcgaccggttcggatgatgttttcgctttgtggcagcttggcagtgaggaggacgacgccaacggccaatctctgcgacgttggctgccagaggcagcagcagccagctgcagctcgaacggaagacgaagctagcaaccgaagaagcatcagcaggaagcagcactgcgcgcgtgccagcgtttgtccgaaacatatatgcgtgccaggaagtaggagtatgcggtttgctgttcagagttcagacaaagccaattgtactgtgggcttgtaccagcaacgagtaacacgggaatttgaactggttttctggtaaaaaatcctaaaaagttcctaagaattctcacttctctcacaggagcctaaattatgtaatagtgtaatcaacttcaatctaatactcctatacttcaatagtacaaccaagattaactttagaaaaccgtggtgtactctgaacttctaaaattttagttacaatgcaggctctaaaagcaggtacaataaccagctacaagcctactttatggattttaataatgagatgaaggagagagaaggtaccagcaggcgactgtttaagcgccggctctactcgcgctccaatacatatttgagcaataccagtgattcaatgccatgcactgccacttatgttagaagagagagtgcatggtactagaagaaaaataattgtttaaggaataatacttttattactatagtatgaatgtagattggagtaagcacttggctgtactactagacttgctctaacgccctcggagagcgagaaagtgtagaggtgtgcacccaagaaagagcgggactgcagctgtttagaagaggccctaaattactctctgttcagggcttttggcttgttatcatagtctcgtcctttccccttctttctttctccatcgcatcatgaaggaagaatacactgccgtgatcagccaggctcatatactagcaacaatgttctcttttgtggaactgctactgttcagaatgtgacaagcctggtcatgatgatttcgctaaagggacttgtggtaatcattcagtagtgatcaggggaaactgacgactgaatgtctgaataaatgaaagcgcagaacatcacgccatgcatgtcgccaaaacattggcagatgatcatcaaccaacagtttcatgcacacacacaaacacaaatactacacacaattggcaagcaagcttgttcaaaccagattgcaaaagggggtcaaaaggtgtcacctcatgcatgagtcacagaattctggatgttctcgaggagtcaaggctgcagttcagtccagccgaccatgcgagtgagtgacaaggccattttagtttgtagagctctcacaaggtcacaaattgtcaagtcgagcacccaataaatatgctgttcttgcatataataattaagtttattagtttgttagctcttgagttaagccagctgcttgggcaacgacacatggccttgtactcttgtgcttcctagcgttctctcccattgactgcatgattagatctatcccttgactgaccattattaacctgttgccatcaattaatcagctcgatataagcatgttgctatctttctcatgtactttcggtttagaaaatgtatgtgatgatcgaatcggttttcctggaatgctctgtgtctgatttacggggcgccatatgcatgatagcacacgctgctggctggccctacacggccagatcgaaacatgcaggcatgtacagaatgtgattatgcatatattgcatgggttccacttccttgtacaaattaatatacgcacgtacgagtggaatacaaggacgtttcatgtagagaagtagctgtattgtcttacgtgtgatcacgggcatggacgttaaatttgtagtttttggtacagtatagatataacaccaaattaaaatgtgttatagaacaagctagctagaagcaagagttgtatggtctgaagctagctactagcagtaagagcaattaatatatcaaataattaagttcaattcccagcaaaaaacgccagcatcaacagccgcgcgcatcccgtccttccgaattaacatgcctttaatccagcgctacagcaattgcgcaggaaaaaacaaggttagtttgactaaattcgttataacattgatcaccaattaacggttgtgatatcggcatccatttgactgctcggaaatggcagaaactagaaactgttcaatctggaaaaatatcgtggcaacttacaatgcctattagcagttaccgaaaataggagaatatgtgcaccaattttcgtattgctaaattgataatgctaaagtaaacaccccccaaaaatatatatatatatatacttcctccgtttcacagtataacttattctagcatttctcacattcgtattgatgttaatgaatctagatatatatataacatcaatatgaatgtggaaaatgttagaatgacttacattgtgaaacggatggagtaatagacagtgtcaaagaaaaaaaaaaggcttgacactttcaaaaaacaacttaaccggtgaaggaaaaaccactcccacgacttttcattaagaagaaaaagtcttgactaaacccggccaagagaagccatgaaacctaacgcccacacacgcgggacgggactctcttgctacccctatacgagggcctactagatcgattgtccccctccttcctacaagagaacctaaaatttaactggtactaaaattcgttcccgtggagagtagaaccaaccaaggatctgtaatgctacttgagcactgtaaccgataagctataggttcttttgcttgtcacaccgctaagctataggttcttgtgatgttatcttgtcactgttttaaacattaaatctgttataatattgatacctttcactatgtgtgccttttcaaaataaaaagaaatgatctcttttgattgacatttttcatgaaattttctactttcacctaaaaatgggttttcaaccctaatataccactaactcacgacaatcaaaacttcaaagttttgtttcaaaacccttttacttttccctgaaaatccaacctttagaacttggatttaggaaagtttgtcatgtgaggtaaagttgtcgtggctcttggtactgtacattgctgaacccaaaatgaatcatttgaatattactcctagctaggaatgaaattgtaagaaggtgatatgattcatagtaaaagaaaaaaaagtatgagctaaaaccacttataaaaactcgaccaatgcaccaaccgaagtatttaacctgtaaaaaaggatgattatctagtactccacttaccaacataagtacggagaagataaaaacaaacaaagagacaacccagtcagttagaactagaaacatgacagtgtaaaacagtgcaaaccccaccattcatcattccaaggaaatgcaaagcggcccccatctacaacacatctagaacccctaatccatgctgccatgcaaccagccaataatttacagagcaaagacaagttttatcttctgaacatggacaaataaggcacagaaagaaagcagcttcttctagccctagctaccatccaccatcctctttataaaccctcatcaccccctcaccccaagtactaccataactaccccacccaacaccatcatctgatccatttccacaaagcttctgaaagccaacacatacctcactgcctttgccttcttctcagcttcaagaagccttttgagcttgtgatttctacatcatccatccatttcatcaccatgatccaagaactccttggagggacaaccatggaccagctcaagggcgccagcgctctgaaccacgcctccctgccggtggtgctgcagcctatcgtgtccaacccgtcgcccacgtcgtcgtcgtcgacgtcgtcgcgctcgtcggcgcaggcgacgcagcagaggtcgtcgtcggcgacctcgtcgccgcacgggcaggggcagggtggcggcgcggcggagcaggcgccgctgcggtgcccgcggtgcaactcgtcgaacaccaagttctgctactacaacaactacaacctcacccagccgcgccacttctgcaagacgtgccgccggtactggaccaagggcggcgcgctccgcaacgtccccatcggcggcgggtgccgcaagccgcgccccatgccggcgccggtcgccaagccgcccatgtcttgcaaggccgcgccgccgctcggcctcggcggcgggccagtgtcctgggcctccgggcagcaggccgccaccgcgcacctcatggcgctgctcaacagcgccaggggagtgcagggccacggcggcagcaatgtccaccggcttcttgggctggacaccatgggtcacctccagatcctgccaggcgctcccaatggcgccggcgccggcacggcggcgtcgctctggccacagtccgcgccgcggccggtcactccaccgccgccgcacatggactcccagctcggcatggggacgctgggccaccacgacgtgctgtcgagcctcggcctcaagctgccctcgtcggcgtcgtcctcgccggcggcgagctactacagcgaccagctgcacgcggtggtgagcaacgcggggcgcccccaggcgccgtacgacgtcgccaccgcgtccctcccttgcaccaccgcggtgacctcactcccgtcggcgctgtcgagcgtctccgccgccgcgccgaccagcaacacggtcgggatggacctgccacccgtgtcgctcgccgcgccggagatgcagtactggaatggcccggcggcgatgtcggtgccgtggccggacttgcccactcccaacggcgcgttcccatgagatagacgacggcgacgacgtcgtctcatgcaagcatgacattactagctagtgtagctctcgatcggtttagctttaatcatcatcgatcttgtgtggtttcggttaatcagtgtgaggactctgaggggtttaatcaagggtgttttagttactggtgtttttgttaatcagtggggatcgatcaagtaaccttttttactgtttacttattattaggtttttacctagggtttggtggtaactgggtatagtgtttaagtcgtgatcaatgcatagatggggttgtactatgagatgtgtacgtgtgttgtcggtttcgttcaggttgatccatgtatggatgtaaggtttacattccctgcaagctcgtggacgtacttatctcagctgcaaatttcactttcgacgtactctgaaatgcaaagtacagggcttgattgtagtaatggcaagaacttactgcaaaaggtggaactcttttgtttgctttcaaatttgtcttgattctgatcgttataatgcatgctatgtatgcagtcctggatctgggtttatttggagcactcatgctgtcatgcttccttgtttctttgctcatagaaatgagcgaaatatatattcactgaaattgttgatcttttattttgcatacttcggatcagagacagcatgataaggactacacatatatactttccctactagatattgtactgtagcagacattcccaagcatatactatatatatatatatgacctaaagagatgggccatgaattccagtcctagctatctttatttataggaagggatcggattatttctctacatacagagccggatctttagctaattaaccctgcttactgagtaattttggaacttgaatttacatttatcatgcccggcccattgtactccactatacaactattccatgacccatactagtattcaagatcagatgattcaaatctgcttgataacttctttttaggtctatttgctcaacaagtgttgtttagacttgagtactagggcatgagacctgagccaatctagctattgttggtattctgccttcctactggttggtaataacccacatatatacaattggccttcataacacctatagattcactagtgtgctttcacagcattatcacagctcaaaagtagtttatactacatctagctatagcaaaatgtctaacttagcacttagcagtatagtgtaccccttttgattagttacttctccacatatatatatctagctcacttgtgcctgtctaccaaatgagctagatagtgctgatgcccaacacataacttacggagtaagagtatagcacagcatgcatatataaaaagttccatctaagctagtgcttcataaaatgtgttgcatatatatacctccatctggtgctagcagcgagccctaccgctactactatttcacatgccttcttcccaattcccatcgtatcgatcacgctgatcaaaattagtaggtcatcaatgcctgtctaaaatggctaatccataggagattaattaggagtaatatacagtgtagtactgtattccatagcatgtcagctagtactaataagagtatttatattcaccaacagtaagcacatctcaatcaagatacagtcatagagagtgattggactacccatccatattgctaagctcttgcttgttcaaacttgcttcattctgaaacttgaactgttttcagagaagcagctagccacaggcctcgttcagggttcagacttcagaccacgcatgcagagagagagagagagcagccatatgggaacaagaacaacactagcagccatagctacacactggtgcagtcaagcaagcagagaacgaaaaggagagagagagagagagacgacgaagcgctagctaccgactggccggccggccggtcggggacggcagatacattcgtctcgccaccagatcaatgtgcatgctagtagcatgcatgcagccttaagaaggaaggaaggaaaggcacagtatagctgaaacggcaggtggattcgattctctcatgcacgatgcccaaccaatggctggataacactgactggtagtattggctattactactactccctccatcgggattttgaatttttgtttgtaacgtttgaccacttatcttatttaaattttttttgaaattattatttattttatttgtggcttactttattatctacagtattttaagcacaatttttcgttttttatatttgcaaaaaaaatttgaataagacgagtgatcaaacattgtaaacaaaaattgaaaatctcttatattgtgggactgagggagtagccagtagcttagctagctgcagaatgcagaatacccgaatgggtgcagccttatgggttggtggagtgaaggaagagagagagagagagagaggtgagctctcgttgttttgtccatgcctccgacgaagcacaatgctgcaagcatcgatccgtccatcatccatcgccaacatcgctagcaactctacataccacggagatctagagagagaggtgcatggtggtggtggtggtgtcgtcctcggaacacgcacgtaaatattccgtctccggccgtctcgatcgcccccatcgagaagcacgtatagtacgcatgcatgatgctttcttttatcatctctctcctcttgctcactccctctctggctcgaggaggaagagggagaagggatggatgtctgattttcctatacattctctgtctcgtaaaagaatgatttaagattgaatgtgatcatttaatctaatacaatagatatagatacgagtctattcagactcgttatactaggttatatcaaatctaatcttagcttgattgttttggacggaggaagaatatccgatcctattatgccaggaagtttgctattggtcatgacgcactacgctgtgccggcctgcactggggtcattgttattctcatactccctccgtttcataatgtaagtcattcta

SEQ ID NO: 8135 - DNA, 6784 bp, Oryza sativa
tgctagaatgacttacattatgaagcggatggagtagctaccatgattactcgatctttgagggtagctgagcttgttcattcaaatagaattttaccatcgaatagtgttttctcaatcgctagagtttttttcgagttggacacttagaaatctcaagacctccttttacttagtgttttgatcaaaagaggagggtgttttacccctgctataacactaaccattaaaaaaattgaataaaataatcggtcaaacattgggaagaaaaaccgaaaactgcacttaaaaattaaaatgagactgatggagtatgaaacaatactaggagtaatatggtgttgtatatacggagtaagtacatataaggcactgtttagattctaacttttttcttcaaactttcaacttttccgtatgtcacattgaactttcttacacacataaacttttaactttatatcgttcaaatttctttaaacttccaattttagcgtggaattaaacacagcctaacttgggcgcacacgtacggtaccccgtgcttttctcgtggggccttgccgccttggcgtgctgtaccccagaacttcagttttgtcgctatctgttgcaagttttgcgtgacgtggcgcccaactggcggcagccaaagattcgctatattgagggttgaccgagtcaaacaatcttggattgaaaccgtggaatactaatgattattattagcacattgggcctttggctgacaaaatctggcccaatataaataaggcccatcaccagcaaacagcaactttgaggtggcagaaggcccatcagctgtgcaggggcagcgatgcagcatgccagcatatctacagacaattttcatctaaaaaaacagatacttaggttgatggattttcgacacagcaatttgtctttgaggacttgccatcatataacattgtatacttgatcttttgccatcagtaagttcatgttacaaaggcacttgcggttacagtggtaatattgatggcgactatcaaagcatgagaggttacccaagttcggcaaatcatagatttttcttgcaagttaaactgtcagcgccttgaattatcgaaatgttgctggcagaacatatcgtcaggcaaaaacgaacgtaacatcaccgtgctttgttttctgaccagtacagaactaacaagaattgttctaaaaaaagaaaaaaaaactaacaagaatttgagccggatacttcaggttttttagatgacgtgctataaactagaaacgacgataccaagacagactgaataacatacaacaaaaaaggggaaaagaacttctttgaggttaacttcccctgggaattaccgagaggcattgtgatagcaagagttcacggctactccacctgtacagtaaaactgaaacccaaacctgactctaaatttctgacattaaataacttgcacatttgtaacgcatgtgttgaagcttaaaggtaaccaggcctcagcaatggggggaggaggaaagctgttattccagggaagtaaccccagttcaattacaacagcatcatgagttcatgggaacatcgctggggttccacggcaagaaactaagcaaaatacagaacgattcttttcacaaagggctgctagtactttgacaaggtacacatcagggcaccctgccccttcagttctcttgttggtcgatgacttacatcgcatagacgatctcgccgctgctatcaacatcaatatctgagtcggaatcgaggtcatccatgtcatcgtctaggtcgagtccatcagttaggatgtggtttattcgagagcaagcaggtggtatggtggcctcagttaaaatttgcatgatctgatccatggtttgcattggctgatcaggttcctcatactggctgctcatactatcatcgtccatcaaatctgcaggaaggttcttcaagaaccagccatggctccgtatttctgggattgttatcctctgcatttgccatcatcaaaagtgtcatgaaaataatgtaccaaaattttgaaatgcatttacaacgattaacaattacatcaactataaacacaaataatcttataaaaaactattaacacgaatatggtgaagtagaagaagaattgaaaaaaccattgacagtgtagagctaactataggaatactaggtctacatcaaagccatcctactaacaaccgaacaccttttttctgtcaatacggtgccatgtcgcagacctatattaataagattcatttaagagtagctgtagtatgccaaacaattctggccctagggcatataaatacaaaaggcactgggtagaaccactagtaccacaaatccatttcctaacttatatgatgggaaagaacacatgcataccaacagcacgagcactgaggttttctacgttcgttgggaggtatggtacccttacgtatatgatggaacagaacacatgcacaccaacaacataagcactgaggttttcagtgttaatcacacacacgcgcgcgcacaagagcaggcgcacacacaaacacaacacacacacacacaaacacacacacacacacacatccctctcagtaccctcccaaggatcagataaagattcagcaaaataattaaacacatcacaggatgtgcatctgatgcctaattactacggaggacaacatgcaaggactcaccaaagacggatccccgacaaaaaatcctcgaaattagatgcctacattctggagatatgtccatgttttctggaatcgagtactgaacattcaagatacgctgcacaaaaatgacatgcaaggactcaccaaagacggatccccgacaaaaatcctcgaaattagatgcctacattctggagatatgtccacgttttctggaattgagtactgaacattcaagatacgctgcacaaaaatgacactgacatcagcttttcacagagagccaaggatgaaaaaagtgctccaatgtaaacaaagcaagagaaataagaaaagaaattatataacctgaattgttttacggaagttcttaggctcttctggatcctcgaaaggatatgcaccaactaccataacatatagagtcacaccacaggaccatacatcagcagtctgtttcagtataaataatgtatcagtatgagccaggattcctacactaagcggttatcagtaatggaaatacttctgttttaaagaaaaagaagggacataggtcctacgttaccctgagttctacggaacactcaattcatctcaccagtggcactatattaaaacagaaatcagtcaagacaagatagtttctggatggttcccagccaggttttgtgacgaagggagtagaacggtaaccagtgttttaccaattttagaaacactggtatgcacagcatctccactttcagacgttaaaacagagcataccaacaaacatattcagtggtcatcccaggaaaggaccagtgtatcaaccacaatggaaaaaatcaggtatacttgaatgacaagaaaaaggggaaacccatttcaccactgtagacctcaccacatgataaacttggccaagtgattggcacataatcttgacaaaatggctaattttttctcagcttagtgtgaacttgtagagcattttggtggtacttcactgaaaatacagaatgcaggacaggggaccaaacaactcccaaaatattgattgtttatgtttgtcaaaatacgatgcaagacgaaaagctatagtcctcccaaaggtactgctctcggggattaaatcaacaagcttaataagtcatgtaccttgccatcgtattctttcttcaacagaacttcaggtgcaatataagcaggggttcctacagtggattttggttgtgaatggagaactgaagactgcagaaaaagattgtcttttatcatttgcttattagagtaaaccagataatgtcctaaagtaatgccagtatagtgtattgtaagcaaatgaaatttacacatatcaaaatctggtctgactttgcctatggtgattagtgaattgttctgaaaacagcattatggatttacctatggtgcttagtgaattgttccgaaaacagacttccgtaatgtattatagaaacattagctaagtaccttagaatagccaaagtcacatattttcaagcgtggagcagggcttccatccagcagtgtattctccaacttcaaatcacggtggcatacttgcttgaaaatggagaaagtaggatagttcagcttaccacgatgccttagtacagaataacaatcagatgaaagaaaatcattgtaataagaaataccattgaatggcagtagctgactcccgagataagctgctggaagaagtagcgagcctagaaagtagaatcagaccgatgcaattagtgcgatcaatatgtcactcaagaaagatgcatcaaaaagaggatgcaccagggaaatggtgcgtacctcatcttcactgaaccgtacattcttacaaattctctcgaaaagctcaccaccagaggcatattccatgacaatagcaagatgagttggggttaaaataacctgtagatacatgatagagaacttatttttgctggaaaatattgaatggtgaactagagaatgagcgtcatgaagatcctgacttacctccttaaacctaataatgttaggatgtttcaacgatcggtgatttataatctcacgctggacattatcatctatctgtacaagagaataaacaaaataagtaataaacaaaacaaatgtggaaaaatataatgtagtcacaatacaccaattaaggttgggtcttaataagttgtctagcgattgtttccctaattaaacaaacaatacctcttttgccacgtcatgatcaagaattttgattgagaaccatactcaacattccaatctatgctatgaatatcaaatatgagttaacaagctaacagctaaacaccaaaagacctgacctccttacgggcagaataatttagggagaaattcttggctttatacgggtgttttttttccaggatttctagatgaaatatgcctaatttttatttatctatttagtagggatgggggaagctggattggtttaaagtgataagaacacattatcaatgaattgaagtgacaagagttactataaaggattacaggttcattaattgatcataaacaggcactgtggtttcttttaccatctgcattaatcacactgggatcaaccatatatgtggtacctacaagaacttagaccaacatggatgataaaatattcatggattaagaatggaatggaagaatggattaatgcaacatgcttcccgagctcctaaagggtgcgatttttttgaaaaaaaaactttctatatatgaatttcttaaaatactttttttaaatccatttttcaactttatgatagttaattcatttgtttttacccttgaatagtgatcacaaaatcattcagctattcattcaaaaagaaaacaggcgctgaggtatctcattcgtttagcatcaaaccagtaatcatgaatggcattcataattattataggcagctttgtccggtcaagaggacaattccacaaaagcagtaatgattggtttatttattggttatttactgtgatttaaacacacagaaaatgtcaggtgggcattcaaagaactttttcaggggtatatgctatgaaaagaaacttgttggggatttatcgaagctgcctaactttgcaattttcaacaaccacgccaccatgaacgtcactatatccacacgtttctgctcttaaacaccgtatgtattaaatgcacataaaacaaaagaagtacatatataaaatgtgagttcatgaccaaaccataggtcttcgtttgtgaatttgctttgtttcccatgttggtacaattcaatttgatgttactcaatggtgaattagagcacattgcatttgatttggtgtattgcggtggtggatgactgatgcttggttagccctaaagccctaattacggcatatctaaacaaaatctggagcaatagagctcaagcatactatacatatcaaatgaaaatgatagcaacaactacatgcaataatcacaatggttaaaacactaaaaataagcaattcactcctcgcactggaactactgaagacatgaatccctaatccacggaacaccacatcctacagcgccgcatgactcaccacaaacccagcacggttcggatcgtacagccccccctgggcgcaacgccgatcaaaccaacgaggcccccaaaatcggccacgtttgggcacaccgggtcgaatcgatcactcagccagcgccgaatcgaagctagaaagggaggagaaggcggggagtcagcggccgtaccttctcgccgcgctcgatgtacttgacggcgacgagctccatggtgcggcggtcgcgcatgaggcgggcgacgccgaagttgccggagccgatgtcgcgcacgagctcgtaccggtcgctgtcgtgcatgatcggcatgtccatccccgggcccaccgtcagcgccgcccgatccggcgcccccgccccggcccccgccgctgccatggccggggacggcaagggggttttacctacctgcggcttccaaggcctcggccacccgagggggggggtcccctccggggggcccccccccccccccca

SEQ ID NO: 8136 - DNA, 7237 bp, Oryza sativa
atatatatatatatatatatatatatatatatatatatatatatatatatatatatatatatatatatatatatatatatatatatatatatatatatggtgagtttatttgcaatcacagaggtgccaaattggtctctatcataattgatctattatttactttaaaaaatatctatgatcagttatactatggagtatatttacatcatagtattatagaggtaccaaatttggcacatgaggttttaccaccttcgaaattcggtgaaaatgaaaacccaccaccagatcatatccacggtgtgtcggttatggtaacaaaagccatactttacctaatagataacatatactatttgagctatctatcaatcgttgctactggtgttcggtgcactattcttaggttgtatttaaatcacgttttcttattctcttgtatcttaatattttacgatgtttgagaagattcaagggagggatacattggtttatgtgaaaaacgtattttgcacgatggatggcgcaagctatcctttggcaatttgctcttcataattgttgatgtccgatgcatcatctttagtttgctcgttggttattataccaaagttattttcaatgatacacaagctaccctttggcgctttgtctttccatcactactaatgtgcatctccttttagattgtttttatttatcatgacactctcaatttgagaaagtataatatttggaggtaccaaatttggcacctaaagttttaccacctttgaaatttggtgaaaataaaaacccactgccagattataccctcagtgtgtcgattatggtaccaaaagtcatactttacgtaatagatggcatatgctatttttggctatctgtccttcgttgctactgatgtaggatgcaccattcttgagttgtttttatatcatgttttcttattctctattatcttaatgttttacgactcttgaaaaaagtccagggatacatcggtttttacgtgaaagacatatttttgcacggtggatggcgcaagctatcctttggctatttgctctttgtcactgctgatgttcgatgcaccatctttagtttgtgggttggttctgataccaaagttgtattttcaatgatacacaagctacttatcactttgtccttccatcacaacttttgtgcattatttttatattgttttcatttatcacgatgccctcgatttgagaaaatgtaatctttaaaggtaccaaattttgtacctaaggttttaccaccttcggaatttggttaaaaatgaaaatccaccatcagatcatttcctcggtgtgtcggttaaggtaccaaaagtcatactttacgtaatagatgacacatgttatttgagctatctgtccttcgttgctactgatgtccgatgcaccattcttaggttgtttgtatatcaccttttcttattctattttatcttaatgttttatgactcttaaaaatgctcaatctttttatctgaaagacatattttgcacgatggatggtgcaagctatcctttggctatttgccccgtcattactgaagtccgatgcatcatctttagtttggtgtgttggttcttataccaaagttgtattttcaatgttacacaagctatcctttggcgctttgtccttccattattaccgatgtgcataatttttagattgcttttatttttcacaccaccctcgatttgagacatattttgcatgatatatggaatgagctatcctttgggtaagtgtacttcatcgctattgatgcgtgataagtcatttttagtttgctccgtggttcttatatatatcgaagtctcatcttccatgatatatggtacgagctatgctttggctctttgtacttccgtcactatccagtgcttcatttttagattgtttttatcgccacaccgctctcgtttttttaaaagattataactgaggtacagtcaatgatgaacagagagtgtattccttgtatttgtggcaattccaaaaacaattcatgaaaaaaatatttaatatgtgtaggtttcacacacagagacaaacacacacacatacacacaaagacacagacagacaaacacaaatgcactcacacacacataattatgcttaatactgcactttgggcctttttttccctcgacaaataaactcctcctcatggctcataatatatgtagtccagtagccaactgcctcaaatcctctaaacctaacccaccaaacatcatatctctacaattgtggagtgaatgcacaactaataaatcatgcgtccgttactgggtatattgtttcgtcagtacatatcctctaagttaatctaatgccattatcacagataactatcatcatggacattcttacgtttgcagataagttactggaattctcctactgaaccatgaagaaggaacataatttagctgtccctaagtcacaaaagtttccggatcaaggagctggaacaagaaacatgaaacacgggatgccatcttccaaaaacatggaacgataggggtatacctcttctaaaacaatggaatgatagatgaaacacgtccctagtttgattctatcatgctccttttttttggatacacagctgaaaacgcgatggtagatggctcaatgcaacgatgggaccagcatgacggcttcagcgctacgctgccacacatagtgatggagggagaaaagaagttgcgacacatggtgcccctctatttctccatccttcccatcctggcgatggcgacgatgcggtgcgatctcgtatattcacctcggcgcgcggcgactagcaacgaaggagcggttaatattgtttggaaattttagattgccctttccatcttttgctccatcatagcttgttcctccctctaactatcctgcttgttcctccatcgttccctcatactagaacgacgacccatccttattcaggacaaactttcacatagttcccattcctcgattcggaacgaagttccctattcctgtgacttggaactgcccatgagcttacgcaattggcgaaatgtttaagacactttgttgtttgccaagagaaattcccattttgtgtagatcaaataattgctcaagaatgtactccttattctgagtgataaatataattccctcttcatctaaaaagaattgttggtttatttacagccccatgattcttaaaaatatctacttgtaacaagtacttgtattgattttttttaatgaacaggcacctagagtatgccaatttcattgaatatattaggagtaaaagttgttgtataagtatgaaaagaactgtacaagaaaaaataaagctaaatgatgagctctaagagtcgttttgctcttgctagggctcaagttttggcctcctcgattttcgtcactaggactatcgttgaaagttcctttatgttagaacactccggaaacactagttagcgcgcgcgcctcctgtacgattttattttttgtttttttacattttttcctttttctctctcttttttctgatttttttaatctttagcatgttttgagtttgaaaatttttaaattttgagttgaaaattttcaaatctgaacttgaaagttttcaaatctcgacttgaaagttttcaaatctcgacttaaaatttttcgaatctagatttgaaagttttcgaatctcgagttgaaagttttcaaatctcaaattggaagttttcaaaattttcaaatctgaagtttttaaattttgaaatgaaaattttcaaatctgaacttctttttaaatctcgatttgaaagtttacaaatctagatttgaaagttttcaaatctcgatttgaaagtttacaaatctagatttgaaagttttcaaatctcaaattgaaagttttcaaaattttcaaatctggatttgaaagttttcgaatctcgattctcgagttgaaagttttcgaatctgagttgaaagttttcaaatctcaagttgaaagttttcaaatctgagttgaaagttttaaaaatttgactttaaaatttaaaacttaaatcgaagttttcaaatctaacttaaaaaattttcaatctgttagtaaaaaaaatatcccaaaaaaatctccagaatttttcctaattactatcattagtgctaagtatagtaactaatatagataattaacactaaagagaaggagggagtgctcgccagctactttcctggcacgcgcgccttagcaacccccagaacactccggtttctttccttccaaattttccatgccgttagtaggatgaggatgcgtctaatcgcttgctagtggctaatgccatccatcattcatggaccgtcgtagttgtacactattttatcgatttgatttgctcgagcagataaaggtaagattttgatcttgcttggcatgattgtgggacggagtgtgctgattcattctgatcctctccaatgattctttcaagaaaggagtcaggggggaggcaaagatgtatcccgtggatgtgggctgaatcctctcagcccaattgtacgtccagcccagacatcattatggatcagcccatcctacataattggttttgccaccataatgctacattgctactcaccaacagaccatagaaaaatccaaataggaaactatcactaacttcatttcccaaactcgccaactcatccaatccccaatcaagacctttagaaatgagccatttctccgtctcataaaaacaaaaaaagaagcaaagagaaatttcagtatctcacagaaaaagaaaggattcatttcagtgaaacgtggcaaaatggaacatgttaagcagagacaccaaaccgtagtcggattctttatgcgtttactccgtacatttcagcaacagcttatattgtgcagggagaaaatcacgcagggatgtgagctcaaacacagctacatcctccatgattcttcagagcagaatcagagtcagcgacaccagaacaccaaaaaaacaacgagaaaataagtcattcttgctcccgatcgatcgatcattagctgtctttgcagaacagcaaagaaagaaaaagaacccagaatattcagccatcggttcaccgaacatggaaagggcacacgcgtccatcccaggatcgagaagccgtttaattagggcaaatggcaatcaaaaccggcgtttaaataagcttatcgcgagcctgaaagcagctcaccgcgcactcatcttacagcgaaaaggacgcagaagatgctgcaagcaacagcaagaatattcgcaggctgtgagcacagtgagccaggcaggatcaggaaaaaaaaatcagataaacaggaggaaatttcagtacatgtgccaagttggacggacaaaaataaaagcagcagagaaaaactaattctgctgcatataattacgtggagataatctcacgccaagcagcaggccaactcatatactccacacatgctcaaagccaaaggggggcaacttgccaattagcccttcggattagtattaaactaatcaacggataagcacggatggtcagaggtgtaagagtaattaatagttgttgactcgcaaggatagcaatgctagctagggcatgcatatgagaacgacgtgcaacttatcgtggaatctatgcagggtatccagctcatggatggtctagaatttgcagtgggggttttattttccttgcaggtttgatcaagcttgtcagggtggtgtacgcaattctgcataagattttgtataaaaaaaatattgagattgcaattcaaaggagaaaatggaggtattaaaaacgtagctttctgtcagaaccgctgatcacatagaccagcagtgatgttcttggttcttgattcaccctgttcaaggaactttggattgttcacagttgtatttggtgttactggtgaattttcagcaacagaggactaaacatcagaaagctagcaagttacaacttttcagatagccagattacagtttggcaatccgttgtgaaatatctgcttaatggcaaccacatgcattgcaatgacctaactgcaacagcttgagcttcacctgaacgccgagaggaaaaaagcaacatttttattcacccaagcatagcaagttcatcacactgtgatcactgatcatcagttcatcacaagaaaaaaacgacaatatgcgaatcttgtatatatttatgtataatatgtatgtaaatctcagggcgaaaatttggggtctgcccgacactttgcaagcctcatgggtggtagcagctcttcatctacacatccacaacaacccagctcatgatcagttcatcacttgagctctcaacagctcaatcttccctgtatacatggccaacactaccatcctcctcagagtttctgaatccattattggcaattttgcatcgatgcgcaagccgaaaatccatcaatctacctctctgtctagcaagattccacgagcacgatctttcgatcattttcggacatagccttccgacttgtcatcatcctcgcagcagctgtcgccggcggtggccgccgagacggccacccctgagccggagagctgaaggggaccttgaggtgatccggattgagagcagcttacttcctgagaagcccagagatcaccaacaagtacaatcgaatggctcgctgaagctgtgcctggtgatttccggttgtgcagccgatacttctgaaaatatttgcatgacatgatcaaaatcagtatcaacaagcaagatatggaataatgaaatgaatgaatcaggaagcgagaactaatttgtttcaagaaatggttgctgaaataaaatgaggggtgtttgctcacctggagatggcttttcacttcgtcgttggtgagcccatcaaccttcatcacctccctgatttgctttggagtagcaactgcaatcatggtggaacaacaagatatgaggatttccggtgatctttgcaaattatggaaggtgaaaatgatggtcgaccatgtaatataccttgggggccaccgagctgctgcaaggcggcgacgaactgccggtgaagctccggcgaccagcaccgcctcgacttcctcgcctgctgctgctgctgctgcgcctgagcctgcaagctaagcgccgccgg

SEQ ID NO: 8137 - DNA, 757 bp, Oryza sativa
agcaattttaagcagaagctcgctgttctcaccgtcggcgaggagacgggcgcagagcgggagctcgcgcctgaacatctcgatcttgcggcgctcctcctcgaggctcatgatgcacgcctccacccccgtcgcctccttggccgccgccgccgccatcctcacggcgctcctcgccgcgaacatcttcaggtccaggctcaaatccagccccatcccgatctcccccacgtccagccccatgtacaacaacaacaacaaacaaaactctctctccctctctctcgaatctttgcaacaagaacaagaacaagaacaagaactggaggaagggtcgcggattggagcggaggaggaggagaaaggcggtggtggtggtgggtgagggggatctggaagctgcgcggcgatatatagacggggaggtgggaatctgcgagctggaccgcaggatttgttcgtctctctctctctctcgcgcgcgcggaggcgaagcgagaccgcgcggcgcgtggggtgggtgggcgcgatgcgttgccgattcctcacgtcgcgtccgtctcgtccgtccacccgcgagaaactcgcggaccttgggagcgggctagcgatgtcgatctaccgcttctcacgcccatgcagaacaccccctaacctttcccaatttcacattccagcccatatcacgcatattcctccataaataaaactcaacttacagaggtcgggtttagttccaaaataattcttcaaactt

SEQ ID NO: 8138 - DNA, 4103 bp, Oryza sativa
tctatcggccatttttggctggaccaaatgttgctttgttactggctttttgcaagttgggttttgggtgtgatatgagtggaaaatggacgtgcgtccccgcgcgggggcgtttttgacaggaaaagctaaggggaagctagcgatcaaggcggcttgctttttggcggctttcgctcgcatcaatcaaaggcgccgatggtgttgtggtggggcggcagcgcgcgcaagagcgacactgggaggcagagcttgggcttggctatggccagcagccgccagccggcaggagacaggagagtgctgctccctgtagccactagccaaggtaagtaaagcatcatgatcaaagtggtaatttgaacatgagagctactttcttcttctaaaataaacgaatctagaacaagataataatagaatgcgattttttctagcacaataaatcttgccctaaaataaaagatgataggatgtgatctttctagtataataaatctggacataatatcatatcctattctaaattgatttttatggaacggagcaattatgggtttgcaatatcgaacggttattgcagtaaaagcctctcttttttatcggtaactgcagggtaacggcaatataccggtagtggttacccccagcaaaccagtacgaggaaaccctgcaatacttgtgggaaatgagtgtttttgtgtagtttttacaaagttccagtgagattattctgtaagggcaagtgctatggtagatgtgactatcacctctaaatttatctattttatttaattatgaactaagaggcaactcatacaatgtatctaatactctcacatccttcttgaaatttgtgtggaggttgcctcttgatttaggggtggctcatcatctctctcctcacttctctcctccacatcatcactcaatccaatgtggcattcttagaggcaacacatgggttatatctaatactctcacatccttcttgaaatttgtgtggaggttacctcttgatttaggggtggctcatcatctctctcctcacttctctcctccacatcatcattcaatccaatgtggcattcttagaggcaacatatgggttattacagtacttgccctaaagtttccaaaacttatccacaggagagatgctgttggcagtgcatgcactgaaaccatcattttcactgaaccagtaatcccatacgccaggggaaaaaaatccattgcatcttcatcatcaggtccactctctccattactagtactacactgcaagtctgcaacttgtcacctacggtaataatattcacaaacggagcaacatgtatgaatggcatgacgagtcgagaggcggagagctttggaagcctggatatgaggctgtcgccgcgacaagagctagctgtgccgggctgccggccctgtcgtcaggctgtccacctgtgggggttgctttccgtaatcatacggtgcacatgcccgcagtacatacggcgtcgtctcatggtcctcctactacggttttgcctatcggctattcagtcatcagtgggcggtcggtttggttggttggttggttgctccagcgtgtgcgcaccgcgcagcagcaggggaagttaccgcctcgccaagtcgcgatgtgtgtgtggcacgcgcgctcatgcgaggggagatgggatcatgggcatatgggctgcccgctcccgccgttttcgaggcttttctggccctgtgcaatagccaatagtacggtggggttgtgagaggttgcagcccaatttttgtgttgcggactcgcggggttccgcttgggcttgttcgcgtgcgcgatcagctgctcccctctagtctgatctcttatcctatagagtactactatactatacgtactatatatacacacacgtatgtatatacaatatatatatatatatatacacgtataaactttgtatgcgtatatacgaagtttatacgtatgtatatatatggtatatgcatacgtgtcatatgtgtgtacatatacataattttatatgtatacacttttaatgtataaaagatacacatgtatataaagtttgtgtgtatacatataaaaaatttaaaaaatacgtgtatacaaactttgtatacgtgtatacaaactttgtatacgtgtatacaaagttggtatacatatgtataaaaaccaaaaaatacacgtatacaaactttgtatacacgtatgcaaaagtttgcatacgtgtatataaagtttgtatttgtatgtatacaaagtttgtatacgtgtatactaaatttatatacgtgtatacaagtttgtatttgtatgtatacaaagtttgcgtacatacgtattaaaaaggaaaaacagaaaaatatacgagaagaaaaaaaaagaacaccggaaaaggtacggaagagaaaaaaatagaaaaaaaaaagaaatcgtacgcccaaagaaaacggacggtacacgcgctgtcaccgcctcctccccgcgcgcgacacgtgtacagtcgcacgcaggagggtgagcgcgactagtcgtgtattagccgtctcggggggttggtggctcttccgcacttgcaattgggagttgggacatttgcagtttggcactacgtcctatataaaattatttaccacttctgatgtgatgctttttaccgatttgctactactaaacccacgtgttataatcatatgaggaatttttgtatcattttcacgcgtagtaaacataggtccgacattactgatagtgcaatgttaccctgcagcgtgtagttagtactacatggtactatgtacatagtacacatgtactaatatgattttcgacggtccagaccttgaactggagctagtagagccaggaacctgccagcgtgtgcactccacgaacagggcccggaaaagagaaacggggagaggaaaacgcacgtcgacatgtggaccatctcgggccaatcaggatccctctggcaccaattgcgccttcaccttttcacaggcaaaggataaactcctccctgccaccatccattccgccggcgccttatcctaccctcatctcccgtacaaaacccactccctccctcccgctcccaacctgacccactccaaccccccctgcgccattgccggccacactcctcttcctcctccatcgccaagaaccaccacgaggtaggcaaaccaccctcatggagatggatttctgtcgttctgagctgcaacattgcttgatctcatcgttggttttcttgcagcaatggcgtcgctgtccatggccacaacgctgccgtcgctggccggcgccgcaccggcggcgaggaagaggagcggcgtgacgtacgtggaggggatgaacgcgtacagcgggctcaaggcgctcaacaaggtgaccctgctcggcgtgcgcaagaccgccgactactcgttcgccaaggtggtggccaagctgagccccgccggcgggaagagccgcggcggcgcgttcggggcgcagtgcaacgccgccggtgagatattcaggatcgccgtcatcatgaacgggctcgtgctcgtcggcgtcgccgtcggcttcgtgctgctccgggtggaggcggccgtcgaggagtcggagtagtggaccccgatcgagccatagcaggcagggcccagccagccatggctggttggccccgataagccgtgatatataactgtgatgtatgtttcgattaaaatttgctttcgttttgtacccatgacgattggtgaatacccttggaacgaaacacgttttggaggcagaacctgcaaatgcaattggtttttcagctgtacacattgcggacttgctacggtctgtccaattcttcttccagagtttacttcggttttgaaacattcaaaaaaccagaatgatcacatcatcaccatcattcatcagcactgaatcatgtttagtgtactcactttcccataaactgatgacaaaactgaatgttataggctttcattttagatgatgccatgcggttgacagaagaagcacagcaggggcaaaatatacttttagttcaatgcctataaga

SEQ ID NO: 8139 - DNA, 1113 bp, Oryza sativa
  unsure (1)..(1113): unsure at all n locations
nnnnnnnnnnnnnnnnnnnnnnnnnnnnnnnnnnnacacgatccttaccttgaattgatccaatatatgctttgacttatcattgcaaagattctttcttcttcttcttcttcttcttcttcttcttcttcttcttcttcttcttcttcttcttcttcttccttttctttttttttaaaaaaaagaagaaattgcagttcactgaatggctttcaactagaaacgcacacagtggatattgctgcgatgctgcatctgccggtatctagaacgaacttatagaatccaataaagatttgcacaaccttgcacaagtgacgtgcacaagattgaggagacattgcttcttttttatctttattttgagcaactctgaagaaacctttcagtactacagctctgaagaaacccgttttttctctttaattagagcatatctgaagaaacccctttgtagtacagctctgaagacaaccattttctctctttaattatagcatctctgaagaaatgtaatagcatctgttagagcaagcctgaagaaacttcacacgtcattcgcttgtgacctagataaacaataatgctgcaagtgtacaactatggagttatattgtaagctacttcctccgttttatattataggactttttagcattacttatattaataaattatttatatgaacgtgagtaatgctagaaagtcttataacatggaagtaatagtagtgtactgctcgcctcacatcgatatgatcttgcagcgtcactccacacctgtagctttcacaagttggattacttctcaaatcttaactgatggtagtgctttaaattattgggcaattctggctacttaatttttatctccgattttttaatatataacacaacacaattgattttttattagtatttgtcttttcaaaaaatatgtgtttaaataaacaatcacaccaggcataatggtactcttttcactccacttaagtaagtaattggataaatattattggttaaattttgagaaaaaaaatcaattgtgtcatataatatttaaaaaatagatgaagtaattattaagtacattattattaattattaactactg

SEQ ID NO: 8140 - DNA, 3199 bp, Oryza sativa
aaggattaattaggcaagatgggtaagtgccaacattaagaagttaactctgcacttgcagcggttgttgttacagttacctatcgatgttactgcctagcaacctcttttttttttttttgccgactgatgctgtacgactgtacgtacctccccatgtctatacggtttagtttaatcttaacgaaacattatgctctggacagatagtacattaatacagtaattaattcgccataaagtacgttgatgtgattagatgtacttgcagcagcattactagattaattgtattcgttacgtctaaaaaaaatctgcctacctagctgcctctttggcgatcggaatttcagaacaaactggaggaagttttttttcttttcgtgttaaaaggaaaaagaaagaaaagaagtagaagtatgattaaaaattaattagaagaaatgtgaccactgcatcttaagcacgtagtagtgcatcttgaattttattttgttttgaaccatatgactgtggattattatgagtatatgcagttccacgtactccgttaacgtggctaattttggctccgccatccaaaccgaccgaccgatcgagtccgacggcaccaccacctgtgcagcatcgaacactttgtaaggacgatcatatcattgcaacacgtacttccgtgtcccttgtgtagtccatgctgacgtttctggcaccaaaatcacccaaaaaacacttaattaatttagtttgaaaaacattaataactaattttgtacgacgacgtggccattctcctgcgaaagtaatcgcgtagtgttcatggagacgaaagcggcaggactcctcgcaagaaagaaagaaagaaaacggcaagacgaaattgtacaaaacaacacgatgcattctagctcgatatgatcgatctgcgccgtcctgtatatgcattctagcatggcagaacgcatggaatgtttcagatattcaaaacacacacagccgtcacgtcatggacgctagctgccggcgacgatcaccaccgttgtccacgtactacttccatctaattaacgtgcatcttctaggctctgctcatgcgcctatatatataaaaaacgcacacgaattcgatcgcgttgcatatttgcatgaacaagtcacaagtgtagtagaagtgcagggcgcaagctgtgcaacacacatggcggcgatgacggtgaggccacggccggccgccgccgcgatcatcatcgccgccgtcttcggcgccgccccggcggcggcgggcggcggcatggtgggcgtggacgggacgcagttcgtggtggagggcggcaggacgatctacttcagcgggttcaacgcgtactggctgatgatgatggcgtccgacccggcgcgccgcgccgccgtcgtcgccgcgttcgcccaggcgtcatcgcgcggcctcaacctcgcccggacctgggccttcagcgacggcggcgaccagccgctgcagtcgtcgccgggcgtctacgacgaggccatgttccaggtcaccaccattcgtcgtatatcaatgaccatttgtcacgtggaatggtgaacaaaaactcacagtttttgtttgattttctctggttttcttttttgcttgcaggggctggactttgtgatcgccgaggcgagacgacatggcatataccttctcctctgcctcaccaacaacttcgacgatttcggcggcaagcgtcagtacgtccggtgggcggccgacgccggccacaacctcaccgccggcgacgacttcttcaccagctccgtcgtcaaatcctactacaagaaccacgtcaaggtacgtcacaatcgatatatacatacatcgatatactagatgttaaagagctggagctcgatctctcgtgcaggcggtgctgacgagggtgaacacggtgacgggggtggcgtacaaggatgatccgacgatcttcgcgtgggagctcatgaacgagccgcggtgcgacgccgacccgacgggcggcatggtgcaggcgtgggtggaggagatggcgccgtacgtgaagcgcgtcgacggcggccgccacctggtgacggccgggctggaggggttctacggcgacggcgagcacgagagcaaggagctcaacccgtggggcatctactacggcaccaactacgtggccacgcaccgcgccgccggcgtcgacttcgccaccatccacctctacccggacgtctggctatggggctccaccgccgacgagcaggccgccttcttccgcaactggacgcgctcccacgtccacgacacggcggcgttcctcggcaagccgctgctcgtcaccgagtacggcaagttcctctggaagggcggcggcgccaacaagacgcagaggaactacttcctcgacgtggtgctcgacgccatctacgcctcggcgtcgcgcggcggcccgctcgtcggcggcgcgttctggcagctgctcctcgacgacgacgtcgtcgccggcatggacgacctcagggacgggtacgagatcatactcgccgaggacagccgcgccgcgagcatcatcggcgagcactccgagcagctggccagcctcaacggccaggacgcggaggcgcttcgccgccgccgccggcggccggcgagctcgcaccggaagacgcgtcttggcagcggcggcgacagcgacgcactccgactcccccgaacgctcttgattcgcttcatctctttgtctagatcgatctcttcatttattcaagacaattttgttcttttctagtttgtatatagcttgcatccttctccttaggtatagttgttcgttggcacatcttgcaactgtaacctgtcgaaatcatcaggaacgcttcaggatggctgttctgacgatgtatgttttgtaccatagtttcctgtataaggtgttttgcaacggttactacgatggagtaccatatttgtttatactaccattcttaattattgacagtagaattttctttactgtttgtaattgttaaattatagtgttgatagtggaatacagtagagaccaccgcaagatggaatgctagctttctgaaaagaaattttgtactacagaactgcaggtccctgcttccaatactgttggccagttgaagtcgacatttcaacctaacacaacgcttattaatcagcgtatccctg

SEQ ID NO: 8141 - DNA, 4257 bp, Oryza sativa
  unsure (1)..(4257): unsure at all n locations
gagtccatatagaaatacagtttaaaaatagttgaaattcgaaattaaaaaataaggaatattagaatagtagactagagtccatatagaaatacattaggaaataactgaaattcagaattaaaaaataaggaatattagaagtagcgtatagagttcatatagaagtacaattaggaaataactgaaattcaaaattaaaaataaggaatattagaagtagagtgtagagtccatatagaaatacaattagaaaattactgaattcggaattaaaaataagaaagattagaagtagagtatagagtccacatagaaatacaattaggaaataatagaaattcagaattaaaaataggaatattatgagtagagtatagagtccatataggaattgaaaactaactaaaatttggaataaacataacaaaattaaaagtaaagtttagagtccgtataaaaataaaatttacaaataactaaaattagaaattaagaaaaacatgggaagaagagtttaaagtcaatataggaatacaatttagaagtaactaaaattcgaaaattaaaaattaaagaatattgaaagatgagtttagagtccacatagaaatacaattagaaataataaaaattcagaaataaaaataaataatattgaaagaagagcatanantctatntnnnaaatagantttagagannatnnggagttatnnaaagagactaaagggcgacgagtctagagtccatatagaaatatatataatttacaaataactaaaatttgatataaaaaataattaataactaacacgtatataaaatacaatatgaatattacacattagtagttttgtaaagttattgcaaaatttaaaattatgttatcattttaatatatttgaataatataatgagaaaacatatatgctattatatgagaaaatataatgatgctagccacgcaatctgcgcgggccaccatgctagttgtaataaatttagcatagctccgagatttgagacaagtttaatcgatttggcttcaaattgatatatttgacaaatcaaattaacaaaatatgatataattatctttttcccatcccaaattgcatataattaataaaatatagataaagcaaaacacacatagagctgagagccatgcgccactgtcgcccctacttctcacgtgtcgctgccgctgctggcgtgactattgatcccttcgtgcgctgtagtctccgctgctacctccttgcccctgccccccctcgggtgccactacccctggcccctactcccaccatgcaccgttgtcgtcgcaccctctgcgagcccacaccgctgctctcttcatgtgtcgttgtcgcagctctcatcgcacgccgccgctttcaccgccccgctacctccgcacgtcaccacccccactccctcctcgtgtcgtcacctctccctccatctcggctactgtccgccacgctagtctttggagatgaatggatgagaagaaatttagggatatgatgttgtgtacttaggggtattttgtcaatttggcgtataaatagtttttttaaatgaaatcttaacagtgtttgcaaataaggtcaaacgacaacttcaattttaaaaaatatggtcaagtgagtaaacttaaaaaaatagagacaacgaggtttaaataagcaattgtctgttaaagtttccctgtctttcccattgatgaagatgacagcggcaaccaagctgcagtttgccggcttgcagcctctcggatggctgatggacggttgagatgaaggcattgtaggcaagggccaatcctgtccaacccggctccgacacgtgccgttgccagtttgccacacctcgtcgaggcgaatcccccgcctttgtgattcgaaccgctttttgggatcattcgaatccaatccaatcaatcgaatgctgcaagaaaatccaacgcgcgccaccgacacacgcgacgaccacctctctacctcgccgcatccttcgatcccctcctctttcactggtgcccagcgctcgcccgtctccacccaactgaacttgacttgcgccgccgccgccgcggggaagcctccgaataaactcgcagccgcggggcctctccggcgatgctcggggctgcccagggaggatactaggggcggatttcgagggcgacacggggggtgtcgcttgctccggtccgagtccgacgctgctgagccatccacggacctcaaccctaggtatcgctttatcgaatgagcgttcattcgcctctcctttctctgtccctttttttttgggatctagatggggccatggtttgctctgtttctgtttttttttttttggttctaaaaaattcgtcacgggctcatggctagacgtacggggtgttgtggtgtattttggatagccgaacagcacgaattctcaattggctagattacggttggattcctgaatagccgacctgcaatttgggtggattaggtttggttcctggatagcctacctgggatgggttaagcttagattctgtggaagtagaattttggttgattatcaggggcttagagttgaattcagtgaggaattttcgttttcttagatttaggcgtattatgatttagggaggtttcgtgaggaatgggatttttattttgctggttactgtttgatttcggtaggaatttgaagttgaggtgattgtggttgcaaaagagagagaatctggatgtgtgccatctttctattatttaggtcgttgattgcttaagtttcaatctaatgctaaatttattgtattaccattctataacttttgtctaacacccctggtttaaaattttcatgtggaacctgctatggattggttgggatattttcatgagatctcttcatcaaagcatgatctgtgctgttattacaatataaatggtgcacgttgctcttgtttacacttatctgtgatttgttaatcttctgttaaacaatttgctccctatgtttgtcctgccctgaaatctggacttgtttagcacaaatggtgcattttctgagacatgtgaatggctttatctctaggtctatggtttaatttggcgtaggttgatttttgattctatacttttgtttccctatcatttgacgctttacacacaaaaaaaaaaacttcaccgttattgactgactggcattgaatatgaagcatctagctgtaatagtttctcagccattagtatggttacgagttgttatgccatactgattgtatttatcctttttttcctggagtgggcaagggaagctgtttttgtttttattcatcctcagtaaaaattttcatctagatcagattatgtttcctttgtttgcaagtgatgtttaaaagagaaaaaaaaataacatgtgggggctaaatcagtgaacaatataaaatttttcatgaaatgctggtgaaaagcagataaggtgtggcttgagcatagtaagttttgacctatagtgaggctgtacaaatcttctgatgtcaatcatcttgataatgataaatgcatgagttcttgcgctttagttcaaagacctccaccctggcgcgctgccgtggcgcctggcgatggcatggtggccgtggacggcacgcagttcgtggtggactgcggcaggacgatcttcttcagcgggttcaacgcgtactggctgatgatgatggcggccgacccggcgctgcgcggcgcagtggcgacggcgttccagcaggcatcggcgcacgggctcaacctggcaagaacgtgggccttcagcgacggcggcgaccagccgctgcagtcgtcgccgggcgtctacaacgagaccatgttccaggtcatcctcgcttgcttaccatcgtcgtcgtccaaaccaacgcaaaaactcactggttgtcttctctgtaacgtttttctgggcaggggctggactttgtgatcgccgaagcaaggcggcacggtatataccttctcctctgcctgaccaacaactttgacaattttggaggcaagcggcagtacgtgcggtgggcgggggacgccggccacaacctcacctccgacgacgacttcttcaccagcaccatcgtcaagtcctacttcaagaaccacgtcaaggtcagtatatatgcaaagcatatgcatcgataatcgatgtgttacatttcaatctcactcattcattcatgctgccgttgcatcgg

SEQ ID NO: 8142 - DNA, 49985 bp, Oryza sativa
agttcctatggaagaaggtcggcgccaacaaggcgcagaggaactacttcctcgacttggtgctagacgccatctacgcctcggcatcgcgcggtggcccgctcgtcggcggcgcgttctggcagctgctgctcgacggtgacatcgtcgctggcatggacagcctcagggacgggtacgagatcatactcgccgaggacagccgcgccgcgagcatcatcggcgagcactcggagcagctggctgccctcaatggccaggacgcggatgtgctttgccgccgggcaagctctcaccggaggacgcgtctaggcaactcgcttagctgcggcggcggcgacacccttgaactgctcctccggatggtcttggcttgtttcgtctctttgtccagatcgatctcttcatttattgtacagaatttcattcttttgtgatttgttccatgcatccatcttcatgggtatagctgttcgttggcacatgttgcaactgtaactaggacaaattttcaggatttgttcaagatgattgtcctaatgttttgtaccgtagttttcttgtagactatatagaatgctttctgtgaaaaaaaaatactatacttcaaaacaatcccatcttccaatactactccctctgtttcaggttataagacgttttgactttagtcaaagttaaattgctttaagtttaactatatatgtagaaaaaaatagtaatatttttaacccaagacaaatttattatgaaaatatatattcaattatatatttggtgaaactaatttaatattataaatattactatatttgtctataaacgtagtcaaacttaaaacaatttgactttgaccaaaatcaaaatgtcttataacctaaaacggagggagtatttgccaatggaaatcgtcatttgaacctaacacaatattaatcagtacactttcttactattttggaggttaacagtggagtgtcgctgacaaaagtcccgtggaaatgtttgagttacaacagggaaaacatttttgtttgccatatgcatccttctccatctgtttttctttctttttctttttttttaaaaaaaagagcactacacattgagcgctgcaacaatgggccggcgccaagcgcattacttcacccctaatgggccgtcatgaacacctgatgggtttaatgtcatgaaacctgaactcacgctctctcgctgcattttttttttgcagcaattcaagccacaatgatctggaagaacgttggccttccaaatttctttacattgtctctaggaaaggacttgcaggtgcattcagttagtttcagtttcaacaaccctgcagttttatacttatgctgttttcatttaattcgactagtttcaacaacctctagaatttcaaatttagatagtaataatgcatgcatgtgattagataaaaagttagcgctgacatttcccggttgctttgtttgctaggattgtgttgcatctcatgattctcatctcgatttcgcggtaattttcaaacaagtgtacaagcttctcagggtacttcgcatccaagctagcactattgacctgcatctccttcagaatttgcacgatttgcatgtttagtggatttgcaagattgaaaatcagttagccaagtttgggactaaattataagagcctaagaggtcatcagtgaccgatttaatttgtcagccacaccatcagttctaaattatttttgtggcgtccacaaatttggcctgcatacttttttaaaaaaatctgaattaatcaaccctgttatgccaaaaacggttgctgatgataacatttgatttgtgcgtacgtatctgctgacgataaattacgacagaagcaactgaaactacgatatgatggtctgagaaacatcatatgccttaacggacgatcacattacagttgaattttctagttactactaactaattgcttctctaatcgagtctccgccgtgcaactcgatcacatgacacatgcatggtccatacgcagtcaaaaaaaacaaaaacaaaaaacaaaaagaactttgctttcgtctaatatatttgaggcgcgcaagctttgcgtgatcacgaaaagaagtcacagaaaaacgcaggcggtgaatactcgatcgaattgagttccccaaatcgatctcatctcatcaacaaatgctctcaaaattcgtccaatgcataagcatggaagtgaatgagtgatccaatatttcacaaaaacccagctctcaaaagcccactgcaaccgcttaattacttggctataaataaggtggtgaagtggccatgaatggatcacaaagcttcacccactccaaacctctaacacctgcagtggcctgctgcctatatttgtccaattcgacaccgatcgatcagcttaagaggctgagcttaattaataatcactagtggtcacacgtgtaagcactactagttagcatcagtttgcataatcccctcgcatatttgcagctagctagttatacatatatatggcaggaatctagcttggctgtgcttgttcttgatccatccatcgccaattcgccatgcatgcgttcttgccctgagtcgatcttgtgaattggtggtggtcggagagatagattggttggttgcgagggcgaggcggcggcggcggcggcgaaggggatgaaggcgacgtcggagggggcgtggcagggggacaacccgctgcggttctcgctgccgctgctgatcgtgcagatctgcctcgtcgtcgtcttcacccgcggcctcgcctacgccctccgccctctccgccagcctcgcgtcatcgccgagatcatcgtaagttgttctcatcatgccttcatcagttaaatttcgcaatcctttcttgtcctggtattatgcaaccatactatatacaaccttaattactccctccacattttaattttaatgtatgacgccgttgactttttgacgaacgtttgacctttcatcttattcaaaaaatttatataattataatttattttattgtgacttgatttatcatcaaatgttctttaaatatgacataagtatttttatatttacataaaatttttaaataagacgagtgatcaaacgttgattaaaaagtaaacgacgtagtacggagtactttgtcgttgcatgaactgtatggtttatcattttgttcttgaatcctgacacgctgttgatcaacgacaccacctcatcctggcaaagtttcctccattcgcacatccttcttcccatcccaaacagtaattacgaaaaacggagcggtccattagcacgtgattaattaagtattagctattttttttaaaaaaatagattaatttaattttttaaagcaactttcgtacagaaactttttttaaaaaaacgcaccgtttagccgtttgaaaagtatacgcacggaaaacgaggaagaatgtttgggaaaaggggatagcaaacagagccatatggtcactcattcttacctagagtgatataaaccgcagttacttgaggataattctagtaccaataatcccaagatcaccataccaaagaccaaccgatatttttttaaaaaaaaaatgcgtgcttttatactagcacaaccaaaaaaaaaagttaagctttggacctcaggaaaattaatccggctttgtaggtaagggaaccagaggtggtagttgcagaagattgctggctatttttgggtcacctgctagttttatctttcctacttttagagcaacctgtacttagtaagcactaagatgatgttcttgacaagatcagtagcttctgctgccattgacaaatgcaccatgcatacaatgaagaacacaatgcaagaagctgaaccttacagataaaaacgtaagaaaactgtttctgatcgagttcttcctcatcacacgtgtgtaactcgtaccagtccacgatacgtaccacgtgcaatcgtaggaacaacacatactaaccagagttttctttcttcgattttgaaaatataaatcaagcattgcccttctatagaaaatacaggagttgacttcgtgaggatggctctgactctgataagctaccggctagctagtacagttaaactagtaggactagtatgaaccatttcgagccagctgactgtttggattattctgtggcaattactgatgcagctattttctatgcaaatattccctccatactcgtaaaggagatcgctttggacaacgacatggtctccaaaatacaactttgactttttgtttatataaaaaatatttattgaaaaatgatatatgtatacttttatgaaagtatttttcaagacaaatctattcatataatttttacatgttcaaacttaacaacttgagagttatttatgaattatattcccaaggtttgacttaaacattgtcctaaacgacttcatttacaaatacggagggagtatttttcttgtgtagctttctctggactaacatatattttagcaaacagatacagtttccaagaagaagaaagtagagctctaaaaaaaactggagaagtatggttcctttacactttaaaaaacataattttcttagattctgaagaaacatctggattaatattaggccaacagttgcatcaccattgaccaccaaagcacagcagcaatacgctgccaaacaaccaattactacagatcatcagttgattcctgaagaatattaaatataaaatataagtagtatatgtgctgtatcaatttcaggcccatagcatcaatcatactatactctttgggttctttcccttacagttttgtatttaattcttcatttatttatttctttattacccgtttgagcaaaatgggtatgttgcatccgtccaaaataagttcatttttcatccaacccacaacacgtgccaattcaaaacttatcaattctcaatgcaactagttccaattttatctgctctcagtataattattttttactttttacaaattctggtacaatgattacttaaaaatagatttattttattttaggacaagtagtaagagtaggtaaaaataaacttattatgagacggagggaggaagcatctttgtgtgatgatgaactgactgcaatggcggcgtgatacagggcggcatcctcctgggcccgtcggcgcttgggcggaacaagcgattcctcgacaatgtcttccccaaggacagcctcaccgtgctcgacacgctcgccaacgtcggcttgctcttcttcctcttcctcgtcggcctcgagctcgacccggcctcgctccgccgcaccggccgcaccgccctcgccgtcgccgccgccgggatctcgctcccgtttgctctcggcgtcggcgcctcgctcgtgctccgcgccgccatcgcccccgacgccccccgtggcccgctcatcgtgttcatgggcgtcgcgctgtcgatcaccgcgttccccgtcctcgcgcgcatcctcgccgagctcaagctcctcaccaccgacatcggacgcatggccatgtcggccgcggctgtcaacgacatcaccgcgtgggtgctgcttgccctcgccatcgcgctctcgggatccgggtcgccgctcgtgtccatctacgtcctgctctgcggcgtcgcgttcgtcggcttcgccacggtcgccgtgcggcccgtgctcgtcttcatggcacggcggtcgccggagggcgagccggtgaaagaatcgttcgtctgcgccattctagtcatcgttctcgccgccggcttcgccacggacgccatcggcatccacgcgctgttcggcgcgttcgtcatcggcgtgctcgtccccaaggaaggcgcctgcgccggcgcgctgacggagaaggtcgaggacctggtgtcgtcgctgttccttcccctctacttcgtgtcgagcggtctgaagacggacgtcaccaccatctccggcgccaagtcgtgggggctcctcgtgctcgtcatgacgacggcctgcgccggcaagatcggcggcacggtggcggcgtcgctgctgatgcgtgtgccgctgcgtgaggcgctcgcgctggggatgctgatgaacaccaaggggctcgtggagctcatcgtgctcaacatcggacgcgaccggaaggtgctcaacgaggaggccttcgccatcctcgtgctcatggcgctcgtcaccaccttcatgaccacgccggccgtcaccgccgtgtacaagccggcgcggcggcaggcgtcgtacaagcaccgcacggtggagcgcgccgacgccgacagcgagctgcgcgtgctcgcgtgcttccacgccagccgcggcatcccgacgctgatcaacctcgtggaggcgtcgcgcggcacgaggaggagcaagctcaccatgtacgccatgcacctcgtcgagctgtcggagcgctcgtcggccatctccatggtgcagcgcgcgcgccgcaacgggctcccgttcgcgagccggcgcggccacgaaggcggcggcggcggcggggaggtggtggtggcgttcgaggcgttccagcggctcaccgccgtgacggtgaagccgatgacggccatctccgacctcgacaccatccacgacgacatcgtcgcgtcggcgctggacaagcgatccgccatcatcctgctcccgttccacaagatgctctgccatgacggcacgctcgagcccgtggaccgggcgttccaccaggtgaacgtccgggtgctccgcgacgcgccatgctccgtcgccgtcctcgtcgaccgcgcgctcggtggcgcggcgcaggtctcggcgccggacgtctcctactcggtcctcctcctcttcttcggcggcgccgacgaccgcgaggcgctcgcgtacgcctcacgcatgggcgagcaccctggcatcgcgctcaccgtggcccgtttcacggccgccgccgacgacgccgccgaagacgacgacgccatacaaaagcacatctccaacgtgcgcaaggccggaaacgacggagcgttcaagtacgacgaggtgtcggcccatggccggcaaaaagtggcgtttgccatcaaaacactgggtagaggccaaaacctggttgttgccgggcggtcggcggcggtggcgaccccgctggtggacaagacggactgcccggagctcggccacgtcgggagctacctggcgacgccggagttctcgacgacgtcctccgtgctcgtggtgcaaaagtacgactcgagaggtgacactggcacattgtcgtcgagcccaaccggaggagaggcgaccgtggaggaatccggcgtgccaatccgccggccatagtcgccggaggagacggccgctacgtcgaggcagccggcggagccatagtcgcactgcctctctgctgcatgatagcacgtatatagcaacattagtgtgtccctcctgtcggtgattagatcatatttggttgttaattattagctaattagttgttaaattagggttcacaggtttatttagagaaagtttaatagtatagccaactatggctccaaatcgcctatataatagccaatgtatacaatagttacctataaatatatactatataattaataatgtctggtctcacctgtcatacacacatgaatcttagagtctgtgttgtagctggctacaaatatgtagtccgctgctcttatctcttctcttttatatttttaaaatatgtttgtagctgacttatagtttgctattgtacctgctcttagagcatctcgaacaggttccatatttaaattttagcaattttgaagcaaaatcgtgctccaatagccatccggctggccaaactactcctctcgttggccaaatttggccagccaaaatagcctagccaaatcgtgggtcccacctcttccccccctctcgtccgatgaacgttggcgccgcacctttgctacttcgcgccgccgcccgtccgcttaggcgacgccctccactggctccgccccaccgcccctccgcaccgcctctccgcgtcgcccctccgccggcggtgcccctccgcgccgccccttcacaccgccgcccgtccgcgccgcccctccacgacgccgccccctgctttgccgacgctgccgttgaccgccgccggggccgcccctccgccaccgtcgtcctttgccggcgccgcccctctgcaagcatcgacgatgagaaggaacgaaagagaaaaagaaaaaaaggaaggaggagagagagaggggaagaagaggagtggagactgacatgtgggttcgttgttattttggagaggattaatagagagtctgttggagtgatcatctagtttgactagccaaattagatggagaattggccatatagatgtttggagaatctaatttagagagactgttgaaggtactcttagggaaagtgatgggctaactaagttagtggttaattagtacaaaatgcagtgcagctgtaattttgtaagaaaaaagtgttgtaaacttgtaccccaccagttagcgtcaaagcaaaagttaaaatttgaatttttaacttgattcgatattttctgagtaatttcttcttatttttggcttgtaaatcgctacaaataaatatataaaatactgtaaattaacataaatggcgaaaatattgtacatcacacaagcgtattctcacacgaatttgtaatcgttccagcggcacgcgctgccgcctccatttcccacgctaccggcaccgcccaccgccggacttcctcacccgcggctccggcggcgccaccgcccaccgccggacttccaccgcccgcccaagtactccctctatgcccagcatcggcgaacttctcgacccctcctcgccctcaccaatcccgctcctccccccaccccctacctcctctctcctcgtttagttgagattgcttaccctgtttgattcttcagtggtatgatgtgtagatgtagtccggatacgtgcagcgggagcgcgggcggagctggagtatggccaatctagagggcaaagggaggtaaattaaggtatagaatttcagttttatccattacgcctatgctttgttttccaattcatactcactctcatgtgcaaactaaccaggatctggtaattggaacgatccccattcctgcagactcatagtgtgattcattgaatcaagctaacaaactgactgaaaattacctcatcagtgctgagtctagatcataactaactttatacagaaaacattgagttgtacaacatgtatgatgtatctgtatcaacttgttcaatctcggttaactggaaccaatttatgaaaaggtggttatcacttcccttaatctctgctcaggttgttgttttcaccattttccttactgtagatcacttggtgttgtgcattcccgttctttctgtatgatgatcaattttttagactaaactcaggtccaagtctcccaagtccactaaagacttgactaataagtccatccacaatttctttctgtcagtttccttgactgtcaaaatactactccctctgtccctaaatatttgacgccgttgacttttttaaacatgttggaccgttcgtcttattcaaaaaatttaagtaattattaattcttttcctatcatttgattcattgttaaatatactactactactcaagttttttaataatattcacaaaagttttttaataagacgaacggtcaaacatgtttaaaggagttaacggtgtcaaatatttaaggacggtgggagtagtattcagtagtttacacttcacagggtctaacaaaagccattccctgcttagaattgccagtaggtttcttcagcatacaattactatctcatctcaaggaactgcagtagactcttccacctggacaatgttcccacatattctcttcctatccctgctgctcttggttcctgaagaccccaattttgccgctggagcttcagccaatgagtcattcattactttgggatcctctatcaacacaagcagcacccagtactggtcctcctcttcaggccgctttgcgttcggcttctatcccaacggcgaaggcttttctattggggtgtggcttgtgattggtgtgtcaaggacaattgtgtggactgccaaccgtgatgagcccccaattgctggtggttctatcatatttgggcatggtggtgcgctccaatggtcacgaactccatcaactccaggtagccaactgaaccccatatctgacagttctacacctgctgcctctgctgccatgttgaacaccggcaactttgtactgtatgatatgaacagacaggtcatatggtctactttcagttttccgacagacacattgttggcaggtcagaacttgcgtccaggcagatttcttctttcaggtgtctctcagagtaatcatgccagtggcaagtataggcttgagaaccaacaagatggcaatcttgtgatgtacccaacaggcaccattgactctggtagtgcgtactggtctacctggactttcaacatgggcctcctcctcacgctttccttagatcctaatggtaccatatggatgttcgacaggaaaaactcctatacaaagatactgttccatgccaaccagccttccaatgcctcccctgatatggaaatttactatcgtctgacatttgatcccgacggcatcctacgactctactcacatgttttctttaagcttggcagggcacctacaacagaggttgagtggcttgagcctggcagtgatcgctgccttgtgaaaggtgtttgtggtccgaatagcttctgccatctcaccgtgactggagagacaagctgctcttgccttcctggttttgaattcttgagcactaaccagagcacacttggttgttggagagcattgccaaccggtggctgcgtgaggaacagctctaacgatgagacgagagtgacaaccacgatggtcgaagtgaagaacactacttggttagagaacccgtatgctgttctaccagccacaactagtattgaagcctgcaaactactttgcctctccgattgtgcttgcgatatcgccatgtttagtgattcctactgctcaaaacagatgcttcccattagatatggcaggatgcctggtaacaccacactctttgtgaagatctacacttaccagaccatatccggtactcgccaaagggctatgagtatccatgcaaattctgcattgatatcaggggtttccttggccatcttttctctgtttgtgctattagtggcatctctattacttatctgcaggcatcggcgatcattggcgcacatgacgatgacggcaccacggcaagaggactccaggattgatgggaacattgttggcctcagatcctattctttccaggaactagatttggcaacaaatggtttcggcgaagagcttggcaagggggcatacgggacagtattcaaaggtgtcgtggccgacaccaaccaggacatcgctgtgaagaggctcgaaaagatggctgaggatgggcagcgtgaatttaacagggaagtgcgtgtgattgcaagaacacaccaccggaacctgctgcgattgcttggtttctgcaatgagggcattcatcacctgcttgtgtatgagtacatgccaaatggatccctggcaaacctcctctttcactcagatgcctcccctgcctggagcaagagggttgcaattgcactagatgttgccagagggttgcaatacctgcattcagagatagagggcccaataatccactgcgatatcaagccagagaacatactcattgacagtttggggatagctaagattgctgactttgggctagcaaagctactgattgggaaccaaacaaagacattcaccggcatccgaggaacccggggctatctagcaccggagtggagcaagaacagagcaatcaccgtgaaggcagacgtgtacagctacgggatcatgcttctggaggtcataagctgtaagaaaagcatggatctgaagcgggctggggaggagtacaacatttccgagtgggcatatgagtgtgtgatgtttggtgatgctggcaaggtggcagatggtgtcgacgaagctgagctggtgagaatggtgaacgtcggcatttggtgcacacagagtgaacctgtgatgcgaccagcgatgaagagtgttgctcttatgattgaaggtgccatcgaagttcaccagcccccaccccctgcatcatattcgcagtcactaacatgagctgcaagcataattctgagtaagtaaaaggcaaaaaaaaaagaggtctacctgtaacatttttttttaaaaaaaaaactgttgataagcagagtgcaatctgaatctactgaatagatccagagtatatgagaagtggcacttagcaaaaggtgtgatcagaagaaacctcattgattgtgtaaagggaaaaaaacatttgatagcagatacccattacagaacaactctttgtcaacaggcacaaaagaacctagctaattttttgtaattttaacaattataatatttcagactttttttagttgaaatgtcaggtcgtttgctgatagaaatccttgtttaatttgcagaaaaatgatgaagtttgcttgaagcgctgcaaagtacagcaagggtcgtccgtctatcaccagttcaaatacatgagcttgcatcatggaacaccctgaaaattgacaaccaagtcttttacattatgcagctataagttttacattttgatcggtagaatgctatggatggcataagtacaggaacggtcctagcagatgctgttatgctagaagtctaatagatcatttcagtgcaggaaaatatatgatgaatcatgtactctgtttctgatatggaataaagtttatgagttctaaaaaaaaagtacaggaacggaaatccattttcgtctgcgatggagccttgatttttagttaactgccgtgttcgcttttctgatcgcgcaatgcatgttggattgttctctgaatcgttgtaaatacattgctgcattctatcgtatcaaatgatttgaaactatgtactacctccatggctctgtcctagaatatatatgaacttttaactatagatttgaatatgtacttgttcagatttatagtcaaaattattatattttgttacggaggtagtttgaagtaaatgattttgatgtcaagcaaatcaactatttgaagtaaatgatttggcaacaaaatgaaacgatgagaagtcccggcccaccaatggttactggatctcaggctctcagctactattcgtgactcgagttcgtgatgggccgagaccatgatcgctaccaatggtagagtgatcggcacagcaccatcgaaccaaattgcccaaacgccagaacgaatcactctgatgaatagtcgacaaaaaaaaagtatcactccgaaatccgaatccacgatgaagatgaatttcattagtccacaaaagtatcactccgaagtccgaatctacgatgaagatgaatttcattagcccacaaaagggcattacatcagactttacagaaagaatcgattcaactcttctcattagttattacagatcgatcgatcgagatgatcaatcgagcaatgcatatcttcatgcatctcagttgatcaaacaaacacctaactaattgattgatacgtagtacatagtacatgtctaactaaacctgttctctgacgaaaaacactgcactacttagtgctacagccgctcactacacctcaatcaaaaacttgtttcatttaattagggttcgagccaagaatgtcgtcgagggtttctccggaagccagccgctggatgatctcctcttcgcccatgcaaggtccgttcgtcgtctcgatgaattcgtctccgccgccggcaacctccatcgtcggagcccacggcaatggctcgtcgttcatcagatacctcatgtactgctccgtcgtggccgtgtcgaattccactcccaaactgtcgtccatcggcgccgacagcaacgcatccaggtccaactccggcaggatcgccggctgctcgctcccggcctcctcttgccgcggccgcgcgctgggcggcgcctccgggtgatccgcgccgtcgtccgccttcctcttcgagccggagcatggcgaatcggccgacttcgccgccgccgccgtgcgcgcctccgcgcagaccgcgcgcggcgagcggtagaccttgcagagcacctgcttgtctgctccgtcgatggcgtcgtcgtcgaggccgtactccgtcatgcaccaccctagcctcgtgaacgtgcgcgccgaccccgacgacgacgactcgtagacgccataggagaacttctggaggtacccgacgcggcggccatcggcgccgatcacggccttcttgccgccctccgacttccacacgctctcgccgccgccgccgccgccgaccgcgcgctgccgcctcccggaggtcttgcgcttgctggtgaagcgcggggagcagaagaagtaccagacgctgctgctcccatgggtgcccggcgccggtctgtgctcgccgacgagctcggccggattggcggagtagacgtcggcgtggttgatgaggcggtcctcgaaggggatcttggcgatgctggggcggaggaagagggtgatgaggccgtcgtcggaagggtggaagacgtagcctggctcaagagcgatctcgtcgtcgtcggccatgtcggcggcgctagctctcgcgttgccctagcttcacctcgatcaggggagaatctgaattgatcgaggagagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggttttttttttttttttggcgggaatgcggtattttgtacccgtaagacgagtatgatttactagtttgttgcaaaatggtaattagcccatcgaatttatgctttttctgatgggctaggcctgggacccaattccgtgacgggtgaggcccatcactgaaacgtcgtgatgcggctaggcccaaatttggacagcgtggccggggtcgtgacatcatcaggttcaaagggggttcggagtttccatcctccgaacccctttgacctctttttctctccaccacatgaatgcctttgtttctctggttccttctctgaatttctctgctaatgaagctcaatcaagttatcatgcaccaccattgaactactaatcttctaacacgcgtttattatcgatcttgccaaaaccatgttcatgcatgctctggccattcagcgtctgctactgattgatcatgcagtacaactttggtcccttctctgaaatgttaccatttttcttctgatgaagcgtacataccatgcgttgcatgaggcaaacattcattttctgcagccggagctggagagtagctcaagtcgtgacgccgccaggttcggagattaaagctccgacccctattttgacctcttttttccggccccaacatggatgcaaaatgtctccttcaattcagccgcccatggctctcttgtccttatcatgcatgtatggccacacatggtgaagaaatcgatcgatagaatcaaattcacgagacattcagacatgttggaattaatagatgggctaaggccaattcaaagattaattctttagaaaatcacaaaagcccatctcataagatggtatgtatgtgagtttaataccactttgcttattataggagagggaacctccttaaaagggaggatgccctcctagccacttgaagcatgtgtggtggagagaagaggggggaaatacacgcgctcgccctgtctcgcagggcagggttgttttgctgcgggaaattcggatttgttttgttttggaaacattccaaaaaatctggtgcgtgaaaacggcatggagttgcgcgacttatccggtttgctgcgggaaattcggatttgttttgttttggaaacattccgctgcggaaaattcggatttgttttgttttggaaacattctgaaaaatccgttgcgtgaaaacggcatggagtccgaataagttatgcgcgacttatccggtttgctgcgggaaattcggatttgttttgttttggaaacattacgaaaaatccggtgtgtgaaaacggcgtggagtccgaataagttacgcgcgacttatccggttcggttacgcggagtgaagatcatgcgggcgccctgatcaagcgacctatctctatataaaccgagtcgctgccttcacgcaacacacacgaaatcaatctagggtttgcctcctctgtactgcgccgtcgctcgtagactactacatcccgctcgccggcgtgcaccggcgatcgggagagcaggtctccggaacctctgccttcgacgtcttgcaccgggagaaggcggcaataagatttttgggaagcgcttcgcgcgactgctccctgttcgtccgtgacggctcgccttcctctccgctcacgtgctgcacgtcttcatcgacgcccgcaaccacgagtagttcctgccgagcaaccggtctttccgccacctcgatacgtgttcgacatgttgcgcatatttgatctgttcatgttttactacttagtttacatgtgtagatctaatgatgcgttcaatctagtttgcatctgaaatgtaataaattaaatcattatgtgcttataatttcaacaagacattcacaacattaacagtttagctgttagatggaatcggcagcataatatttacatgggtattactaccgctgcgtattttgccacaggtagacaaatcaagtgtgcttggcgacaagagatttgctattattgcagagagcttagagctccatcaacatggacaaaaatacagcaccggtatagttcatgaaaggtctgtttgctataaacagatccgggataacaatgtgggggtaaagtacggtctggatttcccaagaacagatccaggattttcttgatacaaatgctctcgaagctctacatgaaaagcatcacaagtgatccataagcatatattagacaggcatatgctaaaagaatatctactttttcatgcactatgtcatatgggaagcctatgtttacaatgtacattagtttcagtacgggcaagccaagaatattgtgcaagtacactccggtttcatgaaattaatggaccaaaatattttttttagttgcgccaataaataaatgcatgcaaccttaatatcttgttttattgcgcaaatcaagatgagcataacaatatactgatatgtccacacaacagattgcatagtattaatctcttgcctatcacatcaagtagaaaatgaccgcttgcgcttctgaacatcaaactcaacatcaatgaggccggttataccagctttgatcttctgtcctggtcgtactgggcctacaccctcaggagtacctgcagaggaattcattaataacccccacaatcacaactctaatgcacaacaaactgttctccaaaaatgtgatttaccggtcagtataacatcaccctccattaatgtcatgatggaactgatataacttattagagatggtatcttgaatatcatatcacttgtagatcccttctgcctaagttcatcatcaacctggacaagatttctctatgcttgttaataatttgttgtactttctacttcttagggggcaaatgaatagattcactacatgcctacatatttgtatagttacctttagccagagctctagatcatcaggattagctacatctgattttggaatctgttcaatagagcaagaatcatcaaggaaagtcaaatgcattggatgcagcaatggaattatgtagttcatattcagtagaatgacatcggcagcattcagagaatacgatccacgaccaacaaaaggagatgccaatctgtaactagtatcctgtggttcttttcatatgatattgactcaccttttccagcattctatgatttatttctatccattaataatcataaagattactggtgtatattccgtctcttcagttatccactactttgaatatggtacttggaactatttattacaagcaaatacatggaaatgaaaaataacgtgtcgagtcaccacctgaaccagtttctttaagcaagagaacacattgcttaccactgcactaattggagtgaaggtgtcctgtgctttacccaaagtccaaggaagacctgcagactacagagtacattggtttctaagtataaaacatagtacaagactgaaaagttatcttacattaagaaactatgtgattgattcatacaagtaccaaggatacaactgccaattagttaccatgattttgcacaaaaatagttataaaaaacattgtgtgtatatgatcaaacaagatagtggtaaccaaattcaaaagaaacaaatagttcttgttctagtagcttatacaattattagttgatatgattgcatgaacataataaagaagcagctactgagattatagtgtgcagcttgttgctgaatttcttttatcaatttgaatgttatgctcttatctatcctctgaaactaccaaggatgatagatggcaataaggtgacaagaccaaagaaaactagggcagctagtgcacaccttagccgcagactgaagttctcttgctgtcatgtccaaagcaagtgcataacctgggaaatccaaagatataccattagttataattgtactttgtcactgaaaggggaaaactgaaaaccagtatagctttttgttgactcgtagaacccacattaacaaatactagcataaaagaaagagtaatagtgaacaatctgctacttactgtagcataatttggtattgaaccaaacaataagatcaatttcactaccatgattatttagagaacatgaagcaaccaacgataaaagaaaatgtgactatgttaacgaatactcctcactaatgagactttcatgagcctggtcatggcaaaacaggcattgaacaagcagatggctaagagcttaaaattccatgtctgaatttttctaccaagcctgtcaaatgtatatggacaaagtttaccggaattgctgaaagagtgaaatttatatgtcctatagttgtccactttcagtctaagtctctaaggcctgctcaaatagttctgaatggcaattccaaggttctagtacgtagttttcacagaacaaagcatatcggcatcttcctattcggatttttcgggtggaaatcatattttgatttatttaccaaacttgtgattttcttccatgatcagggatatagaagtatacaactcatcacacaactaatcagctgaaaggatgccaccagtttagattagatccattttatcacagcacatcctagattatcaattacctcctacgaagtccatggcggatgcttcggggacgtcgcgcgcgcgctgggagatgacaacggcaagctcgacctcgtggtgcagcgactcgaccggctccggcacctcgatggcggcgccggccacgcccgcgtggaggaacgacgaggtgggcttcaggaacagcaccggctcctgcaaccagacgcggcacgggcaccaccgacgccggatcagggcaccccgcgggaagaaggcgaccggagaacccaccgccgccagtggtggttcgggattggagagtactgtaccttggggacggggttcccgagctccttggcgtgggcgacgaagttgcggcccacccctacgatcttcgtgctggccgccaggagcctctgcgccgccgccgccatggccgccggaggagagctgcgagcggcggagggatgcgtcgatcgaggaggtggaggtggtggtgacggggaagaaatggactccagcgcatggtcaagtgacaaaatatacggcccataagacaaaaaccggcatatcatggcccacaagacagacacctgccttcctgtgtcaaacttttataattttgacaaagttttgtagcaactcttgtaacaccaaattagtttcatcaaacctaacattgaatgtatatgttgatagtacatttgtttggtgttgaaaattttactatatttttatataaatttgattaaacctaaaaaaattgacttaaaaaaagaaaaagaaaatcaaaagtggtagtataaaacggagggagcataggaattagtttataggcatcctagaagctcttttaaattcattcagacccttgaaatttcattgtttgccaagatagccaaacttggcattacaaaagctctgcagcattagccaaacacagcatgacaaaagaaccacaccatcagcctaaagcattacatcctttattctcttgaaattattctttacagcagtaaattatctcacaacctcgatgattttggagaagaaacacccgtattgaacttcttgatgtagttatagatgtgatcactgatttcctgtgctctctcctgctggatgaagtgcccagcacctttgattaccactacttcctcaagcataggaacatctttcttcaacctacccttgtgtatgtagcttttgactcctgggagatggtaagccaggtcaccatccccgacaataaactttgttggcactagaacttttgcacctgtccatggtgccatcagctcccaattcctgtgcatgcaggtcagaggttatgagttcctgctacataggattatatgatcatatcatgcaacccacaactgcgtatgttgatgcagttctcaagtccatgggagtgcatgcttgtgatcatgactggtgacaaaatattcaatatggaaattactgaataaataatctgtgtagttcagaacagatttctatatttaccataagtgttttttttcttgaatacgcaggagaattgcgaatcatcattatattaagaagaaggaaaaggaaaaggtcccgacaaactacaagactgagaaaccaaaaagacgcacagcacacggcacacccagtcacccacccatacatatccaccctcacaaagtgttatgcaaacaagaatttcatctctccgagatctgttaactgcagttcatataggttgtgagctcctggttaaaaacacacaacagatgctatgatatctcatagtagtatagaggtattgaattggacaacagttaattccaagcaacaccattatctaaaaaaaaaagttaattccaagcaacgtatgcagtaagacaaacaggatacacagcaatcagtgacaacaggtaaatctaaaggaaaaaatgtgatattgtgcttcatgtttctctctctagtaacctgtcagggagttcaaaaactgtattgcaacgttaaacaggttgtatgtgtgtcttcttttggatagaatttaggtatctggagaaaaataattcgagtgatttgacatgtatgaattctgcacacaatgatttggtaccttaaaaatggcatacttacaggtcaaaacatcggtagtaattaataccaccagcgaagccagtttttgcatacacacttgctacataactgatatcttcctcagagagccaaggaggcaatgttacttccctgttgtttgcccgcatttttttaatggacatagcagaagatcctgttgtttgaacaatcaaggccaatttgaagaatctcttcaagtcaagactggccaattctttttcaactccaggttcctggcagccaagatgacacttgtgaaggcaaattataaaaattacatgactgagagtccgaacatggttcagaaacagttgtgaagcactgacttcatgaggacaaaacttgttcagaaatgaaattattccacatagttgtgcaaaattgttgttgtttttctaagcattatttagtatttactcattagcccatgccaatccatttagcaaactatgtatgattgatatttcatttcaatgtgtacgcaaactacaattggagctgctcacaaagaggaaaaagggcttgcggcacgactatattacattccccaaagatcaattgacaggaaaatttaacaccccagcctagcacatgcacaaaaatgaaatttcctgagtatgtctatgttatgtgttcatctatatgactagtgtgttaagatgaagagcagatgtgagcaccataccactggtaagatactaaaagacttctttttgaaaataagtattcatagacacaactcacttatccattgcaatgaagtgaactattcactaataaacaaaataagcacaatcattctcaaattagttgataattagtggatgatagacatttgggacggggatttagctttaattcttcgattattaaacagatagcagtcgattggccatttctgtggcctacgggaacaaattgcgcacctggaatcggcagacatagtaatcatcgccatacgcgccgcggaagtagtcgaggggcttctcggcggggcgcctcggcatgaacgcgacgctgaggttgacaagcgcgcgcacccggtcaggccgcagcaggcacaggttccacgacacgatggcgccccagtcatgccccaccacgaacaccttcaccgcaacaacgcgcgacgcgtcatctcagcgatttgggggcggaaaggggagagggggcgcgtgctttttttttacctgggggagctcgagggcgtcgaggagggcgacgaggtccccgacgaggtggaagatggtgtaggaggtgtgctccggcggcgcggtggtgccgccgtagccgcggaggtcgggcgcgacgcagcggtatccgcgcgcggccaggtgccccatctggtggcgccacgagtaccacagctccgggaacccgtgcacgaacagcaccgcgggagcagtgccgctgcccggccccgcctccgcgacgtgcatcgagatcccgttcgcctccaccgtccggtgccttaccgccgccgccgccgccatggtctcctctccactccgtcgcgcgacgcggcgacgacgtgcggtgctctgctactggctgtgaacctgctgattacccgaggtagttggagatagttgactgacatgtgggtccagtttcctggatgggccgatgtgatactgggcctagttcctttagtttccaaatgcaaagtggcccaggacggatagagcatttgcatcgcaaagcatggtcaattataccaaatcaatgcatcatccaaacattgggaagaaaattacacaggaattcagtcttttacttatcagtaggactttgcttctttgcgtgacagctgtataatacgaatctcaaagcaacatgtcttcatccctgatttccccagagacttgacttgacgagtaaacgcgttctcctgccgccgccgcacgccagtatccttggcggtgccccctcgcttcggcccttccttgcgtccttgtgggctgtggccctccgcgcctctcgtcgtggcggccagcggtgctagcggcagctaagtggtttgcacgtgttgaccagccgactctttgttagactaactttgcaggtagtggggattatcacttagttctcgccagcacttacgttgtcaattgaaaagaagttcaacagctaaaagacaatggactaggcatgcctataagacttcaccatggtcttggtgatgtgcttctatgatctcgtgatggcttttctctggcagacaatgggtaggcatgccttcaggagttaggtccttgccatggaccctgttggaattaatagatgggctaaggcacattcaaagattaattctttggaaaatcataaaagcccacctcatgagatggcatgcatgtggagtttagtaccaccttgcttattctaggagagggggacctccttaaaagcgaggatgccctcctagccacttgaagcatgtgtggtagagagaagaggggaaacacgcgcgcgctcgctcgcctggcagggcaagcggcgcgcgtgcacgacgttactacgcgtcgaatggttcgaaaaattggctcctcacccttgcggataggttacgcgcgacttatccgaatttgttttgttttggaaacattccggacggttcgaaaaattggctcctcacccttgtgcagatgtagcctccttgtgaaaacggcatggagtccggataggttacgcgcgacttatccggatttgttttgttttggaaacatttcggacttatccggatttgttttgttttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacatgcgaaatcaatctagggtttgcctcctactctgtactgcgccgtcgcttgtagattactccatcccgctcgccggcgtgcaccggcgatcgggagagcaggtctccggaacctctgccttcgacgtcctacaccgggagaaggcggcaataaggtttttgggaagcgcttcgcgcgactgctccctgttagtccgcgacggctcgccttcctctccgctcgcgtgcttcgcgcctttgtcgacgctcgcaaccgcgagtagttcctgtcgagcaaccggtctttccgtcacctcggtacatgttcgacatgttgcgcatatttgatctgttcatgttttactgcttagtttacatgtgtagatctaatgatgcattcaatctagtttatatctgcaatgtcatgatttatttatggaataaattaaattattatgtgcttataatttcaatagacccatggtcggataagatgttggtctcctgcagaaggaggaagagaactcatgaagaaaagacaatgaggaattggagaagaggaggaatcatgctttgagatttggactggacaggtgtcaaacaaataaacaaagtcctaccgatgagtaaaagactgaagtcttatgaaattttcttcccaaacattgaaatttcataggaatacggtccaaattacaacaacatttggtcacatatacgttgacactgattggcacacacgcttgtttgaagagtttttttttttgttttttttttacggcgatgaattgcatctgacagttgagttgagttgagcgcttcagttgggttggggtatgaacttggtgatgaagttgtagataaggtcgctgacctcctcagccctctcctgctggatgaagtggccggcgccggggatgacgacgacgtcctcgagcagcggcacctcggccttgagcccgcccttgtgcaggtagtcctggatgccggcgtagtggtacgtcaggtcgccgtccccgacgatgaacttggtcggcacctgcaccttggcgtccgcccatggcgccgccatctcccagttcctgtccatgttgcggtagtagttgatgccgccggtgaagcccgtcctctcgaacgcggcggcgaagtagtcgatgtcctcctccgttagccaggccggcagcggcagcggcggcggcggcggcgactcctcgctctccggcttgccggccttgtggacggtgaagcggttgcacagtgtccgccttatgatgtgcctcgcgtgcgccggcgcgaactcctcctccgcaacgccaggctcctgcaaacagcaacaattagcggccggtattgggccagattatcctgtgcaattgggcctcataaatgggccgccggcccagagaggatgaaaggtaagtggtctcatgtatggcagtggctgaaccgaccagaggtgatcacgtacaagaatgtagtagtaaaagattacctagagaatcgatatctttcgatgagaaacggaatggccaagtaacctcagggcaagtaattagggcttaatctctcaattccctatttcggcttgatttgctccctccctgcacctctataaaatggcacgcacgtagtgctcagttgatcaatcgatcagaagcagatagagctttctgttgcgtcaatggcggagatcatcctgaacaaccactgcgagggctgcgcgatcgacatccgcaaggccgtcgagaaaatgttcggtaagaagctagatgatgtgtgcagtgccagtgcatttttgtcatggcgatcgatttgacattttgggctgcgtgcgtgcgtgcgtgcgtgggggtgcaggggtaaagagggtttgggtggacatgtatgggcggcgggtggtgatcgccggccgaaaggtcgacgcgacgaagctcagagagcgactcaggcggaagaccggcaagtcagtcaccatcgtcagcgacggcacgccgccgccgccgcccgacgacgtcccctttgtcgggatgatgcacctggcgccgtcgccgccctactacccattgcccgcgccgcctccgccgccgccgccggggagctacctgtacggcggcaactacccctgccagaacccgtaccaccagtacgttcaaggaggcatgccggcgcgcttcgtcggcgacgacacctacgacgacggatgctgctccatgcagtgaccgatcgtgctactaccagtcgtagacgaataacggaataagccaacacgtagtatttcatctactgttccatcggagacaccaacagtagtagcagtatgcattttttttttcttgtactgcgaccacgcactgtaccggtcaggctatcgagtccgtgcaggagaaaatttcgctactccggctggaccgctggttctgatccgtttgggactttgaacaatatttacgatagtattattctactactagtagcatatataaaaaaggttcgtttgcgtctatctgctcacgagttctacctaattttctcccatgctgcatgttgtagtagcttcaaagtagaagaaatatatatgcatatcattcgttacttattataagtcgtttaatttttttcttagtcaaacttcttaaaatttaattaaaatataaaaaaatatagcaatatttttaatacaaaacaaacatattatcaaactatattaaatttaataaaattaatttggtgttataaatattaccgttttttctataaatttgattaaatctaacgaactttaattaaaaaaataaacagtcgaatagcttataagtatataatatgaaacggaggaaacgataagtacgtagaggaaatggcagaggatgaggttctgtgtattgaacctggaagcggcagatgtagtaggtggggccgtaggccttgtggaagtgatcggtggtcttgatggcgtcggcgccggagcggatgaagacgtggcgcatgaaggcgacgctggtgttgacgagcgccgtcacgcgatccggccggaacaggcacatgtaccacgcgattatcgcgccccagtcgtgccccaccacgaacacctgcttcaatccaaaaccagatcagatcagatcagcctctaagttttatttgcaacagctagtagaaaatcttgtaaataaaaaaaaattcactagtagtgacgaattggcatttaattattagtagtactctagttctgcttgatttgattaataagttccaagattttcagtactgatctgcttaagtacatagcattgacagattagtcgtggagtcgttggatgatgccaatcaaattgacaggcaagccacggcgtcacgttgggttgggatatgcccatatttttttttcattccgtctacccattgttgatgccgccttcagtttgaactttgaaccgtatcgaagcactatcgaacaaaacagtcaacttctttgcgctcacatcacaaagccaaatcaaccaaaagcaattttaaaaatggcagccttttcattcgctatccatgttcgacgcttctagggatcacgtattttattttatttagataatgatcacatattcgcatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctcgggcggcgcgtcggtgtcgccgtacccgcggaggtcgggggcgaggcagcggaatccccggccggcgaggtgctccatctggtgccgccacgagtaccagagctccgggaatccgtgcaggaacagcaccgccgcgccatcgccgccctcgccgccggcctccgcgacgtggatcgagatgccgttcgcctccaccgtccggtgcctaatgaccgccgccgccgccgccgcgccctccatgctctctagctccttcgctttcttctctcctctcctcaccggcgagctgatcgatcagcgtgtgtttgcacacttcgcgtgcgaggtgtgagctcgtatttatcgtacgtgtggtgccccctgtcgtgttgacaatgaagaaggtattgtttagtttcaacttttttctttaaactttctactcacttttctacacatataaacttttaatttttttatcgtatcatttcaatttcaaccaaacttttaattttgctgtgaactaaacacatccgaactctcgtgtgaaagtggataaaccgagagagagagagagggtcacgtttgaaaaaaaagaaacggtggcgaagtgtggctgtgcaagcgtgtgacgtggacgctaacgcacgtggcgcgtgggaactggcccccaggaaaacggcgaccggaagagtgtgatcatagcggctgaactattttctcaaattaattttataaaatttaatatacttcgatcaagctatttctttaaggtggcatatcatgtaactatacagatttaaggtgaatttcttattaaactgtagatttaaaataaggtgtaagataaataaatatcaagtagcaaaatctcataactataagtttgttagtgtcaatttaatcataaaattaccacgtttataactccaacgtaatggtaattctagggaatttaagctttagaatttatagttctatgataactccaaatttattttgagagcgataacttcaattttaaatatgtagttttgtaatactttattataaatctatagttttgttataaaaaaatagttaaatttgtaagtgtataacatgataaatctataattttgtgataattcgtttaatatattatagtttttgaaatttagtcctttacttttggatgaaataggaaggttatattgacttggtcatggcctgcatcaatttcagtagcagtagagtaggtgcatccacgatgtgcttgaaaaaagcgataccccatcaacatgttcaataatacatttatataagtgctataaatcatattgttgaggagagatcctcaatagcggggaattgtgagaccccccatttgtgatttcggccgggggcggaggctcatctcttgaaaatcactcgctcgtccctaggattaccggcaagcttgcacgcagtcggattatacaggttcgggccgctatggagcgtaacaccctactcctgtgtttgggattatggatgagttttacaaagatttcttcactctagaaagcgcactcgcttcctctcttctggagttcaggttttctaggcgtcctcctctgtctcagtgggcagggtcctccttttatagctcaaggggataccatatgcgccgcctctacctaccctctatcggagggggatcccactccacttttcctgggctttaaaccgtgccttctcccggaagctaagcaacaaccggttctcgagtggaaccaggcgccgcccccgcctgacacgggggacagccctgtcattccctcataaatgaacgatgacctgtgacagcccttcctcgagtgacgcttggacgtgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctgtcacgcccggaaattcactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctaagacattgaaacttgaagacatttatgtggtcaacttatggaggtcagtcaagtggatcgaggaaggaccgaagtgccaagtggtcaagatggaatgaagtttggatcctaccttagaacctatgccgccaaagtgtccttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtggaaacaataacaatgaagggaacccaattcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactactaacccagtggaagcaggtgattggttgcacactattgagaagaagttggaactgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctccagaagatgtgcgtactgacgaagaaaggcaggagaagttcctggaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagccagaggcagcatatcaggccactccaaattggtgaatcttcttccgctggtcaaggacagtcgcaacaattgaacatcgctggtgagatcaaatcagagactaatgaaagcaatgatgttaacatcgagcaagctaatcagccggtgccagttcagcaggaccagtctcaggagaataacactagtggaagggagcagcaggtatgtttcaactgttacaagccaggccactttgcaagagagtgtccgaagccgaagcgtcagcagccgcaaggtcaggtcaacaacattgtcgtcacaggagccaatgcagtgccagttgcgtcttcaagagttgcgtcttcaagtgttacagctcagccactagtttcaaagcagcagtagttttctttaaagccttagaataattatctgagttatggaataataagatagactacagtttacctatgcccttttctttctagccgttccgaatctcgggacgagattctttgtaaggggggtagatttatcacatcctgatttttgtttcaggatttataaattatttaataaattaataatagaatttatgttaaatgatctttaatttacaagtgaagttaaatgtgggaaataaaatttccttaatataaagcatggatggatttaatttttattaaattctccatgattaagtcaactctctgaaattttctcggatttttcggagctcaattcctaaatgatacaaagaacagttcagtaattatttgattttaatgatctaattatatttgttaagagcttttcttgtttaaaatccttaaattataaattgttgtttaaaaggaattattagaaatgattttaaaagcctagaagagaagatctaattttaatctgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctcctctctctctctctccccggcccagtcggcccagctcgagccgctgctctcttctctctctcggtgccgctgacaggtggggcccacctgtcaggcctgtcttcctcctcgcgccggccgccgctcgaaccctagcgccgcgccgccgtcgtctccttccaaatccggtcgatcctttcccgatccggtgaaatcaatagaggggaaatgatcttctcgatctcctcttccttttctcttatggaatcatcgcctaattcggtttggaaactcgtggattcgaggtcgaatcggatcggtctctttccttcaaaccccgatctttccttcccgtcgccggccgccgtgggccttcgtcgtcgcctcctagcccctttaaaaggttccccgagctcttctctacccgccgccacctttgccttcgcctctcgtcgtccgtagtgccctagcgccgtgtagcttcgagccgccgtcgtcgccgccgctccagccgtgcgccgccgtcgtttcagccgtcgtcgtcgctcgggaaggtcgccgtcgtgatcgtcaagtcaccgccgtcctcgtctgcctcttcgtcgccgccggagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgtcgccggtggtgacgtcatcgccgacgtcatcgtcgcccttccccgtgagccggtcgtggaccgttcgatctcggccgtccgttttggataggttctatctcgaccgtccgttcccgtgaaccgctgccgtgcacccggttcaccgcaaaccttagccgctgacgcataatcctcttttccttttcaaaaataattcattattgcgtcataattcaattaaaatccatataagtgttttaatccgatttaatctttgaaaattcataactaattcatttcattgtaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattgggataacttatgacttaatattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatggttcattgcggatcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctttgtggcttgctgagtatgtcatatgctcattcttgcaataatcaatcaacctcagttgaagaaaaagaatccagaaggagaagacgtttggcttataccccagttgagctgcctgtgggagtggagccggagcttcggtagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagtttggaaattactagtgaatttccgggcgtgacactccctcctccgcatggcagccgggtgagggcctcggggcgaacccgcgggatagcccgagggggtgacgccatgccccgagccccccccggccgcttccacgactcgcgtgacgcgcgaatggggctaacttgcaaagtcacgtcgccggagggaaagtaaccctctacttcacatacccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttgctcaacttgcgctcatagccgttgtgcactccacctcgagtgtgccactgacagacgcactaaaggcgggagcggatacaacgggcgacgtgatgagtgggcgcaggatgcgaagagacaaatgcgggcgcgaggatcgtgggggcaagtatgggagcgcgaaacgaggaggcaagtgcggatgaagcgaggataaaagggggcggaggcagagactctgcccccttcctttcaccaaccgcccactggtcctttcgcttctcaaaccctaacattctcgccacctcatactgtctcacgctccacgctctccgccggttgccatggcccaagacaccggcgacgcagtgctcccttcctcccgcatcacagcagacaggcaccttagccttccccgcaagatcatgccggacggtgccgtcgtgcgggcgggagagtcgcggccacggccacgatatccggagcgatccatgcacctcttgtccttcgccatgacgggcttgattccgccgttctccagattcttccatgaggttctggatttctacgaaattcatgccttgcatctcgcacccaatgccgtgatgacgctggccatcttcgtgcatttgtgtgagatgttcattggggtgcgaccgacgatgcggttgttccaggccttcttcattccgtagcttctgcaaggcgcggtggtggggggatgctacttccagccccggccaggcacagcgggtcagtacatcgagagcaatctccgcaagaaatgggaggactggaataaggactggttctacaccgcgttgccggaccatccgcgacttcgagttcccgctggccctcctgaaaggtctgccgcatggctggcgacttcggagctgggcgaggaatacgacgcggtgtgggatcgccttaggggcctgcggagcctgggcctcacgggggcgatggtctttggcgattacttccgccgctgcatcgcacctcttcaggaacgatcccgtggagcgtgggaatacactggtcccaacgaccccatgcggacgcatgtgggcgagcgctgggactagggtgaggaggacgcgaagagggtgattcggcgggtgctgggcctagactccgctgagccaacactaatcccagatgggattcttcccctctgctgctaccgtgaccgggagagcattctggccgtgatgtcagccatcgtgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatctttttgcaaaagcagcattcagcaaacatttgagaatttaataaaacagttaagtattaaacaatattaacccaacgctatacaacataccctgttgcataggcccaaccattctgaacaaccatcccggctgcacagttctatctccaaaccaggaatataccattccaaaccaggagctaatcaaattattaccaattatagcatcatttactatggtgagaagtgtgagactaatcacgaaagacattgttagacccgcccataaccgtgggcacggctattcgaatagttttactctgatcagaagtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttataaacaaggcatggactccccagcgacccccgtgggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcaagtaattaattaaccagtcacgattgaccatcatgaacaatcattaagccatcattaaaataatagtgagtcataagttatcccaatagtgtgctaatgtttctaagcatggataagcaatcacatctaatatctagctgaaccaatatataaagctcaactagtcaagttataataacccaaggtatcaaggaataaagtaaccaagaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttgtattgattttaattgaattatgacgcaataatgaattatttttgaaaaggaaaaagagatttattgcgtcagcgggctagggtttcggtggaccgggcgcacggcggcggttcacacgaacggacggccgagatcgacttgatccaaaacggatggccgagattgaacggtccacgaccggctcacggggaagggcgacgatgacgtcggcgatgatgtcaccaccggcgacggcggctcggcggctcgggcgcgcatgctcgccggcgaacggctgcactacggcacgaacggagggcaccaacgggtagagggcgacgcggcgaactcaccggcgaccaaaaaggcggcggaagagcaacggacggcgacggcgacgaggttgaaacggcggcggagatcgggtcgacggtgacggcggtgctccggcggtcttcggcggcggcgaagcggcggacgaggacggcggcgacttgacgatcacgacggcgaccttcccgagcaacggcgacggctgaaacgacggcggcgcacggctggagcggcggcgacgacggcggctcgaagctacacggcgctagggcactacggacgacgagaggcgaaggcgaaggtggcgacgggtagaggagagctcggggaaccttttaaaggggctaggaggcgacggcgaaggcccacggcggctggcgacgggaaggaaagatcggggtttgaaggaaagagaccgatccgaatcgaacttgattccacgaacttccaaaacgaattagccgacgtttccaaaggggaaaaggtagaggagatcccaaagattgtttcccctcaatcaatttcaccggaaacggaaaggagcggccggattttggaaggaaacggcggcggcgcgaaactagggtttcgggcggcggcggccggaggttgacgacgaccctgacaggtgggccccacctgtcagcgggcggacgcgcgcgcgcggcggcggactgggccggactgggccgaggagagagagaagggttttgggccgactttcggcccaaagccaaaagaagactttttaaaacctttttcaatttaaattatttatgaaatgcaattccatttattaaaaatactttcttagctcaaataaatcccagaaaaatctaggaattatagaattaagcaaagtatttaatgaaattttatctggccccattttatattggaatttattaattaaaattagatcgtctcttctaggcttttaaaataaattctaaaaattccaattaaacaacaatttatatattttgaatttttagggtgtgacacatcggcgccggtaggagccggtccagtcgatgcggcgccagcggtagcgccgtcggcacgggtggcggtggtgcgaccgcgggcgggagccgggccggcggtccaggcggcggtggctcaagggcgcctggatcgagccgcggacctggagatgattccgccggtgacccaaaggggaaacggaaggtggcctattcccggccgccctctcccccacatggaggaggtgccgagcgtgcaacggatcgttcgccaatgggccacaagcgacctgccgggcccgaggctggtcggaaaaagaagcggctccggaagatagcacaaacggagccatgccggggggggggggggtttcatcgagcccccaaagtggaccttcaaccgccctccccgtaggtacgattattggcgctcactttggtgctcttacccaacccattttcttgttccttctttttcttttgttaacatgatctaggttctcttgtagcgagattccttctcagggaatctcagggtcagaccccccgcaagggacgaaatctgaacggttggggcagtccgagcccggccaaaccaaggccggggttttcgcagcctcgtggcgggacccagaggacacgcactgggcccgatcccgagcgaccctcaggcgggacccgtcctactgtgggtggcaggggtggcgacgctcctcccgggggcggctccgggaccagggtccacgcggagcaccaccaaggatcgggggatgagggaggtcgcggcctgggagccgaagccggaggtggtcccgagcttgaggttgaggctgggggcggtcccgaggctgaggccgaggctgaggccgggggcggtcccgagcccgagcccgaggccgaggctgaatccacccgaggacccgaagcggggggtgagagggacagccgttcccccttgcgcttggggcgccctcgaggctggtctcgcagaaggggggccgagagcagcccccagtctcgcgggggatccagcagtaccccgtcgtcccgggggcggaccgcggccttttcctccccaactccggcgagtatggagccacttctgcaggtgctcgccgccgccgactacactgtacgagaggggttgaacacccaagttcaagccctagcggaagagcgggcggccctggatgcagagtgggaacagctcgccgcggaccgcgcgcgagtcgacgaggggcgtcgcgccgtggacgacatggtaagggtgggggcgcaaaatgcatcaaacccaactagccaaaatccaggcgcgcgaggaggcactggactccgtcatgcgggaggcggaggaggagcggcaggcggcgctgatcgcctcgagcgtcctggatgaagcgcggggcgatatccgccttcagtacgaggctcacgccgaggacttggcgaagaggattagggacgcgcgcggcatcctcgacgcagccgctgcccacgagcggcgggcatcggaggccgacgcctcgctgcgggcgcggacgatggcactcgaggctgaacgcagggccttggatgatcgtgcccgctctgcacaggagtttgaagccacaatccgtcggcggatcgaggtcctcgatcgaaaccagcgtgagcaaaacgcgtgcggtgaagaacaggcacggcgggcccgggagctggaggagtgagcacgcctgctagatcagctggagtctaccttggccgcccatgaaagaacggcggcagaggtggaggcttcccttcgcctccgtgaagaagccgcggccgagcgtgaccggatcaccctcgccgcgaaagcttccgcggaccgccgcgcggaagagctacggctgcgggaagaggcatgccgggaacgggatgccgcactcgccgagcgcgaagccgaggtgaatcgccgcgaggtagccttgcgccggctaggcgagcaactcgcgaaacgagaggaggccgttgccgggcgcgaggctcgtcatctggagagcgcccgcgctgagcgtgcggcaatatcagcgaaggtctccgagctggaggcccgggagaaggacttggtagcaggcgggccgcccggcggcgcgggtttggcgagccagctcgccatggctcagagtaccctcgccgacttggaacgcctggtgcaggatcaggctggggaaattgcggccctccgcctcaccaacgagctcgggcccgggcaactctccgacaccgtcgactggctggagcacgcggggcgccgagtcggcatctctgtgcgtcgggacagcaaactcccgcccacacagccagcactcgcgcttcggctggacgggctggcggtggacctggaaaggctggaggaggaggtcggcgagaccataaagtcttcgtcagtttctttggcacgggctgcggtggagctggtcctcgcgagccaccaagcgcgcgaccccgaattcatgccgtggcatgcgctcgaggattttcccccgggtaccgaggcaagggcccgggagcaagtccgggaggcggctaacgcgattgtctcaagcttcgaggggtcggccccccggttcacctccgggcttaccgcggacgaggaaaacggaagcgggggtgacgacggcgatgacgactaggacgacatcgtcagtggcgctggcctcggggggccgggcactccgtgaccactcgcgcctttaattcctttttgctgtgtgcccgtagcaggcacttcttgtatttaggccattgtgccatcctatcttgttctgcaactgaaacttctttaacccctcttactcttttgctttttccattggatgcctgtgatataaagagaagaaaaaaccaggacaaaaggggattattagactgcctgcgattgatatgtcgttttgaccccccctctcgggcttgttctagcgagaagataaatccgcgctcggtccatggaatctaagtggtgaaaggcaagaccatcgccccgagggagccgcccagcaggactggccagaccgaggctgcgacgaccgggggtcggggacgaccgtgtgtaggcccttccgatcccccggggttcggcacaacccggggcgcggcccgcgctcgtgctccctttcggcggttttcaggccgtcttacggcacttagggtttagagtaaacgcggattatcccttgaaccgggacaagccagagaaaggggagaaaacggtctccacgaaaaccaaggggttgtgcgggggctggcccgtgctccaggaaagcaaaaaatctcgatgtcatggatagaaacgacaaaggtgctcgatattccaggggttgggcagctctgtgccgtcctccatggttaaccgaacggagcctagccagggcacttcgatcactttgtatggcccttcccacattggcgagagcttcctcagccccaggcgcgactgaacgcggcgtaggacgaggtcgctagcttgtagtgatcgggcccggacgtggcgctgatggtagcgtcgcaggctttgttgatagcgcgcggcacgcaaggccgctcgccttctccgttcttcaagataatcgagatcttcgcggcgaagggcatcttggttggcctcgttgtacaacgcgacacgaggcgacccgagggaaagctcgaagggtaggaccgcttcggcgccgtacaccaagaaaaatggtgtttcccctgtggcgcggcttggagtggtccgatttgcccacaacacggcgggcaactcctcgagccatgaatccccgtgcttcttcaggacgttgtacgtcttggtcttgagtcctttaaggatttcggcgttggctcgctcgacttggctgttgctcttggggtgggcgggtgaggcaaagcacaatttgatacccatgtcgtcacagtaatcgccaaacagctcactggggaactgggtgccgttgtctgtaatgatacggttgggcactccgaatcgagacgtgatgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgatctgtaaggcttgggccggctggtgggtccacttggcgtggaaccggcatgccttgcaccgctggacccattcttgggcatcttgtaatgcagtcggccaataaaaaccttgccggaaggcttttccgaccaaagttcgtaaggtcgaatgggctcggaactcaccctgatgggcgtcggctatgagctcgatgccctgctctcgagaaatacacttcaagagtatctcgttggcggtacgccggtatagggtcccttctacaaggacgtaccgtttggagatgcgcgcgagcttttcagcttctgcgcgatcctcaggatgagtattgccttcgagatatgcccggatgtcggtcatccacacgacctgacgaggggggtcagggttgaccccctcgggccccgaggggcacaggtcgcccggagtcgggtcggagggcgtgtcattggggtccctcaaagggctcggtcgtgccgatggttgcgcgagcctttcctcgaaggtccctgggggagtggggctcgtgccgacgcaacatgcgacaactcgtcagcaattgtgttgtcgcgtcggggcacgtgctggagcttaagtccgtcgaagtggcgttccatgcgccgtacctcgcggacgtacgcttccatttgcgggtcgttgcactgatactctttggatacttgatttacgatcagctgggagtcacccaagaccaggagacggtggatgcccattccggctgccgccctcaatcccgcgaggagcccttcatattctgccatgttgttcgtggctcggaagtcgagacgaacgacgtatttgaggacatccccgtttggcgaggtcagcgtgactccggcacttgcaccttgaaggttgagggagccgtcaaaatgcataacccagtgcccgtcgcgaatgtcggcgtttggatcctcttcttctccagggaggggaaaggggacattagacgaaacaggttcgtccaccggggttcattccgcgatgaagtcagccaggatttgacttttgatcgcgtgccgcggttcgaagtgcagattgaactcagccagctcgatggcccattttaccactcgtccagtaccctctcggttgtgcaaaatttggccaagagggtatgtcgtcactacggaaacccgatgcgcttggaagtaatgacgcaacttccttgaggccattaagacgtcataaagcattttctgggcctgcggataccgggttttcgcatctcgaagtgcctcgctaacaaagtagacgggccgctgcacctttcgacggggccagttcgtgttgtcaggggctgatgactcggagcgcgcctgttcggaggtcccggggggatcccagactgcctcgggatcataaggctcggggccacctgccaaagcctccgctcctcccttgggggcctcggggtcctcccgggggctggaagctttgggcgctaggccttcgggggacgaggggccatcgcaagccgaaggggcctcccgttcgccttcctcacgctcaactactagggcggcactcaccacatggggggtcgcggccaagtagagtagcaatggttcctccggtcccggggccaccaagacgggagggaagttaggtaagctttcagctgattgagagcttgctcagcttcctccgtccatacaaatggcccggagcgcttgaggagcttgaataggggcagcgccctctcacccagcctcgatataaatcgactcagggcggccatgcatccagtgacgcactgcacatccctaagcttgctaggggggcgcatcctctctatcgcgcatattttctcaggatttgcttctatgcctcgggaagagactagaaaaccgagaagtttgcccgccggcacgccgaacacacacttatcggggttcagctttacgcgcgtggacctaagactatcgaaagtttcggccaggtcctgtagcaacgtgtcttggtggtgcgtctttaccaccagatcatcgacatacgcctctacattgtgccctatctgattacttaaggtaatacgagtcatgcgctgaaaagtagggcctgcattcttcaatccaaaaggcatagttgtataacaaaaggtgcccacaggagtaataaaggcggttttttcctcatctttcctagccatacgaatttgatggtatccagagtatgcatctagaaaacacaaaaggtcgcaccccgcagtggagtcgactatttgatctatgtgtggtagagggaagggatctttggggcatgccttgttgaggtcggtgtagtcgatgcacatccgtagcttgccattggccttcgggacgaccaccgggtttgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctgaggaccccgggcatatctgacggcttccatgcgaaaacgtcagaattcgccagcaggaaggagacgagcgcgccttcttatttggcgtccaaggttctgccaatcttggcggtcttagatggatcgtcgccaagggggatttccttgacgggcacctcgtcagccgaggggaggcgcttcttggaagcgtgggacgcagaggcttctggggcctgcggctccgtggccaccgccaggttgtctgcgcgctgctccgcgcaggcgagggcgaccttgacatcaccaaggacggtgatgggaccagcaggacccggcatcttcatctagaggtaggcgtagtgggtggcgaccatgaacttcaccaacgcgggtctacccaaaaccgcattgtagggcagattgaggtccgccacatcgactggcccccccatccaccagcacatgcttcatcttgacgttgtggatggtcggggagaccaccagggccaactttccccccccccccccgagcgagcaccgtcggatggtcgctctggtcgaatgtgagcttcacctccgaccagcgcaccttccggaccacctcatgcgtgggaacaatggccagaagctcccacttcatagccttgaagcttcggcgagaggtgtgagcgcaagccccccccccccggtcgagcgtggcgacggtcccctgaggtatctggaaatccagatcctcaccgtctccgccatcatcggcgggggccttgtccttggcctcccctcgctggtcaccggttgaggtcgcgggggctttgccctcccgtcgaccctgccgcttttcctcatcagcctttcggaaccgctcggctaaattcttgaccgagcggcagtcggcgagactgtggcggtaagtgttgtgtaccgagcaccacttgtccgccgaccggccctcgccggagggaatggtagggctcggcctatcgacggtggcattttctttgcgcggggcccgcgtgggcccgtctgctgcaaggacatggccctcgtcatcggagcgggctggtttccttttgcctctcctatctcactgcttagagcgggaggcagattcgggggtagccgcagccgccgcaccggtgctgggagagttccaggcccatgcctccttcttctgggccaccttgtccgccagctcgaagagctcggcagtggtcttgagctccttggaggcgatcttctccagcatgcgattatgccgcacgctgttccggaatgcatacacaaccgcgtgggctgggatgcacggaatggtgttgcggacctgacagaagtgttgtatgtacgaacggagggactcatcatccttccgccgtacagcatgtaggtccacctcttcccccgggcggggatatgtgccctggaagttcgtaatgaactgctggcacagatcctcccaggagtgaatggagccggggggctgggtcatcaaccagccacgcgcctgacccttgagggccatgggaaagtaattcgccatgacccggtcgtcactccctgccgccacgataaccgtggtgtagatctggaggaactcggagggattgatgctaccatcatacttctccgtaaggttggggcgaaacttcgggggccaccggacattccggagactcgccacaaaggccctacaacccgtccccccaggggtgagtgtggggggagggccgcctcgtgaagaggagcgtggcgctccagatgaggaggcgccttcccccatacgggtagctcggcgctcgtctcggcgtcgctcgatgttgattcgagcgtcctgcgtcccgtagaggccgtcatggcacctccggctttccgaggcccctgacgatgttggaaccgtggaccgcctcgagatcgtggccgatcgacgagcccttctccttgccgacgaggagagggtgaccgaggtacgcgacgtaccagcggcagcggatcggccactcgtggctaactgccactgggtagtagtgaccaagttggccacgtcgtccaaccagcgctgaacaggagtctccagctccgggtttaccgggggatgccgcagaagggcgcctgctacctgaagcgtgccttggggcaaaccgccgtctccatagtcgagacggcagcgtgccccggcgcgtcgcggcctccctccgccagggggcggagagagagccgaatcacctgaacgagtgggatcctccctccgcgaaggttcgcggcggggaggagttggagaaccatggcgacggtgacgaggacctcggctctcgccggaatccccactcccggacagggtgggagtaaatgccaccgcctcctcctctactttcaggacctcgaccatggtcggctaaggcctggagaaaattgggacgaaagaaagcgacttcctctcggaatgcgcaaccgcccctacttggcgcgccagctgtcgaggagagatcctcaatagcggggaatcgtgagaccccccatttgtgagttcggccgggggcggaggctcatctcttggaaatcactcgctcgtccctaggattaccggcaagcttgcacgcagtcggattatacaggttcgggccgctatggagcgtaacaccctactcctgtatttgggattatggatgagttttacaaagatttcttcactctagaaagcgcactcgcttcctctcttctggagttcaggttttctgggcgtcctcctctatctcagtgggcagggtcctccttttatagctcaaggggataccacatgcgccgcctctacctaccctctatcggagggggatcccactccacttttcctgggctttaaaccgtgccttctcccggaagctaagcaacaaccggttctcgagtggaaccaggcgctgccccccgcctgacacgggggacagccctatcattccctcataaatgaacgatgacctgtgacagcccttcctcgag

SEQ ID NO: 8143 - DNA, 1166 bp, Oryza sativa
gaatggggctaacttgcaaagtcacgtggccagagggaaagtaattcccctctacttcacatacccccgggtccatatctccgacacatatcatcagaaatcttgaggggatgtcccttgatgcacccatttctctccactatagtactagtttaataataatctagagtataatgataccatcactccacgaaatgaagtttaaaagccatattgtgagtacctgcacgttggaattttctcaactagatgtggagatgaacacgagggaacacggcgtgtaccgcgatttcattatgttattattatgagattgcatctagtaacaagaaaatgtatgtgttagacaataattatgaaactgacggactaaccatccataccgacaacatagtgtgtgccaccgctccttttcgatacgtacaatgccctactatacgttttaattttattcctcattagcatttacagagtacgttaccatgatcgatctaacaaaaactctacttaaggcgccgaagaattaactaattaaaaagtgattttacagttcttgatacgatactgaaagataccgtgttttttatgtaaaatttaatacctcgcgatatcttcaataataataataatagaagattaataccttcaataacagtagaagatatcaaatttacattaaaaatttttggtgtatctccgaaggattgtaaaatttctcgtgattaaatgatagtgtagcatctgaccacgatcgaatcatgccagtttcagagcaaggcggcgacggtgacgagcttctcgaactggcgcgcccggccgcttctgcgacgtcggggaggcgaacggcgtgggctggactttccgttagtgggcctcattcaggcccactgttatcaccgccgatccacatttccgtcaataaaccgacagttgactcagatgttagttcaaagcattggccagagtgagtatatttggatctgtaataacaatatttactttacttgcagtttattcacgtgagctaaaccaacaaaaagagagagggaaaaaaacgaagacgggatacagctggggaagaaattagggtactcaactctgaaaaatcaaaacgaaggctagctactatgatcgcaaccagagaacgtacgtactgaagagggtta

SEQ ID NO: 8144 - DNA, 11604 bp, Oryza sativa
gttgagctccctgcagctgtacgttcacatggtgacgtcgttgatggcgcgaagcacgagcgtcttggcgacctcgtcgtcgccggccttgagcgcggcggcggcgccgtggatctccttcatggcgctcgacaccgtcacgctgcagttgtcgaggcaggccttgaagtccggcacggacttgttgaacccggggagcttcccctcgaacaccgtcgccgccaccgcgccggactccgtggcggcctccatggcgacggcgaccagggacctgaagtccacctgccccggcgcgccggcgatggcggcgccgtggttcgacaccgacgtcagcaccgtctggatgtccagcaggcggtggcccaggtccttgacgcacagcttggagaacggccccgccgtgcacgccgccaccagcgggctagaccccggcgggaggcgcgcctgggcggccattgctgaggcgcacatcaggaccacgacgaacatcgccatggacaacaacgacgacgccatttaatttccttgtcgatcactctgctaatgaagcttttttaggtgttattcaagatctgaattacagtaaaattcgatcaacgccataatatatattagctgaagagacagatctgttggtttgatcagtgagtggttcttctttgtgctctcagctcgtcgccgtagtcgctgaggctgggaggggttttctctggatggtgcgtgcatgcgcgccatgagtggtcgcgcgggagtgaactagcagaggaagcgggccagcttgtgcgagtttgccgcgctcttccctctcgccgtctcgcgtcgcgtacccgcgcccccgtacgtcaccgctgtcacggtgtcacattgacttttctagttgtgtggagtatgtttctgcagcgcttgtactctgtcagctgattgttgcgagaagaggtcggctaagccgtgtctcgtagactttgatcacatcccttttatatacagtgcaaagtagctcaaataatttcgcatgtaagtcccttttattttctattttactctttatattttgttgatttaggggaaaacttcaatattttacaatgaacacctcaaaaatcatgaacatttataaaatcacattccctcctctccaccggcaacttcctctactgaagcccctctctgccagcgccgctctccccccaccccttctgccgatgacactccccccaaaacactgatgatgctagcttccatccccatccgccttgtatggggccatgccatctcctaacgtgctgctcgagctgtgcctcggtccgccctgataaatcctaacgatgaacacatgttttaattgggctcagcagtattcactaaatatgggaaaggcggatgtggcatgaaatctctgatgtgtaaagctggggctaaacaacaactaggcacactgtgaaagccctaagggtactcacagtgcaagccacaggtatgaggagcctggactaggtcacaagttagaaatctctatctcacagtgaaaagtggctctaggatgacttaatttatcatgtgctcccttgtaattttttactttaatactcatatactttttaaaatttagagagtagtctagcaatttgcatagaacaccctaaaaatcagagaaaaaaaaatctactccctaacctcttccccgccacccacccgtcactttcatgttcccctcgcttcaccggctttaccactcacatcgtcggtgatgagctcctcagtggcgccatttctcccctctctcttcccggtgccacctctatccggacggccgtcgagtatattgaaacagcaaaaaggccgaaggcaactccgacggcgcgtcaaggaagccacgaatgggtcaaggcggccgccaatgccgtctcgtcgagctccgccttccgtcctctctttcttctccggtaggtggcggcagaggtgacggcatgaatctggcgaccctcaacggcgtggagtgagacaacacggatgtggcggtgggccttgatagcagaggactccaaggcaagttaatggctgacggctccgtggagtggccctctacagcggaggaccccgaggtgggccttggcggtggacctcgacggcagaggactccaatgcaggctgacggctccgtggtgcggtggagtggccttggcgggggctgcagatctggccgtagcgatgaggttccgcaacggctcgccgtcggccagtctgccgccaccaggttcttcctttctccagtcctcatctcctccccagctcgctggcgatttatggcgatcacggaagccacttaaggcgaggctacagttgtaatctccacaatgcgggtcgcgcccatctatcctcatgccgcacgccctcgatcggatcaaagaacctttggctcattttggctacgcatagtttgtttggtcactataggagcgaacgtggagtctaatctactacgtggaaggtcgaggggcgaacgacatgtcgacgcactatgaacgccctaacattgcagcacattgatatctgatattttgtctatcgggcttaggttgatggacagtagcagcagttgatcatatattgcacttgtttattgagttgcgcgtttactcgtgtaacgagattagaagtatggttaactttgtgtttatcacgcgttctcattggatgttatgcatagtatatctaccgttgacaactagagaccttttacagggtctgtattccaaaaaaagtagaaatccaacgctccataatgaaaggtaccctgtaaaaggtatttgagtattggcataggcacttaggtaccaagggtaaaaagataaatttgctagtagagaggaaaggaaagagttgtccgtaaattcagatcggtaccgcgtcggtaccagttaagttgcatggtactagcattaaagttctcatttacgtggttttctctagatttacatttttgtttccaaggacatggtagaactcttcccattaattctccattacgttatttgcatagttattttgatatttatattttgttcccaagaacattaaaatatcactcaaggtttacgttttaagttttacattttatttgtggaaaaaagaaaattgtagataaaatattcctaatgattgcgtccatctgaacatgctatgttaggttaaccaacaatatcagagcttctctcttgaccctatcttcttacaggttcacctattcaaaccctagaagaagaacatatgagaatatctcattttagtcccttatatgaaggaatttgttaactatgtaaataacgaatcaatcgtgcaaataagtataggagcagaggagatctttcccgatgcgcttgcacctagccgtcgatcggcccatcttgaaccctcaactgtgccgatatttctctggaccaattcaaaccctagaacaagaacgaagccggggtcaaagaaatgaggcgttgatctttttttttcccggtgcagaactgcagatcgatcgatgcattaaattgttcgaaagatttactttgttttctacctaacaattctggtgattgcacccaggtattcgattcactcaaaatgctccaggtattcgattcactcaaaatgctcattttttagtagttaattactccattgctactagttatgaaaattttattccatacttgcccctcttttaatcaatggttcacattgttctacctctcaataccttcaagtacctcgcaaacaccgtaaaaggtctctgacaactattataccagttgtgccgctgaaacccgacttgaaacccggctgtgtgtgttgtcaggcagcaagaaagataagacattacttacaaatcaccgacggcatgtgcgtacaatagacacattcaaacatatatactgcatctatttgatgcaatgcaaagatttatgaatgaattgagagggaaagttagaattgtctaataaccgtcatccagtttatttttatgtcttccaactagctcttggtatgcaatgttaccatacatctgagaagtagtaagatattatgcgcggtgatactactatgctcttaaaatcggtttctaaggttattaaaaagttattaaaaatttgaaggtatattgcttcagttccatgcctccttttgaatgaatgaatatttcaggagaattttgagaggaaattaacgtttcttgtaaaattcttgttttcaatatgagaatttctagcatcatctttttttcgtcgggacaatacatgaaagaaggcggtccgaatttcactagagtttaaaggagtttactacataaaagctcgttaaaccagttttgctgatgaaagtcgtattctcggcgcttacaagttacaacgctaaaaactacactttactacaatcgtgttgctagattagactagcatcctgccaaattaaccacttgtgtctgtgatccacaggccaacaggcggagtttcacagatgcacagaaaatacgaaaaggtggtccggtccgtcgtgagacagtcagagtttaaaaaaaccgtacggttattttgattatcatgtatagtaacctagctttaattttttttcctgcaacttaacaaaagagtagaaattccggtctgtggcatggaatgaccgttcaacggcgcatgattaaagggttggcgtgtcagcgcatttcagcacacactgtcgaatttctggagtattccttcttattggaaatatatgggccggccggcaatatatattttgtaagaaaaacatcaaaacaatcaactgtacacaccctcgcgcgatctcctttacggttctactaccacatataagcatgcgtgtacacacataatatgcaccatgcatgcatataatcacatgagtaattttatagttcttgagaaggtatcatgaggtatcatttttttctatcgtagatttgatatctcttggtatctaaatactaggaggtaccaaaaatttaatgtaaaatttggtaccttatgataccttctcaaggaccgtagaattgttctaatcacataaaaactgctcagtacatagttcttcacaaggccggccgaatacgagaggtgatcgatcgacgattcgaagctagctagcgtcccatgtgttgcacggcgggcgcggcggcggcggcggcgcggcgctccatgttgaggtgccacccaagcttggggtcgtagccgcgcgcggcgagctccctgtactcctggatgagcgcgcatggctcgcaccagcagtggatgcagcagtcgccgcagggctcgccggagaggccgtactgggcgcgcatcttgccgcggtaggtgcaggtacatccactggaacccggtgatcacggccagaaacacgtagagcgcgccgctgtggccgcacgacgtcgaccccctgtccacgatctccgccaccctcccgaacgtgatgcacggacaccaccatgtcatgcaacctgcagatcaaaatacatgtttgtttaggattaattgattaattctctgtaatccatacactacttgagaactgatctttactgcttggtcgaccgaaaaccacaatagtcccaacactgaaaatgttttttttcccggtttataactccaacagaaataaatgatctttagttctaaatatcatatttagttctgattcaccttctaacagggcctttcaggggctgggatctttcgtcccggcctatgcatgcttgccatggtatggtgtggccggaggcgcgcgccgcggcggcgagaacgtacgtacataggccgtagtcgtcgaagcagtcgcagaggccagacgaccagggagcggagccgacggggacgccgggcgctggcccggccgttggcttgtctggctgcatctcctccttaattcggttgcccctgctagctgcaagttcttgtgatcgacttgttgtttgcgctgggaaactgagcacaagctagctagcgggcgggacgatgctcatatatagcacgcgacaagttgcattggccccggtgtgatctggacatatctggttcggttaaaccaattagtcattgaggagaagacgaaggaaattccatgggacggggcctaaacctcgtcctctgtagtcgtccctgttacgattttgacatgcagaggacgacgtttaggcatatcgccttttagacgatatgatatgacatgatatatgcatcaagattacattgattagtcaccatcctgtccgttgcacggattattattgactaggcaaatggtggcagctgtttcattggcatccgggagaagtagtgtgtttgtcgataacggcagatccagtgcaattaaagagtatttagatgcatatccagttcaattcaagagtatttagatgcatatcgaatacagtatgtcatacgtatgtttataaaataaaaataaataaaaataaaaactgaacatgtttccgatgctttaatatgtcgtccgtatttgagtttgtttttaagttcgttcatttttaaaagtacataagaagtcgtataagaaacccttttaaaaatctcgcatgctaatttagaactaaagtcggacttctaattgctttacaattctcaccagaccgtaagaaagcaacgtgcaagatatgatcatcatcccaatgaggtttctggattagatatcaatactatcaaaataaaaatcccatatatactttttagaaaaaaaattaacaacaatacgattaaaatagtcttcacccgttgtaacgcacatgcatttttttcttaaaaaaaaaggaaaagagaacgtattcgacctaagaagcaaatgactttccgttttcggccatttgctatttttgatatatcctttttcggcccaaccacacacgatcaatccggcccattaccaaatttggccacacgttttcagactttcttttttttgtaattttcctgtggtctttattactccctccgtttcatactataagtcgtttgactttttttttctaagtttatagaaaaatatagtactagtatttttaacaaaaaaatatattataaaaatatattcaatgctagatttaatgaaactaaattgatattttagatgttcctaaatttttctatagatttgatcaaacttaacaaattttaattaggaaaaaagttaaatgacttataactagcatggtggcccacgcagattgcgcggctagcatcattatattttctcttatataatagcatatatgttttctcattatattattcaaatatattaaaatgacattataattttaaattttgcaataactatacgaaactacaaatgtgtaatattcatattgtattttatatacgtgttagttattaattatttttaatatcaaattttagttatttgtaaattatatatattcctatatgtactctagactcgtcttttaatatatttttttaattccgaattttttgtaaattgtatttctatatagactctaggctcttctttcaatattatttattttttatttttgattttttattatttctaattatatttatatgtggactctaaactcatctctcaatattctttaattttgaatttcagttacttctaaattatattcctatattgactttaaactcttcttcccatgtttttcttaattttgaattttagttatttgtaaattgtatttttatacagactcaaaactctacttttaattttattatgtttattctgaattttagttaattttaaattcctatatggactctatactctacttctaatattccttattttttaactctgaatttcttttttttcttaattgtatttctatatggactctatgctctacttctaatatttcttatttttaattccgaatttctattatttcctattcgtatttctatatggactctatactctacttctaatattccttatttttaattccgaattttagttattttctaattgtatttctatatggactctagtctcctcttctaatattccttatttttagtttcaaatttcaactatttctaaattgtatttctatatggactctagtctcctcttctaatattccttattttttaattccgaatttcagctatttctaaattgtatttctatatggactctaccttttctttttctccgattaatgtgagagtttctaggccatgagagcgaacgtggaggctccttttctattcctttaataatataataatagatatgtaacagagggagtatttaacaggccggcctaattcatccattcagaccgaattgggctttttctcttttacacacatgcatataaagtttgtacttagtccctcatattcagccatgtgtataaaatttgtatacgtatgcatatacttagaattcatacatataaactttgtattgtacccaatacaaagtatatacatgtgtatatacgaatagagcggagactagaagcccaatttggcgaccgcggcgagggctcaggaaggcgacggcgaggacgggagctcatcaggaggcaggagctcaggaagtcgatggggccggcatattttaagttcacttacttcaaaacagtcattcaaaaccaagtttattaaacatatgtggccggccggcagctaatttgaagcaaatacaacagatatataagaaatgggctgaagaacagactcgacgaggcactcatcttaagtagaccacccgtactattagcgtcgcatcggcgggttgtgcttgggcgggacgtgctggttgtttccgagccagccaagcgagggtttgtagccgaggctcttgaggtgcctgtactcctggcacagcgcgcactgcaggcagagggcgtggacgcagcagtcgcagcatgggtcctcggggaggtggaagctgtcgcgcatcttgccgcggtagcagcaggagtagaggcagtggcagtgggcgaagaagccgagcagcacgcacatcacgcccgccgcgcagcacgtcctctcccccctcgacacgatctccgcgctccgcccgaacgtgatgcacgggcacaccgtcgtcaagcaacctgcatatatataattagtttgtgtcacataaagacgtgaatattaaggaatgatctaatatggtaccaaatgttatatggtaaaattactcaatcaatatatatattccgggaaataagcttaaattagcttagaattaatagatggtctatacaataaatgcaatatatataatctggtgaaggacgatcgatagaatcatcgcaagtagtatagtactgatcgacaatatggaagtaatatatacgcacaaacttcgcagtcattgaagcaggcgaagagtccggatgaccagtcattgtgttgcggcctcgccatctcctccgatcctctccttcgctagtgcgaccactgaccagctgctgctgttgtgatcggcaggcttgctagctaggagcgatgagcatgagcttagctaggagcgtggctcttatatagcagtagcacgatcggtatgcatgcatgtttactgaaactttaaaacgatgatttttaattatatatattagcccgatctaactagcgtttggttgacccaattaacttagttgactccaccagaaccgaccggcaacactagtcaatgaggcagtgaatacctcggacatgacctagatcaggtctcacgagtcatacaatgtcgctggcagtggcagtagtacttcctcctccgttaaaaaaacaaaaaaaactaacataataataatataataataatataggatgggacatatcctaatacaacaaatcaatgtctatattcgtgtttgggttttttttttatggatgtagtaagtagtaccaactattatatattcatgccttagaaaccatgtttattttgattatcatcttaattagcgtgtggcataccaactatgtgcttgacagttgggagcttgggggatttcacaataactatgtacgttcacttctttttcgcgtatattgaagttccggtcagttaattagccaaccggccgccggaatttcgactccttcccaatggctatttcctgaccaatcttttcatactctatttttttattaaatggtgtctcctaatatttttttaatctcaaatgattaagaatttctttcaacgaggaaaatgtcaatcgatcaagatcaatatatcagttgcaagttgtcaggaaaatgagtaaaagagacaggttctgttcggcttgtttacacttacctacttcttggatcggtactacaacattagaacattataactagctagttactaacttaattagtaccagagttaggttaagatagtaccattagtaacatatttgtgcattgattgctggcaacagctaagctaggcacaaatgtactaggattctaggaactcatgacatttctgtgctgtcgttgcctgaaaaatgatccgttgatttggtcttagaaacctaccccacgagatcgatcttgagctcgaaaacatgagcccaatcagctcattacatatgtgctactgctactgaaagggctttgttgagaaaactgtgtgcttgaaacagccaaacataggcaggatcacgcctgatctgataggccattataagggcatactcagactgatgacgttttcaaccataatatcattatttgttaaaattgataattatgtggctacatttagtttgttattaaatattggcaatgtatatggaattttggcaacattttaaagccaatcctatcaaaattttgacaatgttatcaatttgttaaaattttggtatattgccaagttttggtaatatttattttggcactaatctgaacaaactctaacttgtaagtactgtacaaacaagacttccgagggtctgtactgcaggtcaaaattcatgcaagagaatacttgccatgcgaaagcctttcgttatatattggtatagtagcttcactgcttatgactcactcgattagttaagcacaataattaattgttgagaagaaatggagcaagggagaggaaattctatttgggacttgggcatattgttttggaactgaatattactacgagtagtaatgagagttttaggccccgttcgcttcaggtggcgtgcaaaatgtgatacataattagcagtaattaattatgtattaaacttcgatataatatttttttaaaaaaaagtacaagggagcaaaatgttgctcactacaagtagctcatccaatgagataaccggacaggactccagtgtatccggatattgggccgagagcccagatagcccatctggcgacatgccctccttgggccggatggtccatcaggagagcagctaaagataaaatatgggccgcatgctcatcgctaagcgaaccagaagggcccacccaattttgtcgtgcggtaagggtgaggaatttttttatttttaattttttttattaaaagttttacaaaaataattttccattttaaaaattgacg

SEQ ID NO: 8145 - DNA, 45246 bp, Oryza sativa
  unsure (1)..(45246): unsure at all n locations
gttgatctgtcagattttgtaatgacatctaagggcatcgataggcctgtggagagaacatttcagtcaatttatagttggttgttgagaggatttagaatagaccaagaagtctacacaatgtcagtatcagttgtagtgagtcgtgcaacagaaggttatttttgggaactaatgccgatggacaacactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttaaaccaaaatcaattattaggcacatcgagaacaaattcaagtacaccataagctatgcaaaggcctagagagccaaacaaaagattattgagatgatgtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacataattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaagactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaatcatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgggaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcagagggcggcaagggggccgcctgcaaatttcgttgacggccgtcgcccgagagcgaacggccgtctgccacgtcactttcaccgccctctgggatggcgatttttaaaaatcgccctcccagagggcggtaggcgaccacttctgtcaattttcaaaataaaaaattatttttgtaaaacttttaataaaaaaaattaaaaataaaaaaaattctaagggtgagtgggtgcagacgtgcagtatggggtatggctggtgtttacagccgtcagatcaaaacgaaaccgactcaaaatctgtgtactgttaaacgaaaaccgactcaaaagctgtgtactgttaaagaatgtctacgatacacagtactacgatttttttttgaacggacagtactacgatttgattatgttttactaagatttgagtatatagcttcataattttaatccaaaattaacattgggctggccgtcggctaattaataatttgttgggggcatatacatcggacaaattaacatgaccatcatcatacacacattaatttgcaggtttacaagattagcaatgcgaggttaattagggatcattagcaactcaggtcgtaatttggcagtcgtgcagaacgagtatatattacaaacgattgttgataagtcgtcgtcgttgatagtatcagtagttggcatcgcactgcttgtataatgtgtgtatacgcgcactaaatcttacctaacgagattaattcagttgggcatttgtctatttgcctgtgtcatctaccaaacattctacattgtcagaagatatatgaagtattccctccgaattttcagcaatacatatgcagcttcataaattatagaactcgtgatggatgcgaaatgaacctaatgaattaacaataatgcatataattttcaccctataaaacggggttatatatgtagtaaaatatagggagaatagccaacatcatccttaaagttttgctcggggatcaatttggtccctaactttttatattgtccaaacgagtccttataatttgtcaagtgggctaatatagtccttgggccaacttaaatcgccacgttagcataccatgttatgctctcatgcataatatgtggtgaaatgtccaatttgcccttctatataccatagaaaaacaatgaaatgagtttacaaactttgttcaatgtgactatggatatatggcaaacttttttcactggattatgctaatacaaaattaaatagctttaaccactaaatatataatacccatgccaaataaatttcatgtaagtagttgcattttaatgttaaactctaacggatatttaatatgcaagatcacctacttatatttggatttttctcgttttctttctcttttttccctatgaccatatgtgcaagggcaaattgggtatttcatcatatatttgcattggaagatgacatggcatgttcacgtgacaattttcgatgggccaatgactatatatgtccacatgataaagtttaatggcttgcttggacaatttgaaaggtcagggactaaaacgatctcggagcgaaacttcagggatcatagtggctattctcccaaaaatatatataaacttcagggccaacagttccaattattgaagtatatacggagtatgaactagctccgtgttgaccatcaccattgtaagtttgtaacatgtgtgccaacgaaacacaacatgatatccggcttgaactgcgtgttatcagtcaataaggaggatatacaaacacagcatgtggctagagtacacacattcaaccgtaatacgtgttcatattgtcatatgctatacatattgcgtctgtttgttgcaaaggggttaggaattgaaatggaaagttagaaggcagaattagtattttagcaaaccctgtgcttgactccgtaaactaagaatttgaaaaggctgaatttttagtttctaattaatatgcgattctatgtgtactaaagctactcttgagttagcaaatttaggcagtacgagtgtagaatctctgtcttgtactgaaacgattgtaatatccaccctttcccgcaaaaattaaaaagtaaacattgggtagtttttaccactagaatattcttaccactcttgatacgagtgtaactcaactggttaggtttctgttggaggaatatacccacacaagttcaagtcaacttgtcctgagtatttacatttacggttaattattgtttcagtgatagacgacatactcatcgatgacaggatacgtctgcagtgacttcttgaatctcataatacgacgactaatgggtatatgatagaggggtttggaatgactttttgaattttaggatatattggcccagtcattatatgggcgttacatttgcactgtgtttttttaaaaaagaattacaaaagttcgaaatagacagttgaattaattatacttgaatattgcgtgtgtccactagcttgtacacctaaacattttcatacttcggcgccgtagaccgtaggatacgtatagtactctcgttgacgaataatcacactcataaatataaatgcacctatacttttgactttgaaccagagaagcttaattttcaacgaaattattcatttattattttgccccgaaacaaggggcaggccggctaatttggagagtacaatcagaaatccattaaactggagaaaattacaaacaaaagctgagaccacgcatcaccaaacacgcatttacaaacttaatcccatgactatagtcgtagatatcaaataaaacacacgtaatttaccacgggtaattaaaatttttaactggatactctaaaagaaatttgttccggatacttttcgtttagagatttgttccggtccaaataaaaagtatcacatggtactgatacctcacggtatcaaatagtttccgatcgatgaatctaacaatgctcatcgtcctgtccagctaaattcaacaatcagaaacgatttgatactgtgagataccaatatcttgagattttttttgaccggaacaaatcacttttgtttaactgaacaactcttatttcacagtccaagtacgctatttagcggcccatgtactgcacggcgggagcggcgccggcggcggcggcgcggtcggcgttgaggtgccagccgagcttggggtcgtagccgcgggcgacgagctcgcggtactcctggcacagcgcgcatggctcgcagcagaagtggacgcagcagtcggcgcagccggcttcggcgagcccgtactgagtgcgcatcttgccccggtaggtgcaggagtagatccactggcacccggtgaacgcgcacagcagcccgtacagcgcgccgccggtgccgcacgacgtcgagcccctgtccaccatctccgccaccctcccgaacgtgatgcacgggcaccagcacgtcaagcagcctgcagattaatgtgaattaattagtaaattacagatcatgttcatgatatgatctagccatggcacggtggccggcggcgagagcgagaacgtttttttcgtgaacacgtaaaatgattacatatcaatataccacaatggaatcagccagaccaacttatgtcagaagaagggagaaaaagcaaaataaagagctgaagcttataaaaaagagcgagaacgtacataggccgcagtcgtcgaagcagtcgcagaggccggtggaccaggcggcggagccgacggggacgccggtcaccggagcggcgcttggcttggccatcgatctcctcctacttttcttccccggcgatgtgatcagagttgctagctagctactgcttgtgctgagaatgagcatgagccgggagtgggaggacgctttatatagcgcgcgagcggcgagttgatctggtatgcaatgcaagcgaacaacacagctaagcacccatgttaatttactacgaactcgcgacatttctgtgctgttgcttacgaaacgaaccgttgatttagtcttcaacccccacgagatcgatcttgatcgagatctcgcaaacattgagcccaatcagcccatcacattcacatatgtataatgtgctgctgctactatactgatacacaggttaaataaataaatccagaaaaaagggggctttttgttgagcaaactgtgtgcttcgaacttgaaaccaccgaactggaaatgatcacgattcaagcctggtaggctattctaacttgcattatgtgttcaaacgagacttccgagagggccccaaaattcatgcatgcaagagaaggcatgccatgccatgccaaagtctttcgtgataccattggtatatagctccactgcttatgactcgctcgattaattaattaaggctgagcacaataattagccgtcgaatagaagtgggataagggagaggatcagaggaaattctatatcggttttttgtaccgatctaggcttcactagatttatattagtaggttatctatctggtagtactatgttgtgtctaatattgtactaatctacattttataatagagggagtatgcttctttttttttagaaaaaaggattagtaatttagaaattggactcacggaaaaaggaggtagttgatccgatgagcttgatccaacagggccttagtgcattcgcaaattggccgatcagcccaattagcccatttagcgacacgctgagtcccttaaatgggccggacgtcatcgccaagcgaactagaaggcccaaatttgatttgcaggtgtttacaaccgtcagatcaaacgaaaccgacggcggctaataattttggggcatatatatcatgcagattaacttgaccatcaccatacacacattaatttggagatttacaagattagcgatgcgagattaattaaggggtctttagcaatgcagatcgtaattaattttgaagtcgtgtagcgaacgagtaatatatatacaaatgttcttgatattcccaagctagtagttaggccgttaatttgaagcataggtcggatttaatatataatatttaaaaaattctaagtcgttggtagtaccaggagttgacaatgcactattgtataagcctggataaggctatacgcgtactaaatcttactgaactagattagatgcgtgttgtttaattgcttgtgtcgtctaccacacatcgtcaaaaaaatgaagtgtttccttccgaattttcagcaatatatacagcttcatgaattattaattagaactcgtgatgcgaaatgaacctaacaatgcatctttgttctcaccctaaaagactgcgtaatataagtttcagagccgacgacgcttccaaagttccaattattgaagtacggagtatatacactagctccgttgactatcaccatcagaaaacatgtgtgccactcctgccaacgaaacacaacatgatatctgccaacgaaacacaaacatgcatgatatccggcttgatctgcaagtgtcagtcaatgaaggaggatagacaaagcttacaaattaatacgagaaaacccaagaaatgtaatcaacaaacgctctattctaagatatcattgacgaacctaactttatgaaaatgttatgatacaagcatctttatatcagaaatatcatcattgttagatttttgttagtagtcttccgttagtgctataaaagattattttattgttatatattgttgaatgctcaataaaattattgttttttcgttagcattaatttagtgtaaagagcaatatataaattagtgtagtcacaactcttattatatgggctcatatgttttagaaaaaaaggatatgtatttaattagggaaaccacataatctgtcattttttttggtttgtgtaagatttaatagaacgataaataatttgaaacagaaagactatatccaatgggccggacgccaactaatttacagcaaactaatacaacaaacaatcgattaagcgcagagaattacaaacaaaacttgaccatgcatcaccatacttacaaacttacaggagtacaggcatagtccctagatatatcaagtataataatttatctggacagctcttcacactcactacctccgtctcaaaataagcttatttgtgagtttttatgttcaacatttgaccgtccgtcttatttgaaaaaaaaaagtaaaataagtcacgcgtaaagtactattcatattttatcatctaataacaataaaaatactaatcataaaaaaattaaataaaatgaattgttaaacgctagatatagaaacctacaaataaacttattttgggatggagagtgcatgaagtgaagctttttctaacggcccatgtgctgcacggccggtgccgcggcggcggcggcggcggcagcggcgccgcgctcgacgttgaggtgccatccgagcttggggtcgtagccgcgggcgacgagctcgcggtactcctggcacagcgcgcaggactcgcagcagcagtggacgcagcagtcgccgcaggcggcgtcgccgaggccgtgctgggcgcgcatcttgccgcggtaggtgcaggtacatccactggaacccggtgaacgcgcacagcagcgcgtagagcgcgccgccggtgccgaacgacgtcgaccccctgtccacgatctccgccaccctcccgaacgtgatgcacgggcaccagcacgtcgtgcagcctatcaatattgcacagattgttattacagattgaatgaatcagttcatgttgatcgatcgatcgatcaccatggatgcaagctactagtagctagccatggccggtggcgaggacgtagatgtacgtacataggccacagtcgtcgaagcagtcgcagaggccggtggaccaggcggcggagccgatggggacgccggtcaccgcaccggcgcttggcttggccatctcctccaatcctctccttcgccggtatacagttttttttaaaggaaattcgccggtatacagttacctgctgctgctgctgctcactacttaaaaaatgttcctcagtgccgtcttatccatgccgggttttttaataaatcggataataggaaatgtctcattcattcaaatatttttatattttaaaacagatggtgtagtaaatagtagaattttaaaacagatggtgtagtaaatagtagaaccagccaaagggatgatttttttttctcgaccatatgtctcccagccactacacccccctccctcccttctctcgaccttatctcctacacacccactcactctctcccttatttgagttgaaacttgaaacaattgagcaggataggatcacacctgataacttgaaaagtgtccgtaatgtaaccaaaaagtcatgtaagagaagatttgccacgctaaagtctttcgtgatgctataccaatagatccatttattgacatgtaagctttttacgcgttcgcgaaagaaaaatccacaatccagtcaaaaataaaatccatgacctatgacttacttgattaattagttataagcacaataaaattagtcgttgaggtgaacaggataaaatgagaggaaatgaactagagaggtaaagctgaatttaggttaccccacaactttactacagacccaatttctgaaactaaatttaggagttagagcactaccaaacgaaccgttaggctgagttcttcttggcaactccaaatagcaactttctggttttcgttgtgaggcttgactaagtttatattactaggttgtctatctcgtagtactatattgtgtctaatatagtactagctttctatactttataatggagggagtatacgtaatttttttaaaaaaaattatgtttagcaatttaattacactcacgggaaaagaaggtagctcatcggaataagttcactttgactatgttaaaagtgacccgaatctaatccgtgactctgaaccgtaaaccagaaatcttgacccctaaactgttaaaaccagcgcaatttgactccctggatggttttgaatgacggtttcgctgacgtgacgactacgtggcagtaaaatatgggtaaccatgtaatctgtcaaatcttcttagtttgtgcaagatttaacagagcaacaagtaatttaaaacgaggggactctttccaaacacaaggccggcacaactaatttgcatcaaactagctagatggcccgcgcaattgcgcggctagcaccatacaaaattatatattttttaatatggttttacttaaaatttattaaatagttatctcattgtcttaagatcactttgcaagacaaaaccttattatcctcgtgtttctaatttttatagtttttaaaaatcacattagttgctaccacttacttctgtcatatccttgtttatttacttgctcgatctaccacaatttctattcattcttattcgaacctttaaaaattagatcttatagttttcagagtttattatcccgttgggttcatttttataatttatagaagtcctatcaaacactgccattatactcctctacagccatccactgcctcttctctttattgtcattgatattttaattaaaaattgaacataattatcgtttaagttcatttttttactttctagaagttccgccaaaatgtcaacgactttgtcactatattcctctacgactcgcccgctgcctaccttctttattatcattgagattttaaaatcaaacatgattatcattagggtttatttatgtactttttagaagttcagacctttaaaaattggaccttatagtttttagagtttattgtctcgtttggttttattttttaattttttagaaatctcatcaaatgttgccactatatttctctatgacccgtctgccgaccattttttattatcattgggattttaaaaattgaacataactatcattgaaattttttttttactttctagaactcccaccaaccatcggcagctctgccattgtactcctgtacgattcgcccgctgcctctcatttttattgtcattgagattttaaaaatcaaatatgattattattgggttttttttttctagaaatcccgataaccgtcttgaccgattgcttcacgacctctctatcatcctttattttaatcgtcattaggatttcatttggtgttttattaatagtttttagatatcccatcaaccgccaccactttacttctttatagacatgttaattaattaatctcgtcatatgttctagattactctaaagattaaaaaaatcataattccaataattgaacttcccatggtaatatactaagatgtgctaacctcactgtttgtttaatgtaggtttagagagtaatatgacatgctaagctgctagcatctcattgatgtgctaattgggtttagtcaataagatggatgcgtccaacacctcgcatgcatgcgttatcgtcgtttgtttttcatgtgtgcacgcatcatattgtcatgggtatggtgcatgagacagacacgggtgctagttttacatgtcattacattactactcagctaccgacttacgatttagcttaatcacagggaaaattagatttctattctgtttatatactgttagtattatagtagtatagttgtatttcctataaaaccttttctaaataaaaatatatttggtcctttttttccttttccctcttattaacatgaacaaactttcgcgtttatatcacttcaaaaattaatttcctattctgatttggatgcaaggtcagtgtgtgcaattggttcaattgctatacggtttcacactcgtatccgtttcatctctttaactttttaaattttaattaaatcttaaccgttaatattcaagtataccacaattctatccatggttggtattttctttattttgtttaattaacgtgataatttctttagagcaaatatagcgtacaatttaagcacataaatattttattatacatgcatgtataattagatttagtgtacaacacttatcttctgtttctatagataaaattatagcattgtaatttagtcctaccataacctattggaatatattttaatctacctttgagcgcttaataattaacataatatttgcttattctttcgtggatgaacgtgcatgactctaattacaaatttacaggctcaaatggccatacgcatgcatgcaaatacatgcatgtccgactcctagtcaaattagtccaaatacatacatgtccgattcctagtcaatctctctagatgtttttttgtttggactcacgtatttccctgcttgatctagaccatcaaaatctagacaaatacgatccaacgacacatatattttcctttttcttcgattaacgtgggaatttctagcctccacagcgaacgtgttgccttttttcaaagctgttttaataatataatagacatatagattaatacaacaaacaaccgattaagtgcagagaaattacaaacaaaacctgaccatgcataccatatacttacacaaacttacaggagtacatacaggtatagatatcaagttaaaaaaactcataattaattttgaaaaagatggatctagtaagatcgatcgatcgtacgctccaaaaaaaacatttttttttaactggacaccacttcacacgtccaagtacgatcgatgatgtacgaggagagatgacgctatttaacggcccatgtgctgcacggcgggcgcggcggcggcgccgcgctcgacgttgaggtgccagccgagcttggggtcgtagccgcgggcgacgagctcccggtactcctggcacagcgcgcaggactcgcaccagcagtggacgcagcagtcgccgcaggcggcgtcggcgaggccgtactgtgcgcgcatcttgccccggtaggtgcaggagtagatgcactggcagccggtgaccatggccagcagcgcgtacagcgcgccgctggcgccgcacgacgtcgagcccctgtccacgatctccgccaccctcccgaacgtgatgcacgggcaccagcacgtcatgcagcctgcagattaatgtcaattagttagttaattaattacagatcagaatgaatcagtgttcatgatatgatctagccatggcacggtggccggcggcgagaacgggaacgtacataggccgcagtcgtcgaagcagtcgaagaggccggaggaccaggcggcggagccgacggggacgccggtcaccggagcggcgcttggcttggccattgatctcctcctcctcctccttcttcgccggtgtacacagttacctgctgctgctgcaaggatgtgatcaatcgagttgctgctagtgctgggaatgggaggacgctttatgtagtgcgccaacggcgagttgatctggtaagaaagcgtgtctgcttcaatttgattggtcgatgctataatcatgtttgctccgtcggtcttcgttgacccaatacagttgacggcggccagaagcagcactagctagattttttttatttttttgaaactttttatttttttaatttttaaaataaactgttttaataccaatttcaaaatcccttttttttatcacgccaccccgtctgacgtgacaaaatattgccacgtcactaatagttacattgtcacgtcaccaatagttggcatgacagttttaatgtcatgtgaaattacgttggaacaccgcccagattagtgtggtattattgttccacaacgcactagagtggtgtggtattattgtttcacaacgccagtcttctaggcatgggtaaaaggtttaggctgtgtttatatacgccagtcttctaggcatgggtaaaaggtttaggctgtgtttatatccaggtttagcttcagattaatcctcaatctgaggatgtattcatacacgtttaccagcatagtactgtatgttattttttgcgacggcatcaaatcgttttaattagagcgtgatgccgtgatcgacatgagactaatcaatgcgcgtgccagttgggatttaattagagctcattttctactattagtctattttaaagccaacatatattatattagttataaggttggctttaattttcttctcctctctctatctctatcttggagcttgtgttaagctagctcttgcatataagagccaacacttttgatttcttgttatctttctccttcacataagcttatagtagacttatagctcaatattatacttgctcttagccacagtaataatccctctggcgttgatgctaattacctagccaaccgggagtatcgccactattttctcgatcgattgccagttcacttgtattttttttctaatccaggccagtaatatcttttttattttccagctaaaatgatatatctcatgtacgcatagtacgattttctattaattttttgtataaatgtcaatcaaattaaagatatatcgttttcgaagaaaatatcaaatcatagctgtggtcacaagttgtgtggaaaagtgaagtactaacctgtcttaatatatactccgtagtaacctagaaccgaatttgatacattttatgattatgaattttaacatatatttgtctagattcgtagtcttaaaatatattaaatatatttcagattattatatattaggacctactccctccgtaaaaaaacgttaacctagtactaaaatattatgtgaaacatgctctatatacagattcgttatattaggatatgttatattctagcattagatttgatttttttagatggagggagtaggaaatatgaaacaacgcgtcagtatcacacactcgcacaacgtacgcaacaagctaggcgatcgagatatgctacaggcctacagcgacatgattcgtgttacaaacagcaggcattggttcgtttaccagcatagtacgttattatttaggttgggttattgggttaggttagctcccaccatcttatactaatactccctctgattttattatatgatgttgattaagttcaaatttagactatccggcgctatacgtaaaagaaaggacagaatataatatgtagtgcttaattatgggtgtgtttagataaaaaaaattttggccaaaaatatcacatcaaatgtttggacacatgcatggagcattaaatgttgtctaattgtaccatgaattaattttaataaattcatctcataatttacagtcggaatatgtaatttattttgttattagtctatatttaatactttaaatgtgtattcgtatgcttaaaaaaaatgaccaaagaactaaacacgaccagtatcgtgtatttgcacatttgcatgcaacctctaggcacgcatggactgggaaccgatgaaatttcttcgatgtttctgcacatctattcaaatcccatgagaggagaggagcccatctgaaagtgcatgcatcttcatgatcatggataacctttacgtacaccaaccaaactttccaccaccgaactgaattgatccactccggtccggtccgggtccgaccgaaacaacgacgcgttgttgtcgcgtcaactgcgctgccgctgcacgtgattggcgtgccgtgtcagtgatgatacatgcatatacaccggctatatatatgcccgtcaaatactcaaaccccaatccatggaaaacttgcaaaacaaaacaaaacaaaaaggaaaaatgagtgtcttttgattttgcaagcttaccaatatatgcccgcggctactcagtatttaagtataatcaaccttgttttgcgaaaaaaaaacctggtaaatatacaacacgtacggtgatgtttggcattccataaaattttagttcaaaatttgatcaaacacatcgagaaaatattttttggtaaatttggttatgaattggtgatatgtaaatattcacgtgttccatgcatgcatgacgtccaatgtatctgcctcatccatcattaattggtgccgtacgtacgccaacctgatttcttgtttcttgttcgttgtctcgatccggcacatctccttcctctgcagaatttaatcatgggagtttggaaaaacttggaaagggtgggagaattcaggcggcgatctagtgtccttcaggggtggacgaaaagctcgtagctcgtttggcttataacaaactcggctcggctcgtttcatttttctaatgaaaatcggattcgttgacaagttaagagaccttatttgaacttatttcaattggccgatctgctggcccatttagcggcacgctgagtcccttaagtgggccggctgacatcgccaaccgaaccagaaggcccgaaggcccaactttgctttgcaggagaagcgaaggaagtgagtacagtatggggtctggcccagcctttccttactacaggtataaggtgtttacaaccgtcagatcaaacgaaaccgacggtggctaataaatttggggcatatacatcatgcagattaacctaattaaccatcatcacacacatcttaatttggagatttacaagattatcaatggcgaggttaataattaggggatctttagtaatgcaggtcgtaattttgaagtcgtggagaacgagtaatacaaatgttgttgatatatatttccaggctagcttggccactgaagtaaagaccgagtttaatttatattattaaaaaattctaggtcgttgatagtaccagtagttgacaatgcactattgtataagcgtggatacggctatacgcgtactaattaaatcttactgaatgaggttagatgcgcgttgtttaattgcttgtgtcgtctaccacacatcgtcaaaaagatgaagtgtcgttccttccgaattttcagcaaaacatatagctagacgtagttttcataaactctagtactagacactactctttcaatacatacaccattattttatacttaaatttaatactatttatctcacatgatgtcttgaatgttgcgtagaaaccatatctcatgcaagatatggtttccttctcttttctcatttattcacttgccacatcatttttcatcttagttggtagcttatttaatgttatggatatcatcctaatcatttggttgaaaatggtctaaattattagaactcgtgatatatgcgaaatgaacctaacagtgcattttttttaccctacaaatctgcgtactataagtttcacagccaacgacgctttgtttggccaattatttaagtacgaagtatacacaatctcgttgacccatcaccatcataaccacatgctgccaacgaaacacaagattagctagcttgatctgcatgttgtcggtcaacaaggaggatggacacaggttacaattaatatgagaaaacataagaaatgttatcgataaccctaccttattgaaaataattatcatggtataagcgtctttgtttcagaaatatcatcatcattaggtttccgttagcaactatccgttaagtgttataaaaagatcattttacctctatttagtgttatgaaaattatccgttacaataatttagtgtaaagagcaacctacaaattagtacagtcataacacctacaaatttagtgcattatattggatcaaacacctacaaatttagtgcattatattggatcaaacacctacaaatttagtgcattatattggatcatgtgctttggaaaaataatatgtcaaatcttattagtttgtgcaagatttaatagagcaacaagtaatttgaaatgagaggagtctttccaaacacggggccggcagctaatttgcagcaaattaataaatacaacaaacaattgattaagtgcagagaattacaaacaaaacctgaccatgcgtcaccatacttacacaaacttaattacaggagtatatagaggcatagtagatagtatcaagtaaaaaaacgcatataattaatataccacttataaatttcttttaaaaaactggatactataactagctcccaaaaaaaaaacttttttttaactggacaccacttcacacgcccaaagtacgatcgatcgatgatatgatagatacgaggtgacgctatagctagctaatccatttaacggcccatgtgctgcacggcgggcgctgcggcggcggcggcgccgcgctggacgttgaggtcccatccgagcttggggtcgtagccgcgggcgacgagctcgcggtactcctggcacagcgcgcacttgttgcaccagaagtggacgcagcagtcggcgcaggcggcgtcgtcgccgaggccgtactgggcgcgcatcttgccccggtagacgcaggagtagacgaactggcagccggtgaccgtcgccagcagcgcgtacagcgcgccgctggtgccgcacgacgtcgaccccctgtccaccatctccgccacccgcccgaacgtgatgcacgggcaccagcacgtcatgcagcctgcagatcaatgtgaactaataagttagttacagatcagaactaacgaatcagtgttcatgatatgatctagcacagtagagattatctgcactactgctgatgtagtagtagacattaacgtggggatccgaacccacgtgtcagctacggctactgcattagtagtactacggaggatttgcatatgatctagccatggcacggcggccggcggcgaggacgaggacgtacataggccgcagtcgtcgaagcagtccaagaggccggtggaccaggcggcggcgcttggcttggccatcgatctcctactttcctttaatttccttcgccggtgtacaattacctgctgctgcaaattaaggatgtgatggagttgctggtaccttaattagcttgtggtgggaatgagcatgagctgggagtgaggggacgctttatatagtgcgcgagcggcgagttgaactctggtatgtgtgtatgcttcgaattgattggtcggatcaatgcagtaatcatgcacgcatgtttgaccggccggtccaaccaccgtttcgttgacccaatacagttgacggctcgctgccagaagcagcactagctagcagccaaatataaccttggtaaggtcgtgtttacttcacctccaactatcttcaacttccaactttccatcacatcatatccaaaactttcctacacatataaacttataacttttttttcaaacttccaactttccacaaacttccaacttttttcagaaactaaacacagcctacctacacttcgagcgtaatccttaacctgaggatttgtttgatcaattttattttctttttttaaggtaactagctgggtacccgctcaaattgcgtgactagcatatgtacaaatttatctgctttttatatatgacttttatttaaaatttgttaaatagcttgtatcttgttgtcatctttgaaaggccgaacattatcatcccgtgtttctaatcgtatagtttttaccagttactcctttatcacactaccagttgtgttactcgtatttgcttaatctaccacggcttctattcatcctacttgggacatttaaacactaaatcttgcatttttagagttcatcgtcttattgggtttcgtttttacgattttcagaacacctgtcaaacatcgttactgtactcctctacgatccatatgtttgtctcctcttttactgccattgagaatgaaacataattatcgttgggtttattttttttactttgtaaaagtcccaccaaaccatcaacgacttcaccattgtacttctctatggcccgcccgctatttctcctctaattgtcattaagatattaaaatatcaaacatgattattactgcaatttatttatttattactttctaaatgttttgattaatttgagtccaattctatctcatggttttgatcgaaaaatgattgtaatatgtctcgtgtgatttaataaagtcctttcccctgaaaagaaaaatgtcacacactccaacaacgtacgcagcaagtcgatttcccggaaggatatgctacagcgattcgtcttacaaaccgcgaacgttggttcgttagtttaccagctgatcgagagtttacattaatatattatgtgttgtgttgggttaggttagctgccaccaccatcttatatactccctcgatttttctaattaacgtgcaacgccaacttttaacgagttgtttaaccatttattttattaaaaaaattatataagtattatttatttttctgtgatttattttatcatcaaagagtatataattttaacttatatttttatatatattttaaataatacaaatggtgaaacgtcggtgtcataaattaaaaaacaaacgtacttactactacattaatgatatgtaacgcccattaatttgcccatgtgcatgcaaaaatgtactgcgttggggaactgatggaatttctgcgatgtttcttgcaaaacgtatggcatgaataatccatggattttaatttcttcaaatcccacgagaggagaggagaggagaggaccccgtctgatactgaaagtgccgtgccgcttgataattgatggataaattacgtataccaacaaccaaactttccaccaccaccaccgcacttgatccactccgtgtccggccaaaacaacgtgtgtttgtcgcatggacactctcgactgcgccgccgctgcactgcacgtgattgcggtgccggatacgcaattagctatatccggtcaaatactcaaatcagtttgcgaaaaaggaccaaatttatgcgaaaccaagcaggtatagttaacttaacaagtaagggtgtgtttagtttacgccaaaattagaaatttgattaaaattagaacgttgtgacaaaaaagttagaaatttgtgtgtaaaaaaattttaatgtgataaaaaaattaaaaatttaaattaaagaaaaagttgggaactaaagcagccctaactgtcgttgaacaagccgtgtgttcggaacaagtgcccaatataaatgcgcgtgggacttagtttccctagcagtgtttccgtggggctcagttttgcacatgtttgtacctccatttttcttcgtacgactagcaaaaagcacatgttttgctacggttataatgtccatacttatttaggttttgtttagttccaaactttttcttcaaacttttaacttttccatcacatcaaaacttttcacacacataaacttctaacttttccatcacatcgttccaatttcaaccaaacttctatttttggcgtgaactaaacacacccttagtatatgttgttcatttgattcaaacaaatattaaactcttgtttaatattaaaaaaattagggactaatttgtaaaaatgtgcaggagtaattgtggtggattgatggtagttccatacttccatcaccaatattatcttttatagtagtaatatatatattaatttgacaaataaccaccactagagaaatgatctttactaccagtttaaaatcccctttattctcggttgtagcagctaagaatagctagtaaagcgagactaaaaatcgaaatctttagtaccagttaaaagaactagtactaaagatacatactaaatcaaaaataatatgtgggatatgagatttaaacttcagccctcacgcatgttaccatcgcacatactacacacatctgacttggatggagatgctttatttgtaaactaaccttggagatatctttaatatcggtaagtaacaccaaccggaactaaagattctccatcttcagtctcgattgtctttagtctcggttggtaaagatgtatttttattaccggttggtaacaccaaccaaaactaaagacgtttttaggacttggatttttcaaaccgatacttaaaaatatctttagtaatgattctaaatctaaccgagatatttgtgttttgggtaccacgataaaagattggttgtccagtagtgaacaaactaaataaggacgtagaatgtgttaaaaaaaagacgctgaacactcgctttgatttggaaaaagagttattcactctatttttaaatatataatgttcatgattttttacataacagtgatcatttgtcttgttaaaatatttagtacaaatataaaaaaatattagttacacacaaaatacctttaatgataaaataaatcataacaaaatacttcctctgtctcaaagtgtagacatttgttaggttatcacgggcatttttaaagtagatgagaatggttgaagaaatggtgtgattggttgaaaaaagaaagtaggtgaaagagaatggttgtgattggttgagaggaggatcgaggtaggtgaaaaaatagctttattatgggacaaggtattatgctagaaataactatattttataatgaaagttataaataatagtttttaataagacaaatactcaaacgtaataatgaaatgtcaaaacatcacacacccctagtttttgaaaatgaggtaagcgattttctttttgtcagctaatcgtgttcaaagtgactgaaatgcgtgttgtgtcgttcttgatattgcagaccttagagggccaatgggctccatgtccttttgatgcgttattttcagcaacaaccacttagtactagagtattagagcacctgtaatggtaaagtaaggtgctatttataaaacatgtacatctcagcaatagactaaattaattgtaaaccatcttaatagtatgtctatatgggtatctatagctctctaatgcattgcctcgtttttctctatagactatcttcaggttagtagatagctttgctctctctcttcatttaatctcttccaaataggaaaatatgctgacatagatctcttatagagagcctatagataaccattgcgggtgcccttatggacatgcttcttaagctataaatagtctgattttctagaaatttactatataaaaatttcttatactctgcaatttcctataccacttagtaatatttaaacatttatttgtaacttattaatattttgtttatttgtttatgccctaataattatcgtaaaatcagaatagtctaccattcatcccctgcaatccatatccagtgagatcttaatcttcacacaaatagctaaaaaagaagtcaagacttgtagttgcttgtatctctctcattccaagaggtgaatattaacaaatttggttgttaatttgttaatactacacgattgcaaacttgttttttttttgcagggaaaacttgtaatattttattatattaagataattgacctttgtttgcaaaaaaagaaaaagaaaaagaaaaaacatacaacccggtggtgttcgccgttccacataattttagttcgaaatttgatctatacaagaaaataattcgacaaatttggttgttaattgctgctgtagtattcacgtgttccatcacgtccaatgtatctgcctcttccatcattggtgtccgtgtcctacctgatttcttcttctttggttcctttcgttgtctgcatcctgcacatctccttcctccgcagaatttaatcatgggagtttggaaaaacttgcaaagggtgggagaattcagccggccggtctagtgtccactagtgcctaagtcttagtatctcttggggcactcacagtacaaacaccggacctcgtggcttagccaaaaaaaaaaaacacaaaaacactcatttccacagtgaaaggatcctattttgcatgggctaattggatagagatattgtgcaatgcaactaaccccacaacaagcgtgacccgggtccaactatcacacccgagcattccttcacccacccttactaccgttttcctccatcccatcgcgagctcgcctctttccactccgccccacccaccgctcctcctcccggtccgtcacgacggcccgctctctcctcggcacgctcgtcctcggcatctgccacctcctctccctcgttcttggcggcagctcgccggtgcgcgcgtggccgccggctcttgtcggcgggaggcatctccggctgccgtggcggcatcggccaccaccaccggcctcgccgccgcccgccgcgtcggccaccagcccaccaccacccgtcgcgtcaaccaccatcaccggcctcgtcgccgcccaccgctccacctcccggtccgccgcggcggcccattctcccctcggcgtacgaggtagatgtggtggccgcggcggcggatgtggtggtcgatgcggactcgggagcaccggcggtgggcggcggcggatggatctgcctttctcgatggtgggagcggcagggcggcggatgtggtggtcgatgcggactcgggagcaccggcggcgggcagcggcggacgggtccgcctttcctgacggtgggagcagcgggggtggcgggagcagacggcgtgggaggagaagaatcggtggtgggaggaggaaattgctgtggtaggagaggatttttcgagggtgattcggggttttcgccgggcggaatcgacgcgagggcacgggcggccaagaaacgctgctcacagcgcgggtgcctcacgatttcggcgccgcgcgtggatttgcctcgacgaagttttgcgcccctcttgtgggcacgagacacctagtttggtcgcgggcgcatgcgacacgtcgaccaaaatccgatgtggcgcaacgaggttccggtctagctcagcacagtgtgaaagactttatagtatccccaaaggaacacaaagataagttttctttttctactcctatatataacaattaattgacaaaagaaagaaaattaagaaggtcccagccgtagccatatttaagttagacctaaaaaataatatctgattagcactctatagtcaacatatgagttgaactgagccataatgccctttaattaagaatgattcagtttagaattattataatataaactattaggagtaagcttaaacaaacatatagcttattatgatagattattacaatctataaaccagattactataatataataatccactctaaagatgtttttttaattattgggtggctaacaactaacaaacgactaataatatagagatacaaacagctaacagcttattttatgtccgcttattataattcagcttatagtaatctggcttaaccatctagattacaataatttttaaccttaaaatcatgatcacactggctcagtaagcttagagaggggagagagagagatgcatatatgacaaagaaagattataatctgatgatttattagttagctaatgaacgaatcaaccactttattgatggttaaacaaaacattcaacgaattagaagagctaattaattaattagtgcctgttcagattgtagccaaaataaatcttaccaaattttggcaatatcaaaattttggcaagatgataatgttgtccaaattttggcaggatttcttatatatttatcaaatttagtagcaaactaaacgtagacatttttttgacaactttaaaaaaaatggtatggttgaaaatgacgtcaaattgaacgggcccttaattaacctaatcaaaatacctgaacacgatcgatcaaaaatggagatgagaagtcacatgagcgattagtacattatgaattgatcataactggacatccggtattagttcgtccgagtgttcatcagctgacggctccggcgccggctcgccggccgttccgatgaccatctcgatgagcgcgccggtgacccgcatgaacttctcgaacgcctcgttcttgtcgagcagggtggccttgacggtggagtccggcgcgtcccggcagctctcctcgcacgaccacgtgtccctctcggcgacgtccatgaacagccgcacgtccttgaacttggcgtcgaggtcgacgacgccgccctcggtgtcgtcgaggtgggagacggcctcctcgatgtcctgcgcgcactcgtccaggcactgccacatgtcggtgtccttcacgatgtcgagctccgcgcgcgcgaacgtgcccgccgccgcgccgatggtggcggcggagcggacggcgttctcggcgaggacgcgcgggtcgccggtgttcctgcactccgggatggcgcccagcacggtgatgcacacgtccgggtgcggcgtcttggcgcacgtcatcatcagtgggctcccccccccggcggggcggaggaagaggatcagaaggaggagccgcacggagccgcgtgtcgccgccattgtcgtcgatggaggatcatgggtggaggcaccgcggcgagcgatatatggtggtggggagcgggagttgggttcgtgtggtcgggagcgttttgtgagcgaggcgtgctaatgctgccatggcgagagatgcgcgggcgggatccgccatggacgtgggagagcttgcatgcagcgaattagcggaagtgagttgaggctgagctgactcccacccatttctgcggcggctgtctcgctggagaagacgaccggttcgcggaggaagcaaatcagactcactctctctctcacacacacacacactcttgggctttttttgtatcgggttatcttgggccgaatatgccagggggatcgaaaaagtgggggaataagttcatctgaggtccctgaacttgtcaacgaatccaattttcgtccttgaaccccaaaaccagatacaacgggtccctcgactataaaaaccggtgcagataaggtccatcggcggtttagatggcggttttgactaacgtggcgcctacgtagctatttttgactcgatcttcatcggatgtggcactgacgtggcgcttacgtggcaattcgatccagaaaaataataaaacctgtgggacccacatgttagttacacaaaaaaataattagaaaatggtggggcccacgtgtcatcctcaccctatccttcttcctcatctctccctatctccccgctcttcatctctctcccctctcctgtctctccaagtgccacggaacggggaggttcggcggccggcggcacagcggtggcggcggcacaagagaaggggagggcgcaagagaaggggcggccggcgcacgcgcgggttcctcatgggaggatcacgtgggcttccatgccgccgcagttgtcgtcgtcgtcgtccaggtcgtcgccacccttgaggaatccggcgttgttgacgaaaaaatcgaacacaccggcctaggagatctgcttaactcctgtgcaggtccaaaggttggtgagatgcgggcgtgccagtcagtttgatcctgcaactgacaagatatgcaaatagtagatcaaaacaaccgatcggctgacaagccgatagagtagttccagccgatagtcgataatagccgatgccgataccagccgatagcgatagggttttgataaatcggctatatgtccaatgtagatgatgatataaaggcaatcggctgatgataatataatattgcaatataatccggtataaaccaatcggctagcaatgatatgataaataagcatcgatccgaggtttaaagcacacatcggctggaggtccgatgtcatgaaatccacaagattagattaaacagtgaaacctttgttgtcatcgctaaatccaacttatatgtatatacaatccttatgagccgatgcaacgtccagataactcaccggctaaaaccccgatgatacccttattggcaatcaagaagcaggctagagattatggttctaagcacgacttagtagatcaaacttaactgatgcagcactaagtatgaaaagaaacattatatctagacaatcaagccgttgactgagttttcagggtggtagatgtctaagctaatctaatctagaaacacgatttagctaataccggcaaaaaccctaaaacgagaagcagccgatagagctaaattgatatgctaagactagattaacagagacatattgataaataggtaggcaaatatatcatccaaaccagagcaatccaagaggtcgaatgtactagtgcagccttgaacgacgccgacataaatgatacaattgcctggaccggcgaaacattggacttaccccttcgccggagatcgaagccggagatcgaacaccgatgcagccccgcgtcgggtgccaagtcccgccagacgataaaataaagtagaaaaggtaaaaggggtggcgatgcgccgaattgtatcgatcgtggagatagattacatagaccccgggtgtacatatttatacccatgggttgatacaagcccttgtcggacaagaaagaaactaacctaaagataaaaggaaaatataaagtccttatcggacacactttcctaaagataaaaggaaactaacaaactattcctaattaatagataaactgccatgccgcatcctctttaaactcggtcacttagggataagtatcctttagtagattgatttccttaaccgaatatagcaggaatccgactattggcgacttgataactcccatcggctgattccgagatgctgcagcagataatgattctaagccgatgacgtctttgccgattaccaaatttcactgttaataggcgtgcgccggccgccccgctccgcccccttcacccaacgctcccgccaccgcagtcgtcgtcgtcgtcgtccaggttgtcgtcgcccttgaggaacccagccggccgccccttctcttgcgtcgctgccgccgccaccggccgccgaacctccccgtccaatggcgcgtggaaagagaggagaggggagatagggagagatgaggaagaagggtagggtgaggatgacatgtggggctcacgtgggccccactattttttaattattttttgtgtaactgacatgtgggtcccacgggttttattatttttctatatcgaattgccacataagcgtcacgtcagtgccatgtccgatgaagaccgagtcaaaatagccacgcaggcgccttgtcagccaaaactgccatctaaaccacagaaggaccttatctgtaccagttttgatagttgagggacccgttgtatctggttttggggttaaggactaaaatcggattcgttgacaagtttatggacctcagatgaacttattccgaaagtgggacgggcgactgtgggctgcaatagtctccacggcccatccaagaatattcggctcatctggattataggattttgggatagtttttgtaggatttaaattgattttgtgtgaaaactgtaaaaatgatgattctaagtactcagccctttctggccttttgtgaatctcactcagcatccaaaattccaaaccaatcgaatcgtaccacattcgtcaccggttttagcccgtttggtctgttacgtgataggtgataccatctatttcacaagctaatgcatgataaatacaatatttactcttgaaattgaaatttggcagatttacatagcctgatgtgtccaacataaattttgttggaaatttgaaacgttgcaatgagacgtgctcaagtcatgaatataacaagagagaatttggtggtcgtatatatacacgaggatacatgaaatgcacatgatagtacagtggtaaagggtatatggtttcaatcccgattccgagatctcgtgttcaatctttaacacgctcataatttctttttaataaatgtttggatagaggtctccccctccaaatctcgtttttgttatacacgatgatttgctacggatgtttgctcatggacgcattggtgagggcgagggcgatggagcagagcttggcgagctcgtcgatcctgtcggcgatctccggggcggcgccgccctccgtcatccggcactcgtccatgcacgtctcgccgtccgccctggcctccgtcacccacgccttggcgccggcggcgtcatggcgcacctccatcgccgcctcggaccgcctcagctccgccaccgcctcctggaacttcgccacgcacccttccaggcactccggcggcatgccgccgggcatcttcgccaggttcctcacgaacgacgtcgccgccgccccgctctccgccgccatcgacagcgccgcctccgccagcgccggcatgtccaacgccgccgccctgctctccggcctcgccgacagcgccttcacgcagtacgcctcgtgcctcgtgtgccggcacgcgtcctccacggtcaccgccgtggcggcggcgccccggagggagatcgcgacggcggcggcgacgacgaccagacggagagaagcagcagccatgtcgatctgcgtgatggcgagctaaattttcgttttcatgaaaacacttgaaagtgatgatatagagcgtgaggccgagaggatttacagctgcatgcatgagagaccaaccgtacggaggatgtccacgtcatccggtcaacggaatggttccaactttgaccatgcaaatttagctttagtggtatatatacagagtagcattgggacagaaataacatgcaggtatggcatatggaaattgttttagaacaatgcaatttgcaaagaattggattaataatttattgagtttttacataatttacaaatcatttgttattgtatctacattatcgtctttgagcagctgttccaataatgattccattgtgcttatgtaactaggcatgtaatgctcctttatcatgtttggagctagccttattttcccatacaaatctcttggcgtttcataaatgctaatgatctcattgctgctggatccctcaccaggatttgggtcaggtgaggccattgcaaccatgtgaataattcttccaggagggaaaaactggcgcgaactgcaggttggtagcggttctttcagcttgtctttgatatcacagttctgcttcagtgattctggttcctcctgccctgtcaaggatgattgttcttgttcagtgtccagtgatccattgatgttcacatccccttgtgctgcaaagcctgatccagcaacagactttgtactgataacattatcgttgctagatagtacaatcttttcttcagaggtaacaactgatacagctgaaaagtcctgctctgtattagcaacgaggtccgtttgatgctggttgcagtctgtgcttagcccatttgttacaggctgcgtgatttcggggacatgtttgagcaagggctgcattgacagaataaatagggtgtcagaaaatcgtcaatcctctcgttgctttgcttctgtactcacgttggcactaatcagtaaacccaagagttactttgcttctgtaaatttttggaaggtacactgcacggagaagcaggaactgtgcatgatggaaattctcattttgcccttttgtaatagatgtgatgcttgtatggccaatggaaggaaaatcatccgtaccaaagatatgcctactacctagtatactaacagataatattagcatgcccgccacagtgttatcggtgttgattgggattggatgctagaaaggatcgctggatcagctgttaacagtcattaaaaccgctgggtaatcaaattaatactcgtgctgggttcacatgtggcttaaggacgcaaaattatcattgtgctagtttaggatccagtgacaagtgacagaagcaatcatttaaatagtagaaattaaagtgcctaagaggtattacctcagatatgctagaatcaggatctgtgttcttctctgttggatgagatactgacagcatatgagactttatgaaagctacacgcttacttattgccgtaaataagctaaagtgagcttgatcctgctcatcatctagctttgatgataccattacctgcagtagagacaaaaaaatcagtgatgatagaacactgttgggaatcaggtatatggtcgttttcacaatttatcagaaattttatatggccactgtccagtatgccaatgaggttaacatttcaagtttgaagctaagatctccattgcatcacatatttcttgaaatatcacaagaaattaatgtattaacactttgctaagttcttaaaatgtttccttgttaattacaaaagaagttcatactagtgaaggtctgattttattatgctgacacataagacactggccatcagaaattcagagtacctcagctcgcaggttctcagcagaaacttttgaaaaggccgggaccacatcatttctgttgatgagagaagtgacaaattctttgcccgactccgccagctcccatgacatacaggcagctatacaaaacaggaaccctttaaaaatctgaaagcatttcctctcttaaatctagaaaatagtataactgtctcagttcctggattaacttgtagcctaataaaataaatcttgcaagtcaatgcaattctatcatatctgtataaaacaatggctaattctccatcactgtccaataatgcaaattgtacacaagaacgttcaaccaaacagttggcatggatgagatcatgagaacatagtgccaaaacaacttttgtcacccattaagtactgaaacagaacaaagttacaactcaggaaaataatataagaaaacacctgataatcataaagccatataatatctcgaaggcacaatgcaaaaactaagcaaagtgtggctttaaagatgtaaatcatgaataagtcacttacgaggagcaaatgccagacacgtgcacgatgagaactcatgatgctcatgaagaatgtatgtcagaattgctccgatacctgctcccattgaatgcccaatgacctagtacaaatgacaaataaggagacataatttgggtcagaaatcttcacaaaaataaacatgacataaaagacaaaaggagagatctgattacgcttcttaactgtctcagtgatatttatcaaaaacaaattatttcaaataaggtcatgtatatagatcacagcgcactgcagcggctacacctataaattgtagtcacttcatccatgcatagcactaataagaaatacctttatttgataatcagggaattcttgtactgccttgtgaagatggggcttggcaaggttagcaatccaacgagctgcagcaagcatcccacaatgtgcatatcctaaaaccacgttgctgatttgtccttcacttaaaactatatggtgaaaaggaacctcagcagcagttgcggctgttaggcgctccttagtactgatagcaccccgaatgaaaagcagaaagcacttggattttttgtcacacacaagcgcgaaagaaggttgcataagctgcatcaagttgatagttaagagtgagtcaaaatgtggaggaacaaatacaaattgtaaatgtgagtaccttaagcatgagataagaggaatacagtgatacttactcaccctcgccctagccttgtgaataagaatgtcttcttgattgtacccaccaaactgaagaaacgctgaaaatgttttctttgagtagaacatgcaaatcttcaagtgctcaagtagataagctacttcagtgtgtgcgtcgtgaccttttagttgaaggcaatcatttccactatactcatgctgcaaatcaccctagagcacacaaacaggaaaaaatacagtcacaatatgattccacaccattgactatgtaatatgttcaagacagctatacagaaccaagctgattataatctgcataactgaattgcttcagcaaacaatctactaccgccgaatttacgtcttaaagaacaaaatgctagttatgctgattcatcagaacatcggatagccagcttctcttcactcacgggaagtacatcttattgagttttgatgcattgaatagctttgcaaagaacatctgcagataaacagagtacattatattgaactgaatgttgagtgcgtcctgtttcctcttctttgagcaaccattttagttttagcaagacaacagaattctggtccaattttattagttgttcttctagcaaattcacacatgcgcaacaaaataaccagctctgtataaaacgcatatcgattggttatcagaagttcagaacagttggaaacgtttctcacttcagatcaacatctagaggagaccttgaccaccatgaccagcttgactctgaaaaaatccatgaatccgaccttacggatccatgagatttacccatatttacatcaacgatcttaagtcccgcacagaatttaagtatgatctgacattgcaagtacgaggaatgtattgaattagtggtagaggtgaagctattgtaagccactgacccaacattgagcctttatttcccaaataaaaaggcaaaagcagtcttacttgcaagtcaaatcaagtcaaaccttgaaatagtcataaatcctgccttttacaccaaaattttcagcaagagtaaaactaaaacgaagaaaaagtccactcgaagcaaagcaactacacgttccgccgctcagtgcgatttgagcgcagttagaacatcgtgatcagtcgctatcgttaaagccatcgagcgaaatgatcctcaatttgcaagtaagaaacgcaaagcgcagacacagaaacgaacagaagaactgaatactggcagcatcgcagtaatcgcgcacaagagcgaggaatcacgaggtgaaatgcgaaaaatctcgcggacctggcgcttcatgtggcgcttgatcccgaaggcgatgccgtggaggccccagcgcccgacggtgaggtcccacgtgcgccgcgccgtgcgcgcggccaccgccgccgcctcgcagcacgttgacggcggcctgtacggccactcctcctcctcctcgccgccatcccccgcctccctcccccgcgcctccgccccggacgacaacagccgcgactcctcctcctcctcctcgccggcctccggcgccggctgcggccggcagcatgcgaggagtatgtaggcgagcagcgcggtgcccgaggctgccgccgcccccgcggcggcgacggcggcgggcatccggcgattcgcggcggcggcggcggcggcggggatttggggcgatcgatcgcgaggcgttgaagtgtgggacgaagtggagaagaagcttcggtttgtttgtgaaaggggtggatttgtaaacttgagacttgcaacttgccccccaagtgaagtgaggtggtttttaaaataaggcacggtttagtttgggaaaaattttaggtttagttatcacattggatacatggataaacgtttgaaatattaaacttagcctaataacaaaacaaattacagattctgctaagaaactgcgagacgaatttattaagtctaattaatctgtcattagcaaatgtttactgtaggtttgtagcaccacattgtcaaatcatagcacaaattaggcttaaatgattcgtctcgtaatctatatgcagactgtgtgattggttttttttccatttaatactacttacactccatgcgtgtatccaaacattcgatgtgataggtgaaaattttgttttgcgaactaaagagcccctaagaaatttggttttcgaattcgtcctggaatttttgggaagcttgtgagccaaatatgtttggtttgtggaggtcgttttcgaaaataaaatggtttgccgagagggtgatgtcatcgctggatactgacatttttcagatgaaatagtctccacttgcataatgttcttacatcaatggctgaataccttcataatttatgataattataaaatagtataaataaataaattaactattataaagtttaaaacaatctaaacattttttctaaaagatttagtagtatgtgcgtaaagctgttttacaaaaatcataactgaaagcgtgtgtacttgcatattcatcggttaagcataaaaaaaaaacatggctgcgcatcaagtaccattttttttcttggcaataattgtactgtagtgttagtatgctccaatcattgttcatgagtagggctcagagcacgtgatttgcatttgaatagaaaaacactactattccaattacgatagagattgaatgaaaggaaattcgacataaccccaaacgctattccatttttatttgacatcaccacgataaattatccattgcaggcgcgatgttatttaccggattgatccattttcttttccccaaacaaaaaaagggaagcattttccctaagtttcataggtctactaattttcaaggaatgttctggctctcggttcgcaatttcgcattgtaaaacgatctctaaaaatggatttattgaatataagtacagtacaatttgctttcctcacagtcttttttacgttcgtgctcggtcaatcatccaaacaaaacagtggatctcaagatcacaaaatgctagtaggattaattatttgtccccttttgctaaaaggccctggtagaaaccagcaattagaaacaagaacagcagcgagctccggatgcttatcgacaagggagagctggtgggcccgggatgacagcgtggatcacatggaagcgccaattggtcagctcgacatggccccaccgaaatgattgctgccaagaagaaaaaaaaaccacgggttttttctcacccattactccccacacacaccgacatgtgggcccgcttctaccactgggcccacatgtaagagggcgccaaggacaatgaggccgtgggttttactccgtggtgactggtgagtgatgatgctggcaccctcgtgggaagatgccgagagtttggagccctgagctgtggggcccacatgcagtggcacgtgaatgttttttttttccaagaagaagatctccttctctccgagccgttggatcaagctacggacggccagatggtgctgggaggatatccgtatgatctttcgagtatcatcgcaacatgaagctcgaaaatcttagccgcattctgcagccaccaaactgtttatagcagtttagctctgtctgattgctgctgcaggcgagctacgcttcaataatcaatatgtcttctttattattctagcatcagatttgagtttagctgtgaacagccacaattactccaaaggctctctcatattagcaattggttgggtgtgtaaaatttttacactgttccaagatcagctttggattctttgttgcttgtgtttggcgtcgcaaattggaacgttgaaaagatagggttcgtgtttagctagtgtgttcagtcgttcttcaggtctttgcaaaatgaaaatagtatttcattgctcattgaaaatattattcttttattggcattctgtggtgatccaagtatactggacaaaattcttgcatcggcaaccgatgcattagcagcctaacttgatacagtgcttctggttgaaagtctcgaagcaactctctcttttgactgaattcatttgtcaagtagcagtagagtactagccttgccaatcgatcgagaattcgacatagccactggtgtcagggtctcacggctcaaggaaaaactaatcctgcctggctgacaaatgttacagaaatacagttcagattattgagaaatgtttggttcagtatgaaccttctggttcagtctcgttgaaatggcgactgactgacaaccggagtttattatctgaaactgtaagaccataatatactgttattgtttgttgattattatactacgagtacttccaatcgtagtgacagtgtgaacaatcggaacctgaaagccaatcatccagctgaatgtttggcgcaactggattatgtgagaagtttagtccaagaaacagggactggttccattcagatgacgatcatcagagatgcgaaactctgaaatctgaatgatcacagctctgcatttccatttccagatcagtattcggtgtcatcaggactttgatcgccatggccaacctaaaacattggacgtttacagcaacaggacaaacaccaaatctcgtcggcgagctgcacttgtttgatccctgcaaccctctgtccatacaacatgtactcattcgagcaaggagagcatcggaagataatatagagagactaacatgtggtaccataaaagatactcccataaatgagatgttaagtattcccttcgtttcatattataagtcgtttgacttttttttaaatcttttttaaaaaagtttgattaagtttgtagtaaaatataataacattttcaatacaaaacaaacatggtatcaaaatatattcaaagttaaatataatggagctaatttgatatcattaatattgctattttttttctataaacttagtcaaatctaaaaaaaattgttaagaaaaaagtcaaacaacttataatatgaaacggaaggagtagaaaatttggtgaagtttttattagaataaattttcaaaatctattaagactgtaatttctagatcttttggttccaatcaaagcatatagatccataaatggacctattaaattacgatagtcttttttaagtcaaatatacgtacataatttatttaatctttgaaccaacaatatgagaaagaaattatcgatgatcggaattgtagaagtttcaccaaatcttatcataattatcaaatacttattattagagagagtaatatgataataagatatattattaaaaaacaggataaatatttctctagtagtatgtgatgaatttaattgatccgtgttaaatcaaatcattttgttttttttatttccctattctgatttttgtcgcttggccgcaatttgcgctgttgaattcccccctcgagatctcctctcatcgctgctttgaacggtaccgtctcgccactccactcctcacacgcagagacgaagtggacacggttactataactggtagcatctcgccgcgacgcctgcactgctcggctcggctctcactgcggccgatcgatcgatcgatcgaatgtgcatggccgtggaggtgaagcggatcgagtgacgcggtgggggcaatggcaatggcggacggcggcggcggtagcaaggcgcaggcggtgagggaggtgtgcgcggcgtcggcggcgttctccgcgtgcacgcaccggcgccggcagcgatccccgcccttcgtcgactggtacctcgtcctcgccgtcgccgacgccgccaccgaggacgccgtcaggcgccgctaccgccagctcggtgcgtgcgacgcaatgcaatgccctgaatcggattacctgattttgatttggttcgatttgatttggtttggtttgcatgcagcgctgcagcttcacccggacaagaacacgcacgcaaaggcggaggtcgcattcaagatcgtctccgaggttggtaatctctgcctccgcatgcttcttcttcctaatgatggcttggaatctttgccttttttcttgctttcaatttagtgggtggttgcattgcattgggctcctcttcttggagatatggtcaattttcgatcgccgccaccatcggttactgcagcggtggtcgcccacagagcggcgttttcaaatcgatttgaaactttgaatcctcgtggttaacgtaacagtgattaaacgtggtgatttgctacagtttttactgcctcgtaattagtagtactaattctgcaaaaaccgtttcgtttcgttgcggtttctgcttttgatgcgacgatcaaatcgtgtaacgtgtgcaggcgcacgcgtgcctcactgacggggctcgccggcgagccttcgacgacgagcgggcggcgagctactgcgccgcgtgccacgacaggttcaggcaccgcgcggagaggaggacgccggcggcggcgacggccaccggcggcgcgcagcacgggaagcaccgcggcggcggcggcggggggaggaggatgcccgtcgcggcgcaggcgctgcgggaggtgcagaaccggctccgggacgagtgccgcgtcatcgacagctgcctcaaggccaacggcggcggtggcgcgcggcggcggcagtcgttcccgctcttcgacccctccgaccggctgcggttccccggctacccgcacacccgcccgcccccgccgccgccgttcgccgcggagttctgccggttcgaggagaacctcgccgccgatcggaaccagagatggtgcggcagcggcgccggcgagtcgccggtgtatcagatcagaaccgcgccggagcgcgccgcaagaacaaagcgtcattggtgacggacgaactcctgctagtgacattgcagatttattagcttccattctctctcaaagaatcgtttacattttcagattgcttagctttctttagttcattttacggcaacaagaagaggaaaacagtgaaattcactaaaagaagtttaataatatagtccactgtccactgctagctccaattcatctatagtcaatctaatagctaactatactattaatatacgatcccacctatcatatacacactgcgtcttgaagttcgtgctgcagctagctacatatctacagtccgctgctcttatctcttatcttttttatctcattaaaatatgtttatagctggctaatagtttactattgtacctgctctaaatactgctctaaatactgcccaggttttgaagcatttgtaagtgttttgcaaaaatcgttttctagtattaaaaatgacaactctatgattaaggcatccgttttctccaagatttgttcaggtcagttgtcaataaaattatcaatcgcattcctatgcagaacaaacacggccggagaattcgtatcttgcagtcataccaaaataaatgcaattttactgtaaaggtacataacattacggagagttaatactcactcactggtgacagcagtagctacactcttttaacaggtgacaaaattgctccgcagaacatactcatgttacaaaaaaaacatccaacacagaagcacggatgttcgtctgtcgatttctcgtattgctgtagatgcttggaagtcaggtgcaaaactcatttttcgactgctttatggtctgagattttcagaatgccacgatcaaccagcggctgcagctcagcttttgcaagatcccttaccttggaatcgggcgattcaaggaatgctgcgaccaccttggaactgaataaaaatatcaagaaatcaaaaccaaaatgttcatcaggcagaacaagcaagctgagagaatatcagaaatttacagtatgcatgataaattagacaatgccaccggaatatgacctaaagggactggtgtcaaattccaatcaacgattgaattttataaatatccgatgaatagaacatatctatatgtgactcctggaaaacatgagaagaggcgagagggtcatatcaataaaaatcgaggtacctgtgcccatcagcccatgtcttgcatttgccttcaagagcttttttccataggatggcagcaaatgctggagattcaagtataagtcttctgattagacggctggaatgatagttatcaaaggcatgttcagtatcttctgcctttggacgtgctgcatcagaagctattgcattgtgcaagctgtggatcctgtcagtgatgccctccagaatattatcttctccaccaaccgcaaccttcagatttgcaaatgtcaacatatcagagtgacaccagtggcacttatgaaacattatttatacaatgacaacaatcaagcaccgcagattggcaaagacacgttgcttcaatattccagattatgactgtgtatcgtatttcactaactcgtttgtgcctgatatactacgaaagggtattcttggtgcaacttattcaaatcatgatttccctgatacatgattcagtaaacaagtgaccgatattcacggaaagaagagtaccagccaaagatcatgccatgccaatgaggttatgacatgaaaaattgttagcatataataaaaagcaggtttcaccatctgcaaggacaaaagtagttcacctcatgcaatacatctttgccaaaatttgttcgaagtaactccccgacattctcaatgagagtctggatgagcacctgagaaaagatcaggaaggtctgcattatattaaatccacataaagcatattcaatactttgagtcacaagtaactctatgctgccacgatggcatctagatattatatctaataatcacaaaaagaaaggcctatgagcaaggctagtaaattcatcacgattaacttatgttagttgtcacgtcagcactaattgggcaaaatagtgggcacacaagaaaatacagtagacccttattgtaagtgttgttttccagttacatacttgaaaccttgcataggaaaatccctaatggaccattttgccatcatttatataataatattcgtgagcacacaaaatgctgtgcatgttggtattatggggtttaggacatggtgggcatgtagctatacatactgtgactggctactgctatgcgactaaacgagcaccaaagaaatcatattgtaccctactgcagtaatcaatgtgaaaaggtgcatccttttaacactgtatttgaataaacatagcactgaataaatgtcacctcggcaagttcacttttgatcaacaattcatgtcgccgttgaaatgggtcctttttgctgtcagacgcactctgcatgctttctgaaccatcttgctccttattagttgcaacatccaccttattctctgggatatcttctgcagcactctcggaagcttcatcctaaccaaaagtggaatatttataacacagcacttcactatgttctccttaaaatactaaacagaatagctagcttgcctttgaaataagagaaggcacacgatagttcagacaagccagatcagctggaggcagatagcgtgaacaattagggtgaagtagttgcagcaatggacgtcttccattctgtaccaacaagaagcttcattactattagtgcattgtggatttattttgaaaaatatcagaagctcagttttccttttcaccttgtcaaaaataagttgcttcaaatgtttggcgagctcttgaattacgatctatcaaatcaaacaaaagtgttatataaatgctccatacgatatttatcacagcacaatactcagaacaggtgcatagaagactggagctagctaaccttggtaacaagctttgtgtcatcaacaacggaaagaatggcaacaagtaactgaaagggaaaagatgacatatcagtagagtataaatcatttgagcacaaaataaactgaaatcttcggtagcaaaaaagttctttcacatataacaattttattcataatgttgttttcaccaagcggtaactgcaaatgtaaacactggcatacttacaatgcatccataatcactaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8146 - DNA, 728 bp, Oryza sativa
tagtctctgatttgatctcaccagcgatgttcaattgttgcgactgtccttgaccagcggaagaagattcaccaatttggagtggcctgatatgctgcctctggctactaccttgtgcctcctggaatacagtcattctccgtttacggttatccatcctgttcttcttgtcttcaagtcgaattgctttgtcaaccagctgctgaaaatcaacatagtcatgggagatcaatgtaactgacagttcatccttcaggccttccaggaacttctcctgcctttcttcgtcagtacgcacatcttctggagcataacgtgccagatctattcgaagttcaaatggataaaaaaactaacttcttcgtacataattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaagactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaataacaactattcttttcatcactcctcagtac

SEQ ID NO: 8147 - DNA, 1079 bp, Oryza sativa
gttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 8148 - DNA, 455 bp, Oryza sativa
ctcggctctgtatgcttcgggttagtcccaaattgcgtcgcttactgctgggaagcagtccttatctctccccacacctccggctcgaggccctctgtggttctggttgtctgtaggctgtctgctctgtccgtcggtcctgctcctcactccgagtactgtatgtaacctccgaagatccggagttatacagtaccccagaatctaccaaacaatgcgcactaaaacttactaaaccttaccattcgaaaaccttctcggctgcctcgggggttagacctgttcttttttgctcactgtataaaaagtctctgtaacgtacacgcctcaattttctaccatgagaaacaattacctcgggtttttgcccactgtttgtcgctctgtgttgcggttcattgcttctgggattccgattgcgttcttgggtgtttggtccccaatcgcctctgggt

SEQ ID NO: 8149 - DNA, 660 bp, Oryza sativa
acctcggctgattcctggacgaggattttatgcccaaataaatttggaaattactagtaatttcccggccgtaaccttccttcttccgcttggcagccgggtgagggcccttcggggcgaacccgcgggatagcccgagggggtgacgccatgccccgagcccccccccgcggtttcacgactcgcgtgaacccccaaatggggcttacttggcaagtcacgtcgccggaaggaaagtaaccctctacttcacatacccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttggtcaacttgcgctcataaccggtgtgcactccacctcgagtgtgccactgacagacgcactaaaggcgggagcggatacaacgggcgacgtgatgagtgggcgcaggatg

SEQ ID NO: 8150 - DNA, 58123 bp, Oryza sativa
tttgctattttgtgaactatgtaataattggttgtagctcgtttgagtaaaggccgggatatttgattctattatctaaaaaaaatcaaaaaaagaaattctaccgtagttagcctattgggtgtgtttggataatggaaaataggaggtgggattgagattgagaaatgaatatagggttaggattaaatggaagaggaataatgaatggttaagatttaaagatatcttttggttggtgggaattcattttctaatcccattagccaaacaccgcaattaggtgatgtttctcatttaggtataatccgtcagaaaaaaatagcacaccgtggatgggtaataaaaaggaggcaagtgttcaagttcaactagttttgcatcttcctaacgccgtacgaagcaaaaagggaattcatccacaccaaatccacatttgattaagtgtggtgatctgaaaaggaaaaaaaaattcacactgactcccttacaccaaatctaagggagtccgtattagattcggcctacttaagggagtcaaagtggactttttccatctgaaaacaagtcgccgctgttcgttcacactgcagcttgccaggtcgccccaatcaaagcccaccagggcaagtaaagccccaaagacaatgcaggcccaaccctgcggccgcaatagcaatcctgctcgagcacggccagctctcgtttagtaccacctcgataactcgaggcgatggaggcgggatggtggatctaagtggagtgtgactgtgtgagggagaggtgctggacatggatgccggcacggtgcggtgcgcggcgaaccacgcgccgctgacgccgatcagcttcatccagcgcgccgcggccgtctacggcgaccgcgccgcggtggtgtgcggggagaggcggtacacgtggagggaggcgcgggggcggtgcgtccgcttggccgccgcgctcgccgcccgcggcgatgtggtgagtggaacaccaatgctgctagctcttttagcttatcgtgtgcgcgagcatttgctacttagatgtttcttcttttgaaccaacaaggtaggaagtggcggatgcagcttagatcgatggcccgaaagtttttggtagaaaacttgttaagtatgctaaacatatagtttacgagtaatatttccgctaatctttgccatgagcccatgaatagttgaagctagataacctcacgtcctcgcggatcttctcctatcagtactcttgatattaatgttctctctatgcatcagcatgtaaacagcttgattttttgttttgagaataaacagcttgattcagttagcgataaagcttctgcattgccgcgtatacttcttcagttagtgggataattttaccttgctgctaatatcctcgtgcattgccgctatttatatttttgcaacgccagttataaatctgagtctacagtctactgacaccgagtaatagtagcgaagtcatgaaaactctcgatcatgcgaatggccttctctgcagtttagatctttcacttttatactttcagtatgaactgcgaagtaatgtggcttccatgcaaattattggttattcggagatccataggaattctggagaaaatggtaaggattttaggtcccactcacagtccactccacctcttcatgttccttggtcaggccactcaacgatcgaaataatttcgacctgatttaatcatgggtcagtctgaaaactaggcccaggcgtatgacccacattgtcgtgtgtcccatgttcaggttgctgtcctgagcccaaacgtgccggctatgtacgagctgcacttcgccgtgccgatggccggcgcggtcctgtgcacgttcaacgcgcggcacgacgcggccatgatctccaccctcctcagccactccggcgccaaggtgttcttcgtcgagtcgcacctcctcgacgttgggagagccgctctgaggcgcctcgccggctcaaccagcgccgcgagccttccggttctcctaaccatctccgacgacggcgccggcgcccgcgactcgggctgcgtggactacgaggatctcgtcagggacgcgccgtcggagtttgacatccggtggccggtggacgagatggacccgatcacgctcaactacacctccggcacgacgtcgcggcccaagggcgtggtgtacaaccaccgcggcgcctacctcaacaccatcgcgacggtcctcgcgtacgacatcaccgccatgccgacgtacctgtggactgtgcccatgttccactgcaacggctggaacctgccgtggggcgtcgccatgcagggcggcaccaacatctgcctccgccacttcacggcgaaggtcatcttcgacagcatcgcgcggcacggggtgacgcacatgggcggcgcgccgacggtgctcaacatgatcgccaacgcgccggccgcggacaggagggctctgccggggcccgtgcgcgtcatgacgggcggcgcggcgccgccgccccgcgtcttgctcgccgtggaggagctcggcttcgtgctgtaccacatctacggcctcaccgagacgtacggccccgccaccgtctgcacgtggatgccggagtgggacgcgttgccggcgaaggagcgcgcgcggctgaaggcgcggcaggggttccatcacatcgcggtgcaggacgtcgccgtcaagaactcggccacgatggagaacgtgccgtacgacgggcagacggtgggcgaggtgatgttccgggggaacacggtgatgagcgggtactacaaggacatcggcgcgacgaaggaatccatggccggcgggtggctgcacagcggggacctcgccgtgcgccaccctgacgggtacatccagctcaaggaccgggccaaggacatcatcatatcgggcggcgagaacatcagctcgatcgaggtggagtcggtgatcttcagccacccggcggtgctggaggcggcggtggtggcgaggccggacgattactggggggaaacgccgtgcgcgttcgtcaagctcaaggatggcgccaacgccacggaaggcgagatcataagcttttgccgggagaggctgccgcattacatggcgccgaagacggtggtgttcgatgatttgcccaagacgtcgacggggaagacgcagaagttcgtgctccgggagaaggcccgggccatgggcagtctcaccaagtctgccaatagtaaactgtaatatcatttctgttgttggacattggatgggatgccgtagtatgcagagttccaaagattattagctgattcgaggggttttgccgatttttgtcattaccactcgaaaacctgtgaattttgaacaaaatttaccgaacgtctgagtttaagtttggattttttttaaaaaaaatgattaatttatcgagtggtttttcaatttatactatgtcagctggcaggttgccaccaatccctgtggcaaaatttgatgttggccaaatgacttatttatcttagtggcttcaccaaaattgtgcccatcatgtggctcctattaattttactttcagtaaattgcatattggagctggtatttttacctaagattcaccatgaaccaccctatccttgatcttttcactttaaacgagatatatttaccaatactatgtattttgaactagtggcgccaggggcggagctagaacgaaatgaagaggggtgccactcacttgttttactctactttatacttatataagtgtctaagtttgaattgagaggggtgcacatatagtgaaaataaatgaactatagctaaaaagttttcttgaccgggttcctgggcacccccccctctcctacctagctccgcccctgagtggcgcactactccctccgtcccaaaataagtgcagtttttatcctgttcatatccaacgtttaaacgttcgtcttatttgaaaattttttatgacggacggccaaacgttggacacggatccacggctgcacttattttgggatggagttagtaccaattagtgagaatagaggcaataatgaaagcaaactccatggagagggtgtcggcaatctcttcctcttccacacctcgcaagcttttacttcgacgcctctcttagagcatcaccaatagttcccttacttcacccacaatcctatttttttagattttggtgaaaaaaaaagtctccaatagatgtcctatccggatccttttttttttggaaaccccctccccgcatctttcactctcttcattcgagggagagagatggcgcgtctgccgtccccaatctctcattcgcgccagatttttctcagtgaggagcgcgggcgcacgtgagtgggaggaaaacggaatctgatgttagtttaacaaaaggatcctttttaatttttggaataaaatttagatttctcttggagatatcagttttttcgctacctattttcagtttagaaaacccaaaaataattttttgggaaagattatacgtatctcttggtgatgctcttatcgccccaaacccacaaaggccttggattgagctttggggcaagaagagtaggagataagataaggatagaaggtaaccttggagccacgaattgaagaaggagctttaggaaaagagcatgtgaaaaatgaaggcgttggattgagctttggggcaaaaagagtaggagataagataagggtagaaagtaaccttggagccatgaattgaagatggagcttaggaaaagagcatgtgaaaaatgaagaagtagaagatagaagtgagaaacgagcgcagcttcgtatcagtgcacaccgaattcaaatcgctcgatgatatctaggaggggatccaaaaggtatgtaaagggagcgagacgaagacaatagtgacggacaattcaacgaccattccattatcctgtagtaatagcattcatcagttgaaaaggccgacattaacgtacataacgctgacacaattctgcatttctagcttgctctgaatagttgaatattgtccctctgtctcgatcaaatgctcttggcatttttccattgcgccaactggaagtgctttcgaaaaataattccactagcatgatactcattgagtgacccgtgatgtactacgtattctcagcgtctcacacctcctgcgtttcgtctttaatctaaccggagtgcacacatcaagtatgcaattaattaatgcacgcgaaagaagactgactcagatggagaacaacgttttggtttagtgttggtcatccgtttaattatcctccaactcactttggacaaatcggattgcattagttgcaattggttcttcttcagagaggctaattagtgtgacaaatcgatcccgattgctggtacacgagctgccatggaaggctgtatgccgagcgatgcaaactacgcgccgctcaccccggtgagcttcttggagcgcgccgccgtcgtgtacggtgaccgcacggccgtcgtctctggcggcagggagtactcgtggcgcgagacgcgggaacggtgcctcgctggggcgtccgcgctcgcgcgcctcggcgtcggccgccgggacgtggtaagtgatcgaccagagcttgatgcctcgatgagctttgtacttggtgccaattcagctctcaacaagacatgggttaattgctggtcaggtcgccgtcatcgcagcgaacattccggcgatgtacgagctgcacttcagcgtgccgatggccggcggcgtgctctgcacgctgaacacccggcacgacgcggccatggtgtccgtccttctcagacattcggaggccaaggttttcctcgtcgaatcgcagttcctcgccgtcgcccacgacgccctgaggctgctcgccgatgctaaagccaaatttccccttgtcatcgcgatctccgacaccggcgacagcagcagcagcgacggtggcgggctagagtacgaggcgcttctgagggacgcgccgcggggcttcgagatcaggtggccggccgacgagcgcgacccgatatcgctcaactacacgtcggggacgacgtcgaggccgaagggcgtcatctacagccaccgcggcgcgtacctgaactcgctggccgcgctgctctgcaacgacatgacgtccatgccggtgtacctctggaccgtgcccatgttccactgcaacgggtggtgcatggcgtgggccacggcggcgcagggcgggacgaacatctgcgtcaggaacgtcgtgcccaaggtcatcttcgagcagatcgtgcgccacggcgtgaccaacatgggcggcgcgcccacggtgctcaacatgatcgtgaacgcgccggcgtcggagcggaggccgctgccgaggagggtgctcatctcgacgggcggcgcgccgccgcctccgcaggtgctggccaagatggaggagctcggtttcaacgtccagcacgggtacggcctcaccgaaacgtacgggccggcaacgcggtgcgtgtggagacccgagtgggacgcgctgccgctcgccgagcgcgcgcggatcaaggcgctccagggggtgcagcaccagatgttgcaggacgtcgacatcaaggacccggtgaccatggcgagcgtgccgtccgacgggcgcgccgtcggcgaggtcatgctccgcggcaacacggtcatgagcgggtactacaaggacgcggcggccacggagaaggccatgcgcggcgggtggctgcgcacgggcgacctcggcgtgcgccaccctgacgggtatatccagctcaaggatcgcgccaaggacatcatcatatcgggcggcgagaacatcagctcgatcgaggtggagtcggtgctgttcggccaccacgcggtgctcaacgcggcggtggtggcgaggccgaacgaccactggggcgagacggcgtgcgcgttcgtcacgctgaaggacggggcaagcgcgacggcgcacgagatcatcgcgttctgccgtgcgcggctgccgcgttacatggcgccgaggacggtggtgttcggcgacctgcccaagacgtcgacggggaagacgcagaagttcttgctccgggagaaggccagggccatgggaagcctgcctatgcaaagcaaatccaagttgtagtcttgtactattgtactagctgcgattggttttgctgccaagatgacagcgccctgcacgactactccgatattttctgatgatacagtatttgggaagaccaacacggatgttgcataaattccgtgttaaaactgagtcaagtgcagcatcatgtaggatgcacttaaaagtaatcataaaaaagaatataccctcttattcggggaaaatgaggaatataccctcaccgtttttaaacacaccctcctccacttatatatgagttggttaattcattttagtgaactatccaacgtcatatataaatgaaaggagtgaatgcatgacatggacttttgaaaatgatattgaaccattcaacttatttagaaacttaatgcaaatatgtaaaatatgtcatgcttaaagtatcttcaatactaaaaacaagtcgcaacaaaaataatgatatcagaaagaaactagtactagtttcgagcatttgcctgagacttgctaagatcaattttgctttatgcaaggcttgaagtgtagatggaagattggaaggtgggaagtccattcatacttccgcatggtacattatatatccatccagaacatgtaacgcctataacaaaaacatgtgggatctttttatttcgaataatcctatctaatgaatattccttttcagatgcagatcgaatacaatacatcgacgttttattcaagcagccgtacaagtgccactcatcctctaaagaacagagtcaaaactcaaatttcaaagctggataaaccagtcatcaaaatctaagttacgacaacaatcatatatcgtatacaacaatcatagatcgtagagaactctttgaaatgtaccatctagagttgcagtagtctccaacatcaaaggaaacagataatgatcaacaccatgtggaaggagataacagacatgctccacatggacctagcgaactgcgacctcccagatcctcctcctgcaaaatcaactattagaaacctgccgtttctttaactcaaacaaactcagagactctgagtttgtacaggtttgcgggctcaacttactctggcaggctgttgtctgattagttgcaaggctggtttgtatgatgagcgatgaactgttggagtaaccactgtaggcgcacgttgttgatccgcaaccggtgccgttcgtctcaccaagcttcagcgttccattgcacagtggcactgacgggcatcccttgttctgtactgcagtgcagtttagcctggttgacacagtgaaaagaaatgtaaattctttggttactgcttgatcagaaacaacttagaaggagatggaaataataggggagcatactggtaggtagttgaactgcagctgcagcggatgcagtttcctgcggtgaatccataggtgccatccgggaggagcatcagattgtgatcagctgaggtatcgctgattgatgaacggcacactgaggacaccagttttccagaagttagtactaggtctaggaactcgtttcatatgacattcttaccgaagaaagtgaatagtagtaaacatcaagatccatctaagatagtactataatagtatattttgaaaccttgtgagtagcgagggtcaactttgtggattggtattggtagtttattccgtaattttaaaccacaaagtcagatagtttgtccggtgatagcaacggctaactaattatacaagtccaaagagtgcaggaattcaagctctaaagcttaaattcctcaacattgcgatggaattttgtggctttctactcatgtgctagtggagctatgtgtcatgttgtctcaatctctcaacgatcgaagcatgtgcagctagctatcttttcttgagagcaactttccgagtcacaaccagatattttgattctgataaactccatcatgcaaggggaccatagcctaagttcattgcaaataccactgaatccgagcaatatattatcagcatattgcaaataatttaccatacctaacctaagtttaatatgcaaactaacagaacaacacagctaatcttcagtctccccagtcaaccatgtagaggtagtaatacgagtaaggccgtgtttagttcgtgtgctaaaattttcttgaagtatacggacacacatttgaagtattaaacgtagactaataacaaaacaaagtatagattccgtatataaactgcgagacgaatttattaaacctaattaatccgtcattagcaaatgtttattatagcatcagattgtcaaatcatggcgtaattagactcaaaagattcgtctcgcaatttacatgcaaactgtgcaattggttttttttttgtccatatttaatgctccatgcatatatccaaacatttgatgtgatggaattttagaaagtttgaagtgaactaaacacctgcctaactaattcaagtttcttctcttatagtactagtaagactagtctactgagaaaattcactgttaaacaaaaaacttctgagctcgatcacaagattgcaagaaccatactaaacagtaacagcaaggcacgtaccagggagcgggacatctagaatctgtcccatctgcaatttcgtggggtcgtcgatcttatttctggtgagaagcgtggactccgtcaccccgtacttggcagcgatcgccgacgtgttctcccctttgccgacgctgtaggcgaggtgcatcacgttagagccttcctccttgtcgcagctgcagggcagcggaatccacagcgtctggctgacatttatcttgttggggtcggggatgttgttcgcggcggcgatctcctggtaggtgacgaaggcgttgaacacgttgcgcgcgatggcgtcgagcccgtcctgcggctgcacgacgtagatggggaggcggtccgactggccgacgtcgccgttgcagcggcagcggaaggggattttgacggtggaattggcggcgacgggggcggaggaaagcgtgccgtcggggaggccgttggcgccgaggaggtcggggagggtggtggtgttgaagcgggcgacgaggttgccgtaggtggtggcgttgggggaggtgtagaggatggcggacttgcaggtggtgcctgaagccaccgcgcaggtgaagttggcggcggaggcgggggcggcgaggaggacgaggaggaggagggcagcggccgccggcgtggccagggcggcggtgagcgacgccatggtggggaaagctctcctcgagaggtgggaatgagaggcttggtgtttgtttgactgtcgtgttgacactggagcaggaggagtatgcctcgatgctagtgcttgtggcgacttaaatggttgcagcgtgggcctttccctatcctttggttcgattgcatcaaagtagaaaatggtgaacttgtgtggaattgattggtttgagtcagacttggagaacaaaaaatcactgaaatttcaaaattaccgatggaaatttgactacaaacgttagccatgcatgcagcttagcgtcttcaaggggagcttgactacgctaagactttggcaacccaagtcaggctaattaaattgcacaagaggccaatctggacttcaaagtcacaaatgtgaacgagtagcctcgtccacggcagcacacttggatacaagcaggacagacaggccggagctggatgcgaggaaaatggaaacagcagggcgaagttgacgtctcttcgccacacaaaccaacagccaaacagaggtgtccacatcgcaaggcaatgctaaaaaacgcgtggatatcattgagagctttctcctccgttatttatacggagcttttatgcaaaaatgcacatggataagcatagagacaatatgatcgcgagccactgattatttcgcctaattgatcaaacagcagtccggaacgataaaacgctaagccgcggaaggaaaacatgctacgaaagaatgaatgaaccaatgaacgcaatactgcggttgatcccctttctacaaagaatgttccccttacaggcaaaattggaaacctatgcagaaaagcttctcttttgtactggcacaggtatgactcattccagaggcgaaggaggcatgcctggtggatcatccgaaggtggagctggagatgaagcgctgaagtcaatagttgggtacactcctggtggcctttcgacaggttgtatcgacagaagttgtgttgagtctccaacgacatcagcccatccgtaatgaggctccgccctaattgacaatgcacagatcaacgccaaattgtaaatctgaaaatactccgaagatgtctggaagaaccaaacaagacataatcttactcgtagtacgtctcctcatcaactaccaaatcccagctctcgccagttgtgctcttgccgtatttatgaacttttctgaaatacaagagaacaacagtatctaagaaagctactactgtaatgccaggtagtatcgttgcaagaagaaccattgcagaatgacatatagtgtattagaaaaggacaagcccatgtggtttcaattcatttattaatgtcaagtgtcagtcaaaccaaatgcgagaccagcgtcatgatggaacatacccattaccaaaatgctcttctccccaagttcttgaccatcctgaaagtatcaaatcagataagtggatggcaattggaaatcagataagtcataagtcacactacgagcggtgcacacatttaacaatgcaataaacaggatctaacttctaaacctgagtatgcagacagtagatacagctcatatataaaagcaacatgttaaaatatccagcatagcttccaatagattgcaccagtgtgaatttcggccaatgcagcaggcaaactttttctatgcatcaaaggtccaaaggtgcttagcatttatgcctaataccagcatccaaagagaacaaagcccatcatcaaggtggatactgtgcatatatataaatgacgatgaaacttacgatctccaccaggggatacatgccatgtctccccttgtcgagaaccaattccagcaaagaatttctcttcccatttgtccccccatttggtgcctaagtctgtctctgcccacttatctgtcctgtaatacaaatgaattgcagtggttaccaattaacatacatcggatgttccaatcatgattgaacaggcaaataaattaaaagtataaagaacttgtgcctcaaatatgatgcacaatgtaaatgcacaacctagactacaaatttaggccacaatgcgcgcagcataagaaacatgtaatacaatgtaaagtgtatggtatagtgcttgaagataaactaaagtacagtataacaatagtctgcaaaatagcactatatatataggctcaccatttcaatacaaaaccccggccatcataatgttcaccccacctctcccaccaggattgttcatttaatcttccgtacttatgagcacctttttctgtccagcctttggcatcatatttctcccacctaggaaagaaacatgaacacttcaacagttcaagcaaatattttgcagaacaattgcaaccaaacctaaacgaaagcctgagataactctcaccatttttcataccacccagcattttctgctcctgatttcgcttgcttttcagcgctcctctctattcttgcaagattgctgtttgcacaatgtaaatcatgttatgatctacagtttacaatgttgtgctagatggtcatttattaactaatctatactttctatatagttggtacccactaaagctaaagctaaacatgcaagcatgccacatcatcatccactagccattactattctaacccatttaaaatcccatgcaagcatgccacattttcactcactagcaattactattctagcctattttaaatcccatgcaagcatgacatatcatctataatattatattatagagatcaacaagtatgtatcaaatcatcttcctcatattatttttttaacatttcaactttcatcatttcgacaatatttaacatatactcattcgtgaatcccgcagcaaagcgcggggtatcacctagtttgctttaatttccctatcttaaagagaattcaggacctttactcaaaagtacagatcattatgatcataacactaagccagaaatatattatgtgcccagtatgtttagaaattagaactactctctgaacaggataatttatgaatcagcactgtgattttcactggatattcgtgtcaaatatcccaatccacaggagagcttatgctgttttggttctagacagttattgttcaaactaaattgaacaatcctaaagcagttgagcccacagaacaagtttccttcaaacaaaggtactagaaggccataagaggaataagaaaataatgcatgctaatcgataattggtgcacatatgatgtgtccaaaagtccaagttgaagtgtatagccatgtctggtaataacagtcaataatgtgctaaatttcaaatataagtaaatagagcatggatatatggtcaaacaaaattgttccaaacagacaacaagaaattgcaagcgccaagcgcttaacacaatcaaagttctttgttcacagaagtataaccaaggggtcaacaattgtcctcccccccccccctccccaaacaattgttttcttcagcaggcagaaacaaagaacagtaaacttatttttggtgacaaaattagttaaaattcagtggagattatgtatttttgtattatttaagcaaggagctagtatcattaaaaaaatgaatttgcatgctaataatttacctccattcatcttggtaaagaacttctttccatttctcccaccaagaatcaccttcaccattctttccagacttctccgcacctaatgtgagagatttgtaatgaaaagtcaacgacggctgatcagatatgcaaaaggaaaagggcacacataaataagaaaattaactgaattcttaggaaatttaacaacaaattacaaagaccatttgctaccagagccttcattataaagatatgttcatacctaactccttatatccggtccaatcacttttctcccaccactgccacataataaattattgagatctgttagaaaaaatctttttaacaactcaagaattctgtccagcattgattaatgtgccaaaagagttagctacggcctatgaaatcctgggagattataattccaaatccctattctcagtcaagtaagaaagtgcaagttggatctattgcagagtgcgctatagctattggaacaagcacgaagcaacttgcaggatggcagacatatcttcgattctaactagtgccacaagcatcaacaacagctcattagcatcagaagttacataaagaagtcattggaatataatggctacatcccagaaatcttttctagatccttctcatacgaaaatgtggtgtttgcacaaaactgagatggtaactcttaactcaggtgcatcatacaaaggtatacaacttgataaatttgtactagaatattatcagttaagggtaaaacaacaagaacataccgtctctttccattcagtggtaccatcatgactctgtcctcccatcctagcccagcgacacctgtacccattatcaccacgatcgtctccactctccctgtaccaggtgcttccatcttcatttgtcccagactccttgactgcttcatccagaaggttgattccccattccttctcactagcaataccagtgtctataaggcaggtggcaaagaaaacaaatgcatttccttagcaaagctgaaaaatacacttggaactgcgggtcgggtgtttccttttggagtacactatgtctatcacaaaatttggaagtatcagcaaggaacccacctctcttcggcggagtatcacgggattgaggagctggccctcttggcgtgcaccgtggatagaaattctgttgtttccactgcctcctagaactatactagtgaaaacaaagtctaccatcaaaattcattctctgaacaaagagcattcgtgcaacagcagaaaggtacggtttattccactacataaagcgtgtgtcaaaagcattggcacattaacttgtcactacgacaattcagcataaagcaaaaaacaatccatatgttggaatgattagacaacatgttactgtaagtggcaaatgcgaggcctgactggataaggcagaaaaatgggccatgttcagtgacgagccgccgtgcacgtaccgaggagaagggaaggggagtgacggcattgcggtgaggctggcgcgacgcctgccccgggcggcagcggcgggcttgttcccgtcgatgcgccactcctcggtgcgctccggcgcggccgccgcggccttggagaggcgcctccgcggctcctgctgcgcgcggcagcagcatcggatcgcgcggcgtcgcggggcggggcacggccagtgcgccgcccccctcgcggtcagatcgaacggccgcgccacgagccccctggagcacgcggccatcttctcatgccacggcgagggcttcaggagcggcggcggcggcggcggactggctcagtggcggcggtggtgggagcccggaggcgagggggagggttttaaaggggcggtggcgaagagggaaaccgcgggcatcatccgaaccagcgagagagcgattgattgcgaatcagctcgcggaaatgaggagacataaatgagcaagccttttttttcggggcttttatttggatttgtttaggggtgggagatctttgcaggtgggggagaggagtggcgatgaggaggaaggagaagaacatggggcttgggaagaagacgaaggatgctggtgggtcccgcttgtcggtgggagtcaagattggcagtaatcaggaggggaccccccgatgtgggcccaccgcaaggatgccaccgtgtgctaagtttgtggtgatcggtacgcagggagccgcacggtcggcccggcccaacaagttggccagcctctctcccctactcttctggaaactaatgaaaaaaagcattttattttgtttgtgataattcacacactttatctgaaaatgcagtttaaaatcggtagtggaatcccaagacgtgagctcaaattgttttggcactcctactagaagaccccgtcccatgtcttgtgctgcttgtgtctcacgcacactagcaaagataaaattattattatcacgcgacactggtccctatatacgcacgttgggctttttactttgttgtaatttttaaccttaccaatatttagtattacaaatggcggtaccatttgctatattttggtgggattaaattttgatagtgtcagacttcagtttaaagtcttatgtagagttttaacagtggaagctttgggattttctaaaacttcataagaaaacaatgataagaatttgtttagtctatttttcaactaaattttacaatgctaaaattcattagaattataaatgaaaataaagtaaaaatttttaaataatagaaatggattgtatctctgatctctgcctgtgagcatacaaccaaaaagtctcaaaaataaaaagaaaagaacttaagaaaatgtgtgatgggttaaaccttcaacttctgacaataagatggtatactaaaataatgtttttaaaatcatatatattatatcataaaattaaattccataaatcacgtacgctaaagcatagtatagcactgatcacggatcacatggcctggtctatcttacgtggctccacgcaaagtcacagcatgtggacaaaaagcgctcctgtcccaagtggcgaccaaccaggcggctctactgaacccgatcaggaccaggccagagaccgtcgcgacaaaaggctacgtggaaaagcgactcgcgtgtctagcggccacggatcgtccacgtcacgcgcacgcgagagtgaaacggccggctcccgccacaagcgcggccaggtgctgaggtaactcgtggctcagcgcggccggtgcagatggcgcggcgccgtggaacatgtctcctacctccccggctttggatagatatactggataagcattgaccgtggagacactgacacggtgacacgcgtgttaccgtcgagaattttggaggctatctacgcttggctgtggttccgcgggcctctgccgtggccatggcagcttacgttgttgtcgtggaaaagtggcagcatctatccagttaaaatgttttgtgtcatccaaacgtttattttagtaagatttattttagctaggtagtggtgaaaatataaagcataatgaaaacaaaacttcaaaatcatttaaaaattaccatatctgtatcttaatataagagattttgatattttatttatattgtttaaccatttatcttattaaaaaatttaaaattattattattttatttgtgacttactttattatcaaagtactttttattatcaaagtacttttaagcacaacttttttttatatatttatataattttttaaaatacaatgaatggttaaatagtgcaagcaaaatatcaaaatcctttatattaagggatattaattatattaaaggatattaagggatgaaaacggtaaaattttgcgggctgataagagaggttcctcgtgactttattatgatccatgggcacttggtcagattagcccattggcaaggtccataagagttagtaggccaagactaacgatctccggttggtaggccggtagccttattgggccaaattacagcaagtaaacttacatttattcgttacagcgtggaacgacctatgcacatctttgttccggaccaaactgcctgactacacgcatacaccgtcacggcacggacacacacaacaaactactggatgtaggactggccggtgatgtcgaggtcgcggtcgccggtggacggcggcggcgcgtgcttgggcctgacggcggcctcctccgggccgtcggcgctctgcgtggcgctggcgcgcggccgcgtcgggtccctccgcccctcgttggcgtacatcccgccgccgtacgcctcccgcgtcagcggcttcatctcggagatgttgggcggctggtgctcccgctgcagctgcggctgctcgccggcgacgaggtcgacgaggtccgggtcgctcgaaggcaccttgggcttctcctccttgtcctccattgccttcttcgtgttcggcaccagcttctccatcgatcggtccctagtacgcactgactactgagctgagttgagtgagtgatgaacaacggctacgtagctgaagctatagcgtcgttcgctcttcgcgcgcctggtcttggttaaatagttctggcgttcgacggacaatggattggtacgaagtgtcgcgaacgttcgcgtgcaggcttgcgtgcgggtaaattatttgcggcgttgcgccgtgggggatccacgtatttgcgggccttgcggcgctgggcggcgcgtggagcgcttggcgcgcgaggcggggataggtcggtgcctcgtggcgcggacgtgcgacgcgcggcgggacgtggctgttgccggcggctttttagcccggcaacccacacccgctccctgcgtgcgtgaactcccacgcccacggtctcgccacgcgcggctgggccgaacaaattgccggagagccatcggcctcggccactacccaatccatcaagcccggtgccgcaaccgcaccgaatcgcacacgcaaaaacgaactcccatgcaagtagcctgttgcctaagcaattcggcggaatggcgccttgcgagctactgtgtgttccaaagtttttttttttaaactttcaactttccatcacatcaaacctttcatacacacataacttttcagtcacatcgtctttaatttcaaccaaattctaaactttgggccaatctaaacacatgctaggagttgcagcgagtgcggcgagtccgaattttcccgggtgttgcactgaagtctgggaatctgggatcaggcaaagcattaaagcatggtggaagtttcactgaaactgcttagttgatggcaagtacgtacagtacgtctatctctgaaggaggttgctgctattcggattccgtatgcttcgcacaggccactggagctccctctagccattgctattaccgttactattccagtggttatcatatgcttgattccctgcgtacgaacgaaacgaaccatgacgaagcagacgtagaagcaacatagctacgcgtccaatacgactttatttcgtacggctagtaggcccacgcgtcaaatagcaaatcacatagtaggagtattagtatatgctgcttaacaatggcactttgcagatgggccgaatctgctgcaagttgtttaacagaactttataatgtgactgtaactactttaaccttttctcttagataacttgctttaacttgtctgcccatgaggctattgaaaatttccgcaaacctagctctccctccgtccaaaatataaataattttaaataaataagatatattttaatattacgaatttaaataaaaatattataatatgttatatccacgtttaaaatctcttatattttaaaatggaacaagcactggctatagcgaactgctcagccaattgatcagggagatgaggtgtgtggtctcctcggtggacgactcgacttgaatggtcgcctcgcctctgcgttgacgagacgtctatggctactgtctctgttccccatttcagagggtggacaaccggacatgcagaggaaaatcaagcaaatctcttgtacactaacggccggcctactgactttcacgcggagtagtccaccaccaaggtctctgctactcttgtggttagtgttgagtgcttacaaaatacagtagtctaacaaagagcactgaaactgacatgacttaatttctgctggacatggacatggacatggacatggagtagtaccgaacaattgacagcgtaccatgccgttaattagttggaattgtataatcctctaacaattcccctattccaaaggaggtcctgaaatgtgtgaatgcatgaaaggatatcttcatggtcatggatttggaattcaagttattgtttttttatgtgatggatgagtagttagaacctagaggcttggaattcatactttgttcgtttgtttgtttgtaccggcacagtacatttgaaccggtcaaggaaagaacgagaaagagtggtacggtacttgactgtctgtcagtgtaatgcaaccttcaaattcactactagtttcaacaggaaaagaaaaggccgcgtgatgcctaactaagcacgttatttttcttagccaaaccacagaaaatgcatcaacgtacttcgttatgacaggcagcctatcgtttcgcttattttatgcttataaaccaaactttaaatttaaaatttagttctaagagaaattttaaatcattgagaaagtatcttaagatatctaaattctatattaatttttataccttcaggtaattattatcaacgtgaatcaaattttacatattttaccctaattttaaagttgattttgtggattttttatcgattacttttcaatcactacgaacacatatataaaagttttactataaatgattttatttagttagtaataaacagtttagatatgcatatgtataagtggtcctgtggttggcactactgaactgtactaacaagctaaggaaagtctatttatctcttgaaaggatgttctctcctttttcatgtcgcttaaaatatcactaaaaatttaaaaaatagtaagatagatcaatatgtaatatgtcactaaacaaacatgtaggattaaatttaacttaatacaagtagaaaaattaaataaatttaactattaatagaacgtacaattcatagtcaaaattattattttcgtttctaattatataaatcaaatttgaatttgcatgtttgtggaatgaacatcacatattgatttatcgtatcaaaagattttaatttttttgaagaatttttaaatgacattaaaaaagggaatatgtcctcaggaaaaaaaatccgtctcccgttgattatactctagaaactacgtctaatactacgcatgctttcatattctctttacattagtgattatatttttttttgtgagagctatatatggaaccaatcagcatgcagtcttctgtttatatctgttcaggacattcacacaggcatgcattagacacatttttccttaccaagttaagcacaagagctactagaatcatattctcatatgcatgacttcccaggcatttgcctaacttacatgttgtttatacaccataaaccttcatgcgctttgcctgttataactttaggaagtagctaggaaaactccgatcgccttatcccgtctgaattcttgctgaaattcaggaactctgaccgtttcatgaggaaattatttcatcctttctgtcctgtcagttgtgatcggtgtttgtacacataactagtaggaaccgagttttgttcaaatatttttgtcacgacccacccaatgcgtgtaatgtcgctgtcaaacagtgagaaactatataagctcttttgctcccacggatgacctaaacagctaaaaaaaagtcaaaatttaaattttcaaacttaattttgagattaattttgagatattttcaacgtagtttcttttacagcattggcttttaagtcaccaagaacacatatataaaatttttacctataaatttatttttattctctaataagctgttttggcttgtcaagaaaaaagacaaacgatggggcctttggttggtccactaggaattcgttaggttcgtcacactagtccttttcatgatgaatatgcatgcagtctttgttcaaagtcggtcaagatgaccaaaacgcgacaggcagccacacacctatagttagctagctaaggtcgaaaaggctgaaaaatttcatgtctactagtcgctgcctcactggagttctcaaacgagcttgatggctgacctccaaaacctagggcttgtttagcctttgtttagttcatatcaaaattaaaagtttggtttaaattgaaacgatgtgacgtaaaagacggaagttttgatgtgatgaaaaagttggaagtttgaagaaaaacttcagaactaaacgcggcgttagttggaaaaaaatttttgcccttacctgtcacatcggatatacagacacacatttgaagtattaaacatagtctaataacaaaataaattatagattccgccagaaaattgcgggacaaatttattaagcctaattaatccgtcattagcaaatgtttactatagcaccacattgtcaaatcatggcacaataaggcttaaaagattcgtttcgcaatttcctggcgaactgtgtaattggttttttttcgtctacgtttaatactctatgcatgtgtccaaacattcgacgtgacagcatgaaaaattttgtttggaaactaaacaggcccctaatcaccggctaagagccccattggtgccctaataagtcatagccaaagccaaacttttaattttcaaacttaattttaaagttgatgttaagacattttcaacgtagtttctttttcagcattaactctgaagacgctaacatacatataaaaattttacctataaattaatttttatctctaagaagccgttttggtttattagagaatatgaacaacctatgagaacctgctaacgatcattggtccgggatttccaatcctttgctgattgaagatctgattgttgcaatcctctcaaatggaccaaacgcaagggtgacatggtgtcgaagccacgacactgtggcttgtgactcttctttctgttatcgcacctttcatggtacagtaattctagtctcttacctgaaattgaagtaatttttcgttctgacttaactccagtctcccgtaagaaagtgaaagggaaggtaaaagcagggataaaatggaaacctcattacctgttttgctttccagatagatgttgggagaccatcaagtcatcggtaaaacgtggaactgaccaacagtttctgttctgcctgttcatcattaaattgcttagttcaaattcacattggggatgcctgatcaacagataatctctccagtcgtttttctgcccattgaaaagaaaagtattctagatgtcacataccacatgtttaaaaggtaggactgccgtgatgctaccttaaaaaagaggcaattaattagaccacaagtactactatgcacgcatgaaaatggtaatctgatggtaattacacttgtcctacttctatattgatctgcaatgctccatgatcctttgtaagtgtatcgaagatcctcggcaactttaagtccaaaaacatgtttaaaatctttaacaataagctgtttttcttaacagattagtcagacgaagatcatgctgcgccaacccttcagcaaacaaaagtgtgcaagtaaaatgagatgtggccgcctttcccggaataatacagcaagattaaccagacgttactctctcttcttccttttcttaagaaggaataaattagggtttcatattactatcattcaactttataactataggttagcgcggtatctcgaagagaaacagaaaagaatgtagtacatgacaatgacatctttaattttggaattggtcgcaatctctatccgacaagcttataccaagtccaatattccattgatgtggacatcgtatatgatctagtccggtcacagtttcgagaggctcaacaatatataatcgcctaattaataagaccatgcagtgttacatattggtttagttaacatggtatcatttaattatatgatccgatgacaaggctgaagtttattgtggaattacagcagaaagtctaattaagtatgtagatatccagcttgttgaaattttgcatggtagatcctttatgagttttctaaaaaaaatccccactgatacaaacacaatacaattatgcaacgttcacacaccattgattacatgtagactatttatctacgtggacaaaatctcttatattttaatatggaggtagtagtaattaatgacaagttatgcaaaaaaaatcacaaattaaattactcatttagacgatatcatggctaattacctccacctgttgagaaagttacattctcggacgacatgaacttcgtaaggaacacttaatttcttatgcgaatcacgaaaattctaaacgatcttaatcaagtagtaaaacatgaagaccaataaataaaccgagagaatgcctgcagaaatgattgcacttcaattattgagtaaaacagattatttgtaaaaaaaattatgtaaaacagatatcgttttcaaatttaaaactgtggaataactctcaccccagcagccaaattggagagttactcataaatattcggcacagcaaaagggaatgaataggccataatgccatatgtttcaggtgagtgaaaaatgagtcaatttgtgtgacctgacaagtctcctaatgcacactcacaaataagcaaaaccctccaaattaaatacagttaaataaattttactgttaagccgcccagattattttttactactactgaagccaagcactggagactgcactggtcgttgtcaccagtgctaagaaattgcgaccggttttctccatgaaaccgcgttaaagtattcaagcaatgcaatgcctttcttttctatataagctcgttgcctccacatccacaaccatctccacctcacctcgtccatcgtctccagtaaaaatcaagatcggcaagccaagtgcagaggcaaccaccaccaccacctggagcagagcgagcgagcgagcgagcagagcacactgtcatcaatggcggcggcagtggctgtggctgggccgtccatggaggtggagcaggacctcccgggcttccgtttccaccccacggaggaggagctcctcgacttctacctctcccgcgtcgtcctaggcaagaagctccacttcaacatcatcggcaccctcaacatctaccgccatgatccctgggacctcccaggtaaacaccaacacacagtgagagttcagcaagaacggagacagtgtttgagctggatgatctgatgatgatgatgtgtgtgtttcttgtaaaaatgtgcaggcatggcgaagatcggggagagggagtggtacttcttcgtgccgcgggacaggaaggccgggaacggcgggcggccgaaccggacgacggagcgcgggttctggaaggcgacggggtcggacagggcgatccggagctccggcgacccgaagcgggtgatcgggctcaagaagacgctcgtcttctaccagggtcgcgccccgcgcggcaccaagacggactgggtcatgaacgagtaccgcctccccgactacggcgccgcccgcgccgccgcgccgcctcccaaggttaaactaatgctctcttagcaattaacaagaacaatcagttgcagagttaattattagaacgaatcctttaagtgatcgcaaaatattagtactactgaattcttaaaatggtcacaaaaaaaatgatcggaatgaagtgagaatgatcatgtcatttatttcttttttgaacgaacaatgatcatgtcatatgtagtactagtattagagtattagtacattggcagtgaatgctctcattaatttggttgtttttggtgtgaaaatggggtgcaatgtagtcgttgtcccagtagacttgcagtatcaatgatgtagatattccacgaaagcgcaccaagcattaagaattaagaattgacacggttgacttgggagttgactgccttgatttttaccattgtacatgtaaatttactccagagaacaaatactccactagtagtacaattttaacttggatttttctcacactgtgtttggcggcaggaggacatggtgctctgcaagatataccggaaggcgacgccactgaaggagctggagcagagagcctcggcaatggaagagatgcagagaggatcaagtcacggagactacacggcgacgagagcatccctcgtccacgacgcctccgcctccaccggcgacgactacttctcgtcggacgacgtccacgacagcggcttcctgatccagtcctcatcctcgtcggcggcgccgtccggcagcagcagcaagaacggcggcgctggcgcaccaagggaagccaagaaggaagaagcagacgtcacggtcacggtggcgtcggcgacgagcctacagctcccggcggtgagccagctgccgagcctgcagcttccggcgatggactggctgcaggacccgttcctgacgcagctgcgcagcccgtggcaggaccagcactgcctgtctccctacgcccatctgctctactactaagcaaggggcagagaattacattgtgcatcgaagcaagaggagtcgatcacgatctccagatgcatgtgcaagagcaagagatcaaatcacccgtcgacgaagaacaagtagcgtagaatggctagctgtggattcgattgtacatatagtagtagcaccgagatatcaatcaatcttttggtcttctctcaagataatatgatgctttctgacttgacaatgctagaatctcttataagactatgattcaagaactttatattcatgtttgcgccgccaattttttgtgcaccgattataacagatcgaaacaacagatcctaggaacccagcaatacaagaaagatgtatgggccaaattttgtgcgcggagaagcccgctaaacaaactggtggctgattcggaccacagcccgcaggggacactactcacccaatgggccaaaatttctgcgcaaacaatattcgcttttgacaaccttcggagcgctgtacgagtttgagtttgtcaaagacacttgcaagtaaaatatgtttgatgtagcactagcagaagactgatcgatatgctcccccgatccagtcttcgcgactctcgcctcctgtttcggtggttgggggagatagatccagttaggtgcgcggcgccaagcggcaactttggcgttgggcttgtacgtacggcgagtgcagcgcgcggcagagacagcgctagctcatgatcgcttatcgccgtgggagctgagatgcgaaagcaattgaagaaaattaacacagataccggtcacacgatcagtttaactaggggcatcgttccaccagtaataatattatttcacaataacatgtgagataagcgaccatgtgtcatatactcatatctgttacatgatatccgcgaacgctctctgctagctttattcgtactagtatcacgtacatatacgtatgtacgcgaaggctaagctagccattagcaagcaaccagcagctgtactagcactaggagaatccgcttatgacgacgtactcccagtcgatcgtctccagtgcttaacctcctccgtagggcttctggtccctgcaggctatgttatctccgtatcctacgcggaacatgtcgcagtacctcttgtagtagccgacccggtccttggcgttgtcggtggagtagcccttgccgcactcttcaccgccgttgatgatgttggtggccatgccgtagccggggagcctcccggagctacggtcatcgccggacggcgtccactggttggtgattacgtcgtggcacgacggcttgggtgactgcgccgtcatccagaaccagatggccgtcctgaacgccaccacggggtcgcttgacaccaggtcggggttgttcaccaggtccagacccaacgcgtccccggctagctggtagttgtacttactgcataatacatacgagagcatgcatcatatcagatttattttggtggatccattgattatttgtagattagtagtaatagatttcattgcatgagacgatatgtgttgcaataacttagaactgtttgtgtgcggtttttttttatgaacgtactgagtaagctgtatgggtcctcggccgtagtagggcgggtccgacggcgtgatctcgttcacccggcagtatccccaagcaaagggtccatcaggagcagttgcccatccaccttttgtatggagtaatccgtttaatttgcaaataaaaacagaagaaattaagtgatctgaactgtgaaggttgtgactagcttgtgagtagtgagtactacctgtagtttcgtgggaggtctggccaaagaaagcggcgagctcgcgccggcgcgtttcgtcgttgccggtcgtgccgaatctagggaaatctccggcggccttgatgaacgcgtcgtaggtgtagaaggcgccctggcaaccttggtccccacggtggctcagcatcgactcgaacatcgcccgcgtgatgatcgacccaacacccgcctgctgcccgctggcgccgccggccgccgcgatcagcagcgtggcgccggcgagcgggagaagccttctcatggcgcaaatcaacaacttacaaattctgtactgtcaattgtgtttctcgatcgtgtgtgcagactgcagactgcagagcgcacggcacggctttatatacgacagtatcgcgcgagatggtcggctcgatcactccgtccgattgaactcaaacgatgtacatgcaaccgtacgagctagatgagcccgtcaaggacggcacattcagtgcaacagcgaccgcgagcatttggagcatagcatggcgtatgcacgcggcagcttgggccgtgtttagttaacccttaactaccctaaatttttaactttccattatatcatatcacatcaaaaactttcctacacatataaacttttaactttttttttctgaacttacaactttcccctaacttataacttttttcaggaactagaccgggacactgccaatgccgaagaccaaagcagtgagaagactgaagacttgaggtcgtcgagactgtcatgacgatacagccccgaaccagctgcaacctggctggccaatttgctttgccgcgtgcgtgcacaccctttggaaggctcggaatcgtgcaactaacattccggaatgaaagtttatacggctttcacagcttatacaccacatcaaagaagacctcagtctttggaagcaccgtgtcgcaaacaacagtcgcgatcttatccatcaatggatgaacaagctgagttaattttagggctgtttcccagcccctttgtctttttttttcttcttttctatctttctaccttttccttctgttgctctgtttgtttctctgcccttaattttttacccctctactgttctccctgtgttctcctacttttgtttttttaatgggtgaatagctaaagtggtcctccaagtttcatctgagactcagtttagtccttgatgtttcaatctatccatattaatccttcaagttttcattttagttcaaacttatccttgaaccaacaactctcttcataaatgacacttatacccctcatcattcacatatataagagagaaattgcatgcttgaattttttatagataatacatagtatattatgtaaaacgaaaaaaaattatgtactagcaagtgtatacgatagcaattgcttaagtttcatgtgcacatgtcgaaataatgggaagtagatctgtaatgttgtttatttatgttggctttctcttttctagtatatagatgtatacaaattaagggcaaaaatgacattttctaatagaaatattgactagaaatagccatatggcatattaagtggacccaaggatgatttcaagacaaaacaaatatttgaaggatctatgtggataaaatgaaacgtgaaggaccaaattgagccttcgctgaaacttgagggactaaattagctattcacccttttttaatctttgattcaccattagtaaaatggttataaggtaaagcctttctacctttttaagtaaaaaaaaggatttgaggtcgcctctcctgtattcgatctggggttacaaaagtttgtataaccgagcataaattattgaagaaatgtactaccatgagggcatccacaatgtggccaaaaaacagtccttataactctatatgggtacctttaccattgtgggaggtggcattaggaagagccatatgataagctaccgatagctataaagaccacccatatagattaaaatatactatctctctttttgcttctttcatgagagaactatagcatttggaagtaatttttttttagagtgtgggtcccatcttaatgtcaattgctatctatatacattgtgaaaatagaaataataaaagaccacttatatgggtcccacctatatggactatttggtccatatacagatgccctgatagtcaaaacagctatagtagcagtgcctgaaagcaagacttaaaccgataatcaggatgtgcgtgcacgcatggacggatctagaaatagcttggtacacgtataaaagtttctcatatttttctaaaaaaatattaataagtggttcgtataatcgtaaacataaacgaaacaaatgagaccggtgatcaccatccatcctgtctactactggcgacacgaggtgctcgtctcttccatgtgtctggaaggttaatcgtggtggaacatggaaacagatcgagctcgcgcctgccgcatgtcagatatatagtactaagcctgcgttttccacgtaaaaattagaagtttgaagaaattaaaacaatatgataaaaaattggaagtttatgtgtacataaaagtttgatgtgacggaaaagttgaaattttaaagaaaaaaagttgaaatctaaccaaggcctaagggtaggggttattttgcagttcttccttttgaagaactccctcctttttaagatttcgctgggctaccttcttttccagataagagtacataattctttctttgtctggtttagttcccaactttttctttgaacttttaactttttcatcacatcaaaacttttctacacacacaaacttccaacttttctgtcacatcttgttccaatttcaataaaacttccaattttggcgtaaactaaacacaccccttgtaaattggcgtaaactaatcacaccccttgtggtgatgcttagtatgtccttgccggctcgcctcctcagcacaagcaatggtttgttggttaaatagcttcagctacaagatcaactgtgcaccttattcacaacaaccgaactctagtgttaaccaccacaaattcccttgcatggtgcctgtttctctctctctctttttcaattaatgttacatatacatgtgccccccaaaaaatgcataatagaaatggcaaaccaaatagttacaatcacaggatctacaacatctggtccgaaagagaaaaaaaaaaggattctgcagcaccttccccccattacacccaactctttaacctggaatgtatcacaattttctgaaggaagagcagcacgtctcaacataaacctttgagccgcaaaggagactgagcagacgcatctttagaccagagacgctcttgtctcttctcttctagctgcgaagcttcattcaacatgtccatagcatcactctgcatatttaactttgagagcgcaacagcttgcatatagaatgcggttggccaatcagggtatacgcactgcgcttgcattgcatcccggagggcagcatcaggttggtcagacatgaggtggcataagctccgtctagcgtataccgttggtgataccattgttcccacatcaacaaactgcaacccaaagaggaggtaaaggagtgagataacttcaatctaacgatttttttgtaacaccagaaggttcctgatatttgacgttccaacctgtgtgtaacactctatggctgtcttaaaatctttatcacgaaacgcaaagtctccacgtttcctagcatctaacatatccctcatctgctgagtccattcctggaacgatagctgcaacagggagattgatgaagagatagatttcttagacaacgatctgccatatgacagaaatcaaagtgctccaatatttacctcattagtcccttcatcatctctgtaatgtgtggcaactagaatctgatggattgctgtcatgtccatcctagaacaggcttcacccatgggggatagagggtgttgtggttgtggagctggagcaggagcaggagcaggaggtgcttcttcttcatgctttggaatgccaagcatctcataggaaggcacctgtttgtattttaaaataaaattaggtcagtcaaaatatggcagccataaattagtaaagaaggcttaaaccatcaaagacagaaaaaagatttagaaaagtaaggataaaaacacaatggttacctctagttttgtttgcaaaggatcaagtatggagaccagctttcctgtattgggacggtccctaggttcatactgtaaacactgagaagcaagatctaccaaagcagttgcctcttctgtagagtattttccttccaaatgtgagtccaagagcacttgaatgtttttgcctcttatcatatcgagagcctgagtgaaacaaagctaattgtcaataagaaagcacatgttttaattgttttaagcattgttaccacttacgatgtgattatgctaccaagttacatttagaagtaaaataatatttggagcagctaagagtgttagccatactatgaattcaagcagcagtcaacctcttaatgttcatgtctatataagtaaaactctgttctactgtagttgcacaggagtgttgcatcagcacgatgcaaaagaaatatatatgcagaagcagaatagcattgtatgccacctggccaaggtattttcagtacggatttcggacttcttatgctgcattggagctaggataaagaggaacaagaaaaggcatactttactagcaaaataaacttacatgggaaggaggtatgcgctttccacttagaaggtcgaggagaacagtaccaaagctgaatatgacactttctggagtaactctacctgaaaaaggagaatataccatgaagaaatgtaaaaaaaaaaaaaccttacatttagaatggtttcctcttatatttgttatcctaaggctgcctttgtgttagtcacccatatgttttagctggctaactatgagcttgacatttcttcgtaatcaccttaaaaagcacatatcaatgcttacaaaagcactcagtaggcaaacaagatgaattatttatttatctggcagggaaaaagaacatgattattatgccttattttgattataggtccagtttgtgcatatgatgtgtcatgccattagagtgcaaggcacagttctgtcatcaatggaagatggttaacatctataatattcctatgaatgcccagagtaggcatttcaaataaaaaatttaggcataaagcaagaattacatgcatacagaaaaaaaaagagcaatgtgtatttatccatttaataaagagaaaatctaagaaatgtcattgacaaacatccaaatccaataaatgccattgacgagtgcaagttccataaaataccatcgtacaagcgattttgtccgagaaatgccattgccgttagggttctatccatcccgtgtcgttaaatacattgttcatcatatagcacctaaaggagggatgctaacggaaccctaacggcgatggcatttctaggacaaagttgcttgtacgatattatttcatggaactcgtacttgttgataacatttcttggaattgggcgcttgtcaatatcatttcttggattttctctttaataaatagcagttcatatctcagaggaaaagaatagtttttagtctcagggtaaaaggcatatgtaccatttctcaaatactctggaggtgtatatgcaaggtttgtgctataacttttgccatccctgctgtttttcatcaggccaaagcatgaaagacgaggatcaccattctgcaaatataaatacattaacgatttagataaacggataacatctggataaccatgtgaaggagaggttcatgtgaacaacatcatgggaaagcgatttattctttgatgagattcctaatcatttctccaatcagcacaattggtaaagagttgacattttcatttctgccatgtgctttcttccaggtactagagatgccaacaatttccacttccaatataagcatgcaaatcaacaaacagaggaagcatccaggataagagcacaaactaaattaaatcagtgccattccgtagattgcacactacttcttgcagggaggtatttgtagagataaatatactatcctcacttcctctaccacatgagacaatcctacagaataaaacatacaaacaccacaaaagaattggttgcttacctcatcaaaaaggaccctatatgcatttaagtcatgatataaaggccgttcattgctactgcagtagtcaagtgcttcagcaatgtggtgtgcaactcttaaacgcatagcccattcgatagtctggttttcccctgcaaatgtgtaaaaaaaaataatcatgataaatgaactgcaaatttaataacacacatctagtttgcgcaaattcaaacttgcatgaatggtgaatgcaattaagatcacaaaaagaagtaatacagtgcattattgttgaggttttacagaattcagtacttgcgacaactattaccaatacagtcgacagctcacccttcaccactgccagtgtaccctattgtcaggttgttcatcaaacatgaagacaacatataaagaagcctaagttctcaagtgaactacaatctcccgtaaccttaaatgcataaaaaagttaccaactgcattggtcactgtaataacaagacatttccacattggagaccctgaatcagtttaaggcatccatttgtgtacacatatagctgctgacagactcataacaacaccaacattccatcgagtgtgttaaggaagcttgtgccataatcagttcgactgactcaagatcattgccaacaataaccgaataagaacaagatatgacaaagggcagtcccaatcattcgttcggtacaccaaatgcaggaagccggtaggagccagcagttgctcaaagcagaccaatatgtcctcttttgccaacttccacactaatcaggaactacaaggcagaaaaatccaatctttttgcgaccagtgtttatcggatatggaaaaaaaaagtctcctggtgatcagaaattcagaaaggaacttatcaaaagaaagatattccaataactcacaatggaagacgtgcttggctagggtgtcgttgggcatgaactcggcgacgagaagccgctcgtccccatcgcagcagtagccgatgaggttcgccaagcggcggtggcgcagcttccccacccccttggcctcctcctgcgaaccaaagcaaataaccttaatctatcggactgatgacagcaaagacgaattctccaggcacaacaagctcttcccgaatcggggcgtacctcgaactgcttgggatcgggccacgccatcttggggaacttcttgacggcgatcgcgcggcgggtgcgctggaggcggcccctgtacacgaaattcggggccttctcgccgctctcggacacgatgttctccgcggcgaacccgcccgtggcggcacggagctccgccagcgagaactccgcgaacgccgggacctcccctctccccacgccctgcgccgccgccgaccccggcgcctggtgctggttcagggagaaggacgggcgctgcggcggcgccgccatccccggcggcttctccgggtgggtcccggcctgcagcgacgacccgcagcaacccatcccagtccccctcctggtcgtcgccgactacctcgcgggctcgctcgctgccccccctggtgcggcggtggcctgtagggcgagcgagcgagcgcgaggtcgagtaggaggagtggttgctttcgacgcggcggcctttgtacaaacacctgctcgctcgaatgggggggtttgggtttcgtctcggttttcgctgccgcggtacgcctacggagtacgccgctgtgtgcgcgtgcgtgcgcgtgtgcagtgcagggtacggcctgaggctaggccgtgggcacggtgatatgttgtttgtctcctgttcacatctcggcaaatctagcgaggggataagcaaaaatggagatgtcgtcatcatcgttttggaacaaattttatttcctccgcagtccgcaccactacaacataacactacattcacactcacaagtggaaaatactgcacatacgatgttttattacgatcttagtacgatccaacgccggaccatctgcttatgtagtttagcgtgggaccgaaacttgcaaccgtcaacaaacactaagagagaacatttatcataaaacaatagtaaacataataccgtatgtttagcagctctcctcgcgagtatgcctctgacacaccaaacaaatgaaaaccaatgatacatatctgatctcactaaattttcgttgaaatcctaaaatttttttcttgcaattatacagtagacatacgcgtagctacaccgacatatataacactatattcacacacccatgagtacgttcccaacacacagaaaaaaaggaaatactacaatgattactcggatgtctattttttgtttggtcgtattaaatatctttgaaatcattgtttctctcacgttgaaattacaccacgacaacactaactatacataggtaaactcctctaaaatgttccatatattcaattcaacgatagaaacattcatccaactcgcaaaacgctttaatgataggaaaataaatggaaccatatgacataattgttttgtgtgagccttacaatgattcatattgaacagtttagttgaagctgaaatcagagaaaacacacacataaattgcttgagatgctttgatggtgttctaagattctctttgatgtgcctttcaaaacatagtgttggagaaggagaggacatgatgtgaaatgataaccctttacctatgtgtttcctttctttcaaccaattctaattatttttagtatgttattcaccttttttttctagagaaaggttgtcccacatattagctaaagacaacaaaattttaaattggaggcctaactttggattttattttagttttttcgtcaggtctattttctatattatttttaaaccaataataacacatatataaaagtctcatcctaaactattttacgtttcttgattcggttattagtcatgggctccatagctcaaactttatttctctgtcaaattttgataagaaatggtcgagggcatcaacctgtaagcagagcatacggaaacgactagtgaaaactgaaaacgaacggtttggagtaatttctgatgttacgtcatgctttggcccacacttgctctgttcctctagtattttggtccatgagtcaacggtttaactcgtgctctcgtttttttttttttggttgttgttgtttttttgatgagttcgaaagggaaaagaaaggacaataaatccgtccgtcgtggcgacgtacggagccacagtcacgcgaaaccccctgcgcggtttacgcgcgtcgctaccgtcgacgtgcatccgaagccaaaatcgccgtgctcccgtgaattcggcgaccatgtcgctgccacgccgcggcaacgagtctcatgacacacgggcacctggaggcacgaaagctaaatttcctgatcagtgcccaccagggcaccgatgttaattttcgccgatgataccgtggccctaagggctggttgatctgtgagtttgggatggtagattagaaacgagaatactcattagtatattattaattaagtattaactattataaaattatatatatatatatatatatatatatatatatatattataatcgtttaaaacactctttgtatagaaattatttttacataaaacatgtcgcgtgacaattcgggtagtatactaacgaaaaatgagaagttgttacgagcaatttgaacacgaaacacgtttgactaaatgggatgaagaatttagtgtgcatttactttgttgtcacctttaaccctattaaatcttgataatgtcagattttagtatgttttgatgatgccaaattttgattttgatttttatttttttagagaagggtatttctacccaaaaacgagaagtatttgttacgagtaatttgaacacaaaacatgtttgactaaatgggatggaaaaattagtgtgcatttacttcgttgccacctttaaccctattaaagcttgataatgtcagattttagtatgttttgatgttgccaaattttgattttctttaattttttttagagaatgatatttttatccggcctctaaatccaaccggatatatacaaccttttttaagttagaaattagcgctcaaataacccaatctaaaattcactcctatgtagctactcaggttactgcaaccactaggctacatgacttttcaattttgatggtgttggatgtatttggtttaaagatttaccaagattatgatagagcttataaaattggaaattttataattgtcaaactttgataagataataatgacaagaaaaggtaattcgatatggttaaaagtagcaacgaagtaaataaccttaaagtttcaccttttagaatctaattaagttctaatcgtagatgtcaaccaattgaccatccattcttcctacgtaccgtttcgtcttaatctcctattaatttatatttttcagtcttgcctctcataatccatatccaaacatacattcgttttctcgtgaaactatttccacggatgaagatgatgttttagtcctatgaaactgttgttagtgtaacactacagtaactgattacgacgtgttggcacttggcagccgaaaagcagcagaaacagtgccatcccgtagacctttttcggggaaaagcaatcccgtagattaattcatggtagaagacttttgccgtagcaagtggcagctcaaaattggagtatcctcctaaattggaacgggtaaatccaatgtttaggtatttcttactactagtcattcgctgtctccacctcctattaaagtagttgaacttgaactcaattactcaagcacagtgtctactggatatagtgctgacagaaaatgaatatggtgaaacagtcagagtttcagacagtaagaattagtccaagcaaatgcatgctccaataaattagctctcgttttggccgagggttcaatcacatgtaaatcagttttggccaagggttcaagtagtgttaactcattggagcaactcggtcgtatttttttcctttttatccagacttcattcttcagaaatccaggctagcattgtgtttatacaaagaatactttagcaattattgaatgtagtgctcaatgcagagtcaacagaatatcagaattcttcagatccctcgctgcctcgcaagacatcacttgacctgatcagctcagtcgttagtcatcagtcatcactcgtcagtttgatggaattatccagttgcatgctgttagcttccgttcccatttcgaacaatgaaaggagaaagaaaagctcctgctttttgcccagaggcagacgagtagccgagccaaatatctgttgatccttaatttgcccttaattaatatttgataattattttttcatttccagtacaacagcaagagaggacaataaagtggccaagttggcaacttaccctgtccattttttttgtggctgatctggcacgcacccgggcaacgacgacaccgtgtcgtttactaatcactcagccagttccaaacaatttactgctgcttaacggggacatgtagcttttgttactgctaaaagtacatgacttatgacgtgctactgtgctggtgccactgtaattcgtttatcaattcatcgtctgcggcgccagtgcattgtctagctctcctctcctgccttagagccatcaaaagatttttctcgaactcatagttaagataatcctcctcacgtgcactgacagcttaccaggataaaataacctgatgtggcagaagattacatcgcgttaactgccaacgaaatcgttggatagtgctagtagataatagtataatggctagctgctgtcactctcatagggtcattatcagtataaaaatgtgcaatgtttatacaccagcatccccaattctccatcgccatcgcgattactattcccgtgcaaaagacaagttgggaaatttgcgataccattttttcttcttttcccacgaaaaccttattaaagcatatgcccaaatcattactagctacgtacatacatatacgtacacaccggaagagcacgggattagcatttagcaccaattcaagttaatcattattaaagcagaaaagaggggaataatccggttatcatgataacgacatgaaccgaaccatcgatcgatcgcacacgcacggatgcatcgaagtacagattagcatatggatgcttcacctgccgcacaatagtagtagtacagtactactccattggccggaagaaataaggcgaaaaagttgcggctccaggtgctcatcccacgcgggattcgctgccgctttgcgctttcgatcattgcgtgcccctccccctcccctgggtgcgtttggttggacacgtttccgcgagacggcgagagcgacgtgacgcgccgcgccgcgcggtcgctcacgcagcatgcgttcccccccccccccccccgggtttttgcggccgtatgcaccgcgtacttgccccccgcccccggcggcatcgccacgccacgacgagacacgcacgccgcaaggccggagcgcggttggagctcggtctcgtgggtttatcaggtttacacgagacggcgcgcgcgcgagagagagagacgccgcggccgtacgtgcagcgtgcaggtgaagacgggtggtggtggggaacttggccagatggccggacgaggcgccgtacctgctgcggtggcagactggcagtgccagcgctagtcggacggcgcgacacgacccctgcctcggtggcgctgagctgtgctgtgtaccgccagccttgcggctgcggacatcgtgctgtacctgtactatcatcggcgtcgtcccagctggctcctctgtttcgtgggccgtcacctctgggttccgttcctcttcggctaacaaggtaggtttagcccatgggccttttcttggtagctcaaaactgcacgaagttatgcaaagcagcaaagggcgtgttcttctccttttttaaaaaaataccattggcacaaatacaaacgttcacaacacgtgcgctcatccttatctttatgagtatgtccgaaccgatatattgaaattgataaagccaccacaattgatttactcttgattgataccttgcctaccaatgaaaaaaataattataatgtgttctttgtggtacatgaatttgggctgattagcggctcacaaacgaaaaaagtggttagtatataattaaatgactattaattattaaaattttgacaaatatattatttaatttttaagtaccttttatatagaaatttttttacacgaaatataccgtttagtagttttaaaatatgctaattaaaaaaaatatattatttaatttttaagtaccttttatatagaaatttttttacacgaaatataccgtttagtagttttaaaatatgctaattaaaaaaaatgagagttagttgaattaggccttttttagatcccctgataaaattttacaccatgtcatatcgaatgtttggatacatgtatgaagtattaaatatagacgaaaaaaataactagttatacagattgcgtgtaaattgcgagacgaatcttttaaaactaattgaatcatgatttgacaatgtagtgctacagtaaacattgctaatgatggattaattcggcttaacaaattcttctcgcggtttacaagcggattctgtaatttgttttgttattagactacgtttaatccttcgaatatgtgtctgtatatctgatgtaacacgttaaaactttacccccttacacggttgagtacgaatcacataagaaatacgtttccgatctttagctgtcctgtttgcctgaacgatcacatcgaaaattaagagtgatccgattagataggcaccggtgtccgtcctactaactcccaaatgatcaccgtgtcacgtcctcgaactaacgctaacaacgtgcagaaaatctccctgcatctcgtgatggttcattggatcgtagtgggctccaataagtggggcttccaggcccatcttgctggggcccaatagtaccgaaaacgaaagtagcaccaagcttccatgcacgacgacagaaacgagcgatgacattgttgtttctttgggaagaaggacaacacaaccgatccgttagcttgtccatttcgaccctaagtggtgcaaaatgattggagaattagtcaccaaaataaataattgtactagttctaagttctgataacacaactagtgaccaaccatgactagttctttagagatgttgggtttcagattttcagtacagagccgacgcaagttcagtgttcagatgcgccaaattatacggatccgtgcatgcttccgattctagtttagatcgcgaccttctagctagataaattataggttgcacaggtttgatgagcacgctaaagctggggcatgtacactgtattggtttggttgcaaagtaaagatccggcttaaaagtgcagcttctcttgactgacgatcttgattctggctttaggtgcattaaccttcacaaccacccaacttatctgaaagatctaacaagatgaaagaggaactgattctgcgtttccgaacagtgaacggtgcctgcatttgtgtttcttctttgcaaaccgaagctagtacattatactctgctactactttaagcactgagacaatgtcatagttaaatgttcaatgctcctttcagtatattagtattaagtgctaaaaataactgaaaagacataactatagaatgcagccgcaaagcctgcatcaaaggacctaaacgccagcttaaatagaaagacaatttggtaagttcgattccaacgtgatacattaactccttgacccaattccatgtgatgccaaaccgaccgaacggcttacgcgatttaacaaagattcatctttgcgattgaaaaatgcatgtgaataaaaagcagaggcctcacatgctcagcttaacggttatctttcagttcagagccaaaccctgcatggctgcgtatagctgaaaaatgagacgggaataaaattgcagctgaatccagataccatttggtattttagcaattgacattaactcgcatccaaatcaaggtctaattaacataagtttatatggttgctgcttgtcgcttaagaatcaggaaagcaacctctgaatttggaggtaatccatgaaagtgaggttgtgtagacatttgatttgaaagctaataactaaattttactgaatatttcacctaaacacaattccattccattgtgaaacgatccctatacatcatgtacgcaacctaccaaaaactaagaagaatgatgtcaaacaaatccgcattgtcctgatcactaatcttccaggaatttccctccagagaagatcaaaagcacggcgtcagtacgttgagcagtgacaccctcgcgttcacgagcgcccggtacacctgctcgcagccgtcttccgccgccacgacgcactcctccagcctgagcagccgatccatggccgccttcctttcctcctcttcctcatcgatgcattcgtccaatggcgtctcctttgcgcctgcgccggactcgcaggcagcgaccgacaccgtgcgccgccgccaccgcaggaggtcggccacccaccacaccggcgcgaccgctacctttgcgggagaggctgcggtcggggacgccaacgaccgcgaggcagaggaggcggaggcggacgcgaggcccgcgaagaaggaggcggacgcggccgccgccgcgcacgtggcggccccgacggcctcggctagcgcggcctcgccggagtcggacgtcgctgcggcggaagaggagcggtaggagaggtcacgcaatgtggaggcgaggcgggagaggtcgcggtccgagcggcggcgcgcgcgcagcgcggcggcgaggcgggtcgcgtcgcggcggcggagcgcggcgtgggcctcggcgaggagctgcttgagcgccaggagcgcctcgcggaagcacccgtgcgcgtcggcgaggaggaggaggtcgtcgagcagccgctccgtccacggcgccgccttgcgcggcggccggagcgggtcctgcgcctgcgggtggtggagcagctccgtcaagcccgccaagagccgcgccaggtggccgaccccttcgccgatccactgcgtgccagcctgcgccggcgcctcatcagtccacccgaggagagcactcgccgactcgtgcaggccggtgacgaccgggtggaagcggccggggaggctagcggagcgggcgcgggagtacgataacttcttgtgcctcgtccggcggaggtaggacgatgccttggggatggtgagcgcggtgagccgtcggcggaatcccgctgccatttgctgcgtcgtgcacctccggcttgctcgagaagctgttgtgttcttcccggcgctcgcggtggcagtatgggctttttgctgtgcgatcgagttggtggtggtggccgtggtgtggcaagtggatcgcgggcgtttttatagggtggtgtggtgtggattggtagagcccgcacgggtgggagggggtgtggtcttgtatactgtgttcggcagctagccaggcgccagtggcggagtggcgcgagtaggagttggatttttcactccccccatgagctttgggcagcatcagcttacgatacaaggttctgaagtccgtcctgaaggggtataaccaccgtgttcaacaagctagggagagcagcggactacaggattcttctggtaatctggccagttaggacaagatagtgtactgtgcctgtttttcgtactactgttctgggccacttcaataagtttatttgtttctttctagggtaaattttctcgtttaacgaaccatttgctgtggcctcatttcctttgcttgtgcagcagggtagtacattatggagagtgaaaatttttttgaactgaatggagagtgaaaattgaaaagtcagtgccaacgtcctgtggcttgcaaacagtaatgccgttttttagctacttagatggagtaactccttttttttttcacgaccgacatactcctactatattagcacatggagtaactcttatgtaccaaaatatcacatgtaacataaaaaatatcccatgtaaaaattgctcacatgtactagaaaatactaccatagatgtaaatgattctcctatatgaggaagtaggataatcctaccatccggccaccccgagcagatgcccgggcttatcgagggataatccattaaaatatcatataattagaaattttcaaatagaattcctatattaaatagtagtactagttatagtgaggtttgtccggacttcaaaatatttcagatccacgcttgcgccatgcttgaattgataggtcattttcgtttttggactaaatatttttatataaattcaaattcgcaaaggccaataacaaattcaaactcgctccaagcgtcttggactcttgtttggattacacaggtagtagtatacaggtgcaaattggcagcacatctatcttgcattgcacggagagtaaagttagtttagggccagtacctgtggcgcgggccctgccacccggtgtgggagcacctggcgtgtggcgccccacggcgcaacgcgcggacacgtgcatgcgccggtgcgtgcctcggggacccgcgccccctcgcgcgcgccggcccacctcgctcatcacagctcactcccccgtcccacattcaatgccgtcatggccgcgcgcgcgcgtcggcgtcgcgcgccacaacgcctcctcgctcggtcgctcccctagttccctcctcctcctccgcaccggggcccctccgctccgctgtcccggccaatatgtgcactcgccaatatgtcgggtcgatcgattggtgggggcggaacggatgcggatgggtgcaccgcactggcgcagcgtcccatctggggcggggcctctcgggctcgtgcgattgggacgtttgacaccggttggcctgcgctgcaaggagagggatcgatcgatcgccatatctcgcgacttcaatgctcatcttcgtctggtgcaatgcaaatggaggggggcggggccgtacgagcagcaaatcattgcgatcgacttgccagccgctggcactggccttgctgctactccataccgtcctcgatagttccatgtggggttcatccctacatggatcgattgatcgatcggactgtgagacgatgaaatcaatcattgggtttgggttggtgtccctttctgaatccatgcatctcgcgtagtactattattttcctttggtgttatttggctgggtcgatgtgatcaactctatagatcaagacctttggtgttctttcctttggtgttatttgtgcagaattagttcgctgcaggcttgtttccaagctcccctgcatgcagggtggttggagtatctagatagctgatcatctcccgttgccctgtcacgatccttttcgtccgtttgcacgtccgcactaagattttccaggttttcctatgtcctgcttattactgacgatgcatttgactccccctgaatctggaaggaagaatccatgaccacatgttagtgtttgcagactacggctgatataccaacacaaaggccgtttgctcttatgtatggatcaaattatattataccactacgattttgtgctactacaagtctacaacctatgctcgtgatttttagtacttgcctgcatcacacctttgtttagggattccaatgagatactccagataaacagatagatctacacacatgaaagcgtgcaacaaaagaattgccgcaccatggcctaccagggacaatgaagagcataacaggcggtacaataaccgtgtatcagatgcattgcactgcaaataatttaatgaacgctaactgtgctctgattaatctacaaatctcgaggtgtttttgtagagtggggctctcgatgttaaaagctagcatgcgacgtgtcctcctgccagcagtgccatccatccttgtcacttagcaggtgacatactatcttcatcatcatcatcgattgatcattgatcaaattggtcagcatgatcagctgaacgacctgttaattaatgacaccctctttacgcacattaaggatcacgagatgctgatgtaaagcattctagagaccggataatttatgtactacttcggcctggtttagtcccaactttttcttcaaacttttaacttttccattacatcaaaacttttctacacacaaacttctaatttttccatcacatcattttaattttaataaaacttttaattttaacgtgaactaaacacacccttcttttcaaaatttatgtactaatacatagtactagtactttatattgtgcacgaattaaagcttaggccgtgtttagttgtaaaatttttcttcaaactttcaacttttccatcacatcaaaatttttctatacacaaactttcaaatttttcgtcacatcattccaattcaaccaaaattttaattttgatgtaaactaaacacacctcaagttgcaaatgcttttcgtagccaaaaccgcagaagttactgacatgactgaagattattatccagaccagcttctagcttcagatcatttacgccttgtttagttctaaatattttcttcaaactttcaacttttctttcacattgttccaatttcaaccaaatttctaattttagtgtgaaataaacacactcttagtggatagaatctccaacctgaacgttgaagtctgcagtagtagtcgacaagaaatccaatcgtatcgtccatcgtttgcagtgaagccaaattgacttggttggggttcgtgaatgtcgttgcatgtagtttgagaagcagtacgtgactgtgagagagcgactagaataaaaactagaatattagggaagaacctaatatcaaataattaggaggggtgaggctttgaacccaggtcgtctagcccaccaccttgtaaagctagccggaaaacccctgggcatttctcgagagcgactagaatgaatatgcagattcttttatgtcaaacgccaccggccgccgatttggtcggctgagttagttaatcacggctgcggcatctgtctctagaatgtgagcatgttcgtctagcggaaaaatctatcgatgaatgcagccatgtgctgcagctatcaagcttgacaatactagagaactggtatcccggtatagcaggagatcgccagatctgcatgagtgcaaacaattgtaaccgacaatactaatctgcatgagtgcaaagaattaactaataccagtatcaaatttagtatttatttaaagcttagtggctaattgcacacctgcattttcagtaatctgaacatgacaacatacttgtgtgtggattctgaatttctgagactgaaattggcattggtgcaagcagcggagaacaggtgggcttgaacacgagcaacaagaggtctcagaagtaagagcccaatctaaaacggcccaagataacgacccactaacggcccaatataaagcagcccaagccgccagccgccggccgaaacacccaccgtcgccgacttctcgtgcgcaaacagtgcggttgctcgcgcactacgccggcgagccgcgggcggcggcggcggctgggagtacgggagacgccggaatactagcctcgcatcctcctccctcgagttcgctgcgggaccgcgccatcctcgtcggagccccgggcccaggggacacgagcttctccgccctcttgtccttcggtcagcaccgacgccgccgtctcgctcgctcgctcgatcgagccgttgcttgtggccggaggaaaggtatactccctcgtttcgatttgttgccgtagcttcgcggcccgttagaagtgtttccaactttccatacacgctacgagtatcatcaggttgtttgtcagatatgggattaggctgctgttgcagttgagatgtgatccttttgctgtatgttctgcactctgtttccatgttggtgtaagcagcttgcatttggattttggagagatttgcgagacaaacgtagtgattgcctttgtagggggttgctttactgtctaggtagttcctcaatttagcgaagcaattttggcagctcgtttgattttttatttggggattcaagtcgatccgttatcaaactcctcaaattagcactagtgtttactaagtaggttgttcatatagattcccccccactctcttcatcctttggtatagcagttttttttttatttggaacggatctggtatagagaatctgaaatctataaattaagggtccgaaaagctactatgaatctacgatgcagtcatgattgaatactattttttaaaacgcatgatgactgtattaataaggggagcaaaagttgaaaactgccaaagcggtataatgatctgcttatctatgttttgtgttgtgaaggagcttgatgagggtttatgtgtaactgctgctgtagattcgatgctcataggacatccttgtttatggatgctgttattggctgttaaacagtgtttctaacaaatgtttgttttcttaacctttaggcctcaacagtcaatatggctggctcattcattactggggctttaatgtaagtagcagcagtttttgtacaaaagtactgcagtaggtaatggttttggtctgctacatgtttgttattacctattttgcaggcttattcttggatatgcatacccagcctatgattgctacaagacggtggaactgaacaagcctgagatcgagaagttgcggttctggtgtcagtactggtatgctttttatgcccttttgttttattttggactatcattcttggatttcttatgcttgatctcagctgtgtgatcatggcttttgcaggattttacttgctgttctaactgtttttgatagagttggggataattttgtatcatggtaagttgaccatttggaattgtatttttttcaggtgtaacagtaaaggggaaatcttacctgcttgctgatgataattttgtttgcgtgtaggttgccaatgtacagtgaagcaaagctggcatttgtcgtatttttgtggtatcccaaaacactggtatggtactctagtatttcaaactgctagaagaatctatctcttgtttgttggtaacacaggttgatttcaggggactgcctatgtgtatgaatcattctttaaaccgtggattgcaaaatacgaagctgatatcgatcacaatctgcttgagttgaggactagagcttgcgacatggcggttctttacttccagaaggtttccaactatggtcagacaaggctttatgaaatcttgcaatatgttgcttcacagtcacaaacccaaacatctcgcccacaggtatcttttaaaacgttgatgttactccccagtccatttatgtatttttgcttctagtatagtttgatctgttcatggtattttttttatattaacactagcctcattcttgttatgatcttttactacagtaggtgacttgagaagcttggattacctccttattgaattactaaatgttgcactctttaaccatgccatttataaggcggtgtcaacaatttttgtttgttagtgcacgatagagttgttatttgagcacattgtgatgtttactgttctagtattaatgtcctgtttaccagttgtaggattcaaaagattgtttgcacctctatatatttattactccctccgtctcataatataaaggattttgaagggatgtgatacatcctaggaccatgtattgtgtcacatctctccaaaatcccttatattatgggacggagggagtagcgagcatgtgtgacagtttatatttgtgtgactgacatactgacttcactgcaacccttctattctgcaggcacgtgaacagcagcagcgcccaccaccagcacagactcggcaagtgaaccctgcacctcagcctgttcctgcaccttcggtgcctccactgccaccacaacccacccaagctccttctgctccaccaaggaaccaaacgcaggatacaactccagttcctgttcctcctcctggtgcagagtctcttgcccagccacaggcacatgctggtcctcctcaagctaacgccagcgacggccctcagaacactgaagctatgcagattgatccatctggtccatcaacaagcaacgcacgtcagtcatcaataccagacgaagatacgctcatccaggaggctattcggatgacgaggggccggcttaggaggcgcacggccgggtctggacctccaccaagttagaacctacaccaagggtgatctcgacacaccattcgctctatgctgggatgattctgcaccttcgggcgttcaactgataacagaaggaaatgctgggttggtgaaaagtgattcaaatatttcaaatcctcctggagtgaacgcacacattcctcctcttgatgtgatgcctgttgctgtcgtctcactactcccaaatgtgcataatagaggcaatgatgacacatatcagtagcttggcatgtcgaatgcatcaagatgggtcgaacttgtccatgaggagtcaggtccgtcatatttgaattttgaaaagttcaacatgccaaagtatgcgtgactgacttgccgaaaatcatcacaaaaatcaaatgggtaattagtatagttgatcttgatccctttgtttttaattgatctttttgttcctgtactcttattttgtctgatttcctactaacgtgagcaagccaaatttggatgaatcatatcggtggtaagtaactgcgtacaggctacagccaaaaccagtcattttcaaacctcaacacataaacggacaaggatcttgaaaggccggataagtattggattcttggcctctcaatggtactgttatatcttggcccactgacgtcaaaacgtttgtatcctcctggctgcaggctgtaatccgtagattaaggcccagaaaaacctaagcccggttttttttttccagattccggtttagatcaataatatttttccagattcttctgctgattaaactgcttcatctgaaattaggtgttccaaatggagattcatgcactgtctagaacatggtatttatattttgtttcatatatatgcggtaacaggtaactgaactgttccatataaatttcatctgagttggcaaattgttccctgccatgtggctgatagtaggccgatatatgcacaaaggctatagtcgatgtgatctgagagcatcttctgcaaggtagttgcgtgctgatcaacgacaccaaagctttctttccgagcgtctaggttaagcgagatttatcatgatgtggctatgtcatcttgaggtaacacgtctgagcctgacttatcactatgttttacaatataaacaccacctaaaatcaatcattgccctattcactgttactttgtttttgctggcccaagtattacctagtcaagctatgaacactggttggggtcccgagaatctgaacccaagtcatactgaagatgaaacaacatgtgtcgccataacaacatagtatttactgatatcatgcatacacataaaatttctgcaaacgtcagatcgttatttatgtcttcacacttcagtcaattttttaaaactaaatattgtcttcagtcaaattaagaggctctctgttcatattttctcttcaggttttgttaatacagtcgccaccaactcctcctgcttgaacaacagtgacccacttattcgtgattgtgtgacaccgcatccttcagaaagtaacatcaccgatttctctgaaacatcgtctcaataatctaatatagagttgctatcgtcatcatttaagtagcatctttgcaaacttcagcttgaatacttgggctagcaacctacgtcggcagatgaaataaactatcagttttatgctggtgattcgttagccaacaaagtgaaaaagaaatattgcaaccattttgtcacttggctctgttcgtagtagttatattcgattggggttgcatgatatatatttctatcttgtcatgatcaaaacaaaaatgtcacctaataactgtcacattggtgttagcacaattacaaaactacaatggagataccgttggtttaggtaggccaccaatttctcttcacaagtcacaagatggagttcatggctcccaaataaatccactcatgaagctgatgcgtacttgccccatctgtttcactagttgcgtcctaatatttttagataaagaaaaataataataagaacgccctgtcctactaatggataagaagctcagaactatgcacagtactcatgattctgacctgtgatttctgttatccgaaacagaatcagaatattacaaatcagctgtccatttttttgttcactgaaccaaacgagaacattattagcttcggctcttaggattatcctaatgtctgaatgcatgataagacttaatatatatctactaagtacaagacttgcctctgctaacttggcaacagctcttcaatactactgtcactagtatttctgtgcacctaaatgagcaaccatctgaaacacctaaccagaattgtacttctgaatctaattgggcaagaacatggacctcaaaccaaaggctcatgtgtggaaacaagcaaacagagacagtaacaagaactattcaaaactacccttcgtgattaaaattcagttgttcatttggagttctcctaaccactagattcgagtcctctttcttgtgctggtcggctcgtatgatgattgattatacggcagcaaaatgccaagtgttggaggttactgaattcctactgcaagctaagcacaaggggacagtgaattataccgccgggccggccgctctgtctcactcgaggctctcacacatgacatacttgctttagtgatcatcgtgttgcttgcctacaaatgttggagcctcagtgatcggatcagattgttggctgctggtgctgcaaatcgattgatccatgctgctgcacgcatggtgtacggttgaccacctaaccttctcaagtgctagttgctaagttgctcggatgtttgattgctttggcgctgagcagaattgcagaaccctcggtttcaagtactccattttaatttgatttcaactaccaccggttttgttgtttgtgaaaaaattagttcaaacgtatcgttttatatgcgttcatgagctgtttgattagaagccatgacctggtcctaggccgtggagcgtggacagccaagttttgaaaaagaaaatggacaatttgggcagcagaaatgaagaaatgaagtgcttcgaagtctgaatcactggttcacttgcagctagtacctagtttcagatcgaaaggcagaagatgctgtgttgatccaaccctgtaccatcacgtagacacgatcactggcaacgtaatgcgagggaaatctcactttaaaagctcactttcaccggcacattcagttcagtcgggcaactggccatcatacctcgcaccatggacttgtggagttgcggtgtccatgatggctgtgactgccatttatggcccactcacctaccgtgccctgatgcccaccacatacatgtctgaaactctgaattgcaatatccctcgtaattgttctcgtgtaagtaatcaacctcacattttttttcagataatggaaacggttcggtaatcacctcacatttcatgcagaattctgataaggtttaacgaccagctccgtcagcaagtctgaccaccaacagcaacgagcaacgtgcaggggctgtatattaggagggtgccagtaacccggttaagaaaattattttagctatatcttatctattcttatcatgtatgtaccctctcaatataaacttagacatccgcatcagcttaaattcgatctaaactaaagtaaattaagcaagtggtaccatcctccatttcgttttagctccgcacctggcaacatgaccaagcacaccgtaggcagaggcagccgagcaagccatgtgtcagggactcagggtagagaggaatgttgccggaagcaacacacccaggccagaggcagcaacagcatgtgagccctttgaaactgcgatacgttggttgttgcaaacgttctcaggagagttgttgcttcacggcggcgccaattcggttcgtttttcgttagttgtttaggctcccaatgggacgggacggtttgtaacttgctttaattttatctttacacattagttagtagctcatgtacaaagttggaaaagaagaagaagaaacggaggaggaaattctgaagttgccgagggattaggaggactctaaatcgggtcagtgaaatctctactggaggcgagccgagagacgtcttctttctcatcaaagcccaaccaaaatggccgtgacgacaggagaagtacgtgtggctgggcttctacttccactcgtgcgtgtcgcaggggaagcagccttcctgggcgatgtcagtgatctggacccccgtgtcgtagacctcgccggcgcgccaccgcctcggcaggacctcccggtcggcccacacccacttcccgtcgtagccgccggtcaccaccagcctcatctgcagcggccccggcggcgcgttcgccatgctccacgacggtccgtgctccctcgtcatgaacttccagctcgacgacccaacctgcagctcccaacacacgattgttagattctgcgacacaaacacttgcagattgttaatgattgttctgtgctgtgctgtgtttttacctgggcgacgtcgacggcgacgatgtcggtttggccgccttggtagaggaagctgatggtgagctcgttgggtccgcgacttctctcgtcgactctgacagagaggctcctgtgcctgtactcgcacggtaccctgcacatgcacatcgctgacgaatttgagcctgacttccaattccggcttaggacaatcgtacgtgttcactatctattgcctcgcctagcacttgccaaacatttcgtacgtacgctttgcaactggtaaactacagcaacggaccggtgaaactctctctgttgaacagtggtaaagttaatatttatctatatatgtgtggaacacgagctaaggtgcggttggtgaaaagaaagcgagctgggtaaaaagtaaagcttggtgagctttgcttacctcttgtactcgacgtccacggcggcgagctcggtgagcgacgcggccatgccggggcgggccatggcggcgaacgccgggctgctcagaacgaggccggtgcggttcgtcctggcgcggtccgtgacgacgacacgggcgcccgcgttgctgcacagcttcttgtccttgcatctcacctgcagcagcgaatcggtcaggatggggaagccatggacatggcatatgcagctaagctagttgcctatcttcggttgtgttctccttctcgatcgagcttgattacctggtagcacgcgccgcagccgacgccgccccggtacagcgcggggcccgcggcggcgaggaatccgccgccgttgaaggtcgcggccgccgtgccatacccgcaagaaccggctgtgccacgcaagaacaaacgaacagaatcaatcagtcgatccataatccggccgctccctctgcacgcaaaaccacgaacaaaaacagagccgtcgtgtcgacataccagtcagcgtgagcgaggaggtgtagtaagccgctctggagcggcgcacgcagcggtcgcagccggaagcgagccgaggcgcgagcaacgcaacgatgacgaggagtagtcgcgcgtggtgcgaaagggaggaggagccgaagcagcaacggacagagacggccatactctctggctcgggcacggggagtgtgggtcgcttcggagaagagagagaccgaggtggattcgtgtgcgtgacgactggttttatacacccccccc

SEQ ID NO: 8151 - DNA, 12896 bp, Oryza sativa
cccccccccccccccccccacacgcccgcgcccgcgcccgcgcgcgcgcgcacacagccaaccccgtatctgcaactgtaagtaggtaattaggcgccacttagtaaccaaaccaataactaatcccacaacgagagatatacatagaagaaaaaagtacggatcccgcgcgaatcggctgcgtgcgtatgtgtggaggaggaggtgtacgtcgtgacaggcgggtgtgtaaaaggcggtggccgcgcccgacaaaatggaagggaaaaggaggggatcgcacgggacgggagacgaccggccaccggctccactcgacagcgcggcacgcgcgcgaagtggcccgcttggccgcttgcgccgatgcggcatcgagcggtcgatctctcgacgctgcacgggagatacccataagattttggctccacgccccgctgctgctgctgaaaaatgtacccaagtttcgtgtcaaatcgtacgggcgcggctggggtttgagatacgcggccatctgaaaacgattaattcacgggaggttatgaggtaatcgtgttagtagattttgcgtggtcttgtgcactcgtttcgtagctcggtagattgttttccgttaggagcgtagaatcatcgtagtacggttggacgtcgactcctggaaacggatgtggacgacacagctagcagagccggttgcaaattggagaggaaataataattaataatcgctatgattttcgattctatttgtccttttcatgtgcttgtgaaattaatattgacggttacgtgacgccatatgaaaatcgatctttgctaatcctggggcgtttatactaacggattaacccctcctgtctctgcatctgtgcgcattcagaatcacctgtttccgttgaacgagatctatttgtgtagaaccccaggattttaattattagtaccatgcatttcacgaatctcagctcaagacaaaagtcgagtcccacgcaaagaaaaaccaaatactagtattactgatgaacattgagcgagtaggtcgcctagctttgctagctggtgttggccggtgagcttcccttgttgtagagcgttggatttattcagtttctggtcctctcctgtcgctcttctgcatcaatcgcttcttgatcacttaaaaaactactagtacaattaaaagggcagcttattgtgtgactcacacaaaagtttcaagtcgggcatgaacaaacaaacaaacaaattaattaatactataagattgtggcatccaattaattaaagattagtataatagctagagggagtggcgccgtatgatcttcgagttcgtgcgcaatcgcactactgaaaaattacgatgttgggggttggtgaatgtgtccaattatttctttttagctggaccagtgttcagtgactccaggtgaatgtgcgagcagaaaagaaatatcagagagacccttcaggctcaagattttgggcagggtagcgatcaccagcatcatcatcttgacgcagaatcgacatttccctcgctgcatctgcgactaattacgtacgcacacagttcagcagattttacttactggtcgttacgacatgattcctaatttatccgtttcataatataaatcattttagtatttcgtaaataatataaatataaaaaatgctagaatgatttatattgttaaacgaagggagtacctttgaaaggtgaaaaacaaaaacctctgtactgctagcatgcttattccatagagtcgaaccgcaggttcacacgttgcgacacatgctacttgacaagtcctcaatagtacacagtcacccagctcaaatctcttgtgatgttacgtaagtatgcagatcagctgttgatttatcacctaccggttttaattatattcgtttagaactcacgaactaatcagtggagttgacagaaatttatgagccaagcatgccttaactagagccaatcatgtgttaatccaaaaaataaaagagataataatgtacttgtacgcatctcgtcgatcgtcgcttttctaatagtatacccatatcactaacactggtggtcaccatgcacgcacatatacattttcctacaggaaagtataagacggatggcagaaagacatggtaggaaaagaaaagaaaaaaacaaagcaaagaaagaagcaactgtctgatatctgaagaatttagggcgtgcgagaaaagggatcagacagttgaatggagttgcagaatgaggctgagctgaggtgatgctgagtagtgggggttggggggataagaatgaacggaacagaagtggctgcctttgcatgatgtggagaggaagcaaagcaaagccgataaaagattagggcttatcatgttcgtacggcacgcaccaccaacgccggtgcggtgagatgcgctgccacgccacacgaccacgagactggctgactgactagctgaaaattcatttccgttttgttctatataatatcatcataaatgtgaattatgagtgcatgcatcatgtatgggtatggcccctctgataggtcgacgtttttggatggataatgccaagcttttaatttcgttaagcatgtaccgcatttttgagttcttatttcgtaggccacataattggaggaatggagaaagggacttgggagctagccaggatgctcatgagtcatgacggtataatttcgtcaactatggaaagaaaggtcttaattccaaagaggaactcaagtcttagttttgtgcagtgttattcccctttcttttccttttcttcttcacttgcaaataagccagcaatggcatgcatgtatccggtgtccaaggatcatggctacacaatggagtgacgtgcaactcagtcgcaattgacaaaggctaacaactccattgactgattggtgttcaatttaatcgaccttagctccagtaaacaacagtttccgttacgtcctttgtgatatatactagcacgttctggtcggtgtttctaaaaattaacttgtccatataatataagtcttatactatcatcacgaatcacaacatacaaaaacaagatttgtcctttaaattagaagatggtgatgtagaactgccccacttgggtctaaaaacttgataaccacagggcatccactattccgttccatgccgtcccttgtcgaacagccgtgcacgcattcagccagggtatgcacgaatgaatgcatcgaggaatcagagggcttctagtagtagtatactactgtacgctgtgatgaggcagcagctaagctgtcaatttgtcacggaatttgcagctcgatgggcgctggcccgtgacacaagcgaacaaggggcgccagatgaccaggccgagcagcggcgacccaccgtacccccgggcgaacaccgatggatccagcaaatcaagcggcaagcaacgcgacccgtcgccacccggccggttaatcatgggactctgccccgtctcgtgcacttcgctctccgatcctgaccggctaacgtgcaggtgcaggccaaactacgcgcgggcgcggcgtcctgcatgcggcagggtcacccgtggatgaggctgacacgaggaagtgacgaggattctccgtacttttgcgtggttgcacgggcgatgcgcgcgacgggggatggctgcttgctcggttgcgatgcgcggataccgcaacggcgcacgtggggctgtggcttcgtccgccgcagtttctgcagccttccacccggttcgggctgcgcacctagcgggtggtttcgcctcggactcaggtcggcaggccgcaggtgcgcggagccgcggagcgtcaggtgaggcaaacgaggaaacggcgggatttgtccgtgatttctccgtggaatctgcgtggttgcgctgcacgggcggccgggcgtgcgctcgactgggggacgtggttgttcgcttggttgcgcaggtatccagaacacgtactacgtggcgtcctccgacgtccgccgagagtccgagaccgcagtttcttcagccttcctccccagtttcgaggcctgaggcctcgtagctcgtcagcgcggtgacacgtcgtgcttgtcgggtcgggactcggtcagcgagctgcacatggcaaaaggcatgaactccgggcacggggtagtagtcctatatacgtgcgatacatctttgtatcgagctgtcaggtgtgtgtgtgtgtatacgttctgctccgtctactagcattgaaatatactcctatcaactgtcaaataaaatgttacgccttctctggctcgttgcacagaacattatttgtaccttttatgcacacatgtaccgagtttgatcctttattccatctccttgatccgacgagatcttaatgggctgactgatgaacaattcgaattgtggtcttgtttgtccctgtcaccgaatcctataatgcctctcccctgctttaacgcctttatcaagtcattttcctcgctgttccaaaggttgctctgcgtcgacatcctagaggccactttaaccgcctctctagaagagatccgtcccaatcgatttcaccttttatcttggtcggagaatgggaacagaaaaaaggctcaaaagcagaagcagacatgcgtgcgatatatgctcagcccatcatcctattgtagtgcgaagaatgtttgggccatagaatttgcgtgattggagcagcaaagcatcggtcagggccggctaatattcaatgtactccttagctcaggtctgatgctttttctttcttattttcccgtttggcatttctcacggacaaatcaaatgcaggcggctgtgtcgaccacctaccatcatccgtaccattttcaagtgaatatataggtcattagtagactaacggtcgagttgttggcaattaaaaactcaataattgtgtgaacgcctccaaattagaacaagtagatcaatccacctcaaacaactgtaacaagttgtgttctgtataggcaaacaaaattgctcaaaccttagaatcgctgccctaactaaggtctgtcttggctgtaactctaactcttttgagtaaagaccgggatgttctatttcgttattgagaaaaaaaaactaaggtctgcctgaaactatccaaaaacaaggtcgtcctgatacgccattacaggctggaggcccatcaaggcaaagaaagctggtgatcaccgaactgatcagacccaaaacaggattttggacagatatgagtctctgtttttcctctttttttctttctgcgatgggcagacatgagtgtacatcgaaggctcgaactcggaaattattttttatttgattatacaagaatggatacagtgtaactctaccagatcatgtatagaagaaatgcacatgactgatgatatcttcatttacaaatacccaccatattgagaaagagggtacacaacaactaaagtgtctatgccaattccaaaacgtattcaatatcttgccgaatgcattcttgacaagcttaatatattgtggagtagtagataattgattggcatttcatagtttggatgtggcaagcttaataagatccttcctcagtatcttcccggatgcattcttgggaatgtccgtcacaaacgccacctttctaaccttcttgtaaggcgcaacctgcgtatattatataacagaagttcagagaaattgcgggattggtaagccaaatctgaatcaacagtgaacactgaacactgaacatgatgtttcatttcaacttctattttggatctgacgatcgaatcatgctaacctgttttgccacaaactccatcacctcgcgctctgacaagttgcttcctttcttcctcactatataggccatcgggaactggccgacctccctatcaggaaacctgcaacagaaccaaacaccaacccattgagaacctagcataattatttctatagaagtgataactggcatctatatgaagcttacggtataacggcaacatccgtaacctctgggtgcgtcaacaaaagagcttccagttctgccggaggcacctagtgatacacaaattatattcagagttacagatataagaaaatgcgtagcctaaaagtctttcaggaaacctaacatatcagacatatcacccagtgatttttacctggtaacctttgtatttgatcaactccttgaggcggtccactacgaagagatatccatcctcatctatgtagcagagatcaccggtctttagccatccatctggtgtcagcgttgactgtgttgcctctgcgttcttgaagtagcctgaggagaaccaactttgagttacacccattatttttttctatagcaggaaaatataaagcaccaattttgactgcaagctttagctggctaagggtatctcatgtgtatagagatttttactctggtccaaccaaaagtacctcgaggtaccggtacgtgtaccttacggtaccaaatcgtttccgatcgttggatctagctggcagcatggggcattgttagatccaacgatcggaaatgattcgataacgtgaggtaccggtatctcgagatactttttgttggaccggagcaaatctcttgtgtataactgcctgaaacacctcttgtttcttaagcaagtaaaatgtaagctctgccattgcataactttatcacgtagtacttactgattccatgaaactcattctgaataaatatgcttgcaactgaatgtagtgaacacatgctttgttaatataacaggcaaatcctttaccttaattttttttttaaaaaaaagtaaaggaaagaatggagatacactaaaatatgttgaggtgtggaaaactgaatgcacgactcatttcaaagtgtactataatgccacaacatagcaagatattcatggcattgaacaagaacctgatgttccacataatgaacataattctgccactcactgaaccaatctacttgccaatgatccttagtactagaaaaaggtgaagttacttgccgaactaaaatatataaatcataattctgtgttcacaattgatttcctcttcacgattaaatcaaaggcaaatgcctcgaacagcatatgcatgcaaacaggaattaatgtcaggggcaattcattcagtcgatggttctggtagagagcacccgcgaaagatctcacctaaaagatcactcaacattataatagtttgactgcacaatgcacatggaagcctacagataatcagatgtaaacaatgtataatctatacatatgcattatgcatttcaattcttttcccaacactaactttattctcatggaaagctaccgcccgatcgatatagtaaattaaacaaagtcctacgaactggcacctaccatgtggccttagtcaaaaaaaaatgacgcaggggtctcaatttatatgtttacgtccaaatgacgcggttataactttgttcaggcagcaagctcatgacagttcagaacacggttatagctcaatttatatgtttatgtccaaatgacgcggttataactttaatttgtttagtgcgtttatattagtgatccacaaacagacaatttctagcgtgcaactcgctaatggaataaaaatgctgccaagtctaaatgaaatgtaaacaatgttcatcaaacctttcatgacgtacggtccacggatccagagctcgccggtgcggtttaccggcagcgcctcgccggaatctgggtcgacaatcttagcctcggtattgggagacagaagcccggccgtcccgtaccggcggctctcctcggcggagtccgtggacgcgccgatggcggtgctctctgtcagcccgtacccctgcaggatctccacctgcggatacttctccctgaacccttcgatcagctccttgcccagcggcgcgccgccggatagcaccttgcgcatctgcccgagcgggagcggcttcgggtgcgccaccatggcgaccaggatcggcggcacgagcggaaggtaggtcaccccgtaggcgttgatcgagcgcagcatctccgggagctcgtacttggagagcacgaccaccgtggcgccgcaaccgagcagccccgtggcgaaggcgacgaggccgtagacgtggaacatgggcaccgtgcagaggaatgtctctgtcttgtccgagccctcgaggcggaatcgcgtcatgatgatctggaccatggagatgaggctccggtgcgtggcgacgacgcccttgcttggccccgtcgtccccgaggagtagagcagggtggccggatcgtcctgcgtgacgcggtccttgcggcgcgccgggtcgggcgtcgtggcggagatctcctcgatggtggcgacgatccgcgggtcggagctgtcgccggggaggcgggcggattccaggaggacgacgcggaggtcgtgggcacgcgggagcttggggaggagctcgcgggtggtgaaggcgaggacggggcgggcgtcggcgacctgcttggcgatctcggcgggggtattgagcgggttggcggtggtgaggacggcgccaagcgacatggcggcgagggcggcgacggggaagtggacggagttaggggagaggatgagcgcgacgtggcccttgcggagggagacggggtgcgcggcgagggcggatgccgccccggccacggcgcgccagagctcggtgaaggtgatccggcgcccagtcgcggcgtcgacgagggccacaacgcccgagtggcggcgcgaggcgaggaagctgaccacgtcgacctccgggtcggcgggcagcggcacgtcggcgcgcctgctccggaacgtgcgggtggcggcgcagtagccgctgcgcgcgtccacctccatctccggtgagcgtcccatcgcgatcagacccacagatcaccgagctccagccaactgccccttgcagttgctacctgcgtttgtttccggtgtcgcgtcgcggctgtggaatgtgtggctggttcctggctgctgtggggtagtaggctagtagagtagtactagtagccgtgcctgcggcaggtggaatcgcccgtatcgtcgtcgtcacgtggggatagtgcggtgcgggcatgtgcgaaatcgaacgcagactgtgcggtcagtcagactaacgtgtgaatcggtcaccgacgtgtgggcccacccgtgcgcttgaaccacctgtaggagagaagaacggtcaccatgcggcctgaatctcggcggcttcgagaagcgctagagcgttttgagttttgacagggttgtgcagctgcggaggaagggggatgaccattttgctcgcagcatctcgcccggagaatggggccgacacgacggcgacacatgtgccatcaactacaaatggttagtaacagtggcgcggcggctccgaggaccgatgcttcactgccaaaacgagtttgggtggtgggtgccgtctgccgtgtgtttctgcctttcccgctttccggtctgccgaatcgttttcggaaaagcagggtgggggcggaccggtggagtgatgggggcggctacaatgctgagtgtatacgcaccggattgagatcctctccagtaactgcaccgtgtatttttttactgacatgtgaacccagagattatcaggctacataatcgggctatatatcagtgataaagatacggtgcaattgattgcagaggatcttgattcatacgcaccggtggctagactcccggcattgccacgaccgacgaagatacaatgaggctattcaccaaacgtggttggagatattattttttttccttgggacatttagggtgcgtggctctagcctctgccctagcatccacatagattcagatgccgccatagagaaaagaagtggcctcacaaggttgttaggcgtacgtagtatagaacacacggtattttggagcaaggataatagtgagcttatgtgaaggaaagatgtgacaaaaaataaaatgtgttaactctcatgtaagagctaatttaacacgtgctcaaatacaaatacattaaatatatgagtgagaaaaagggagaggagggaaaaattgaaaccaatcttatagctaatatattatttatgttggctttaaaatatgctaatagctattagtgagctctactattaaacttgctgaaaaacttgtgacgcaccatagacacagacacggaagccctcctcctctcacatcgtcctcccccaggggcggcgcgggaggcgacgccccggccgccccttctccctcacctccctcttccgcctcgccgcggggcccctcatctctcacgtgcttgggtgacttggggagtcacctagggaggcggtggcgaaaaaccgccagatcagcgccgctccgcccagatctagcggggacaggaacagcgtcggtggcaaagattgcgactgcggtggtagagttccgcggatccggcaacggtgtggcgtttcagcgatggtaggggcgcgcttctccagacggtagtacccgatggcggcggggacggtggtggcggtggcatttgttcgtggatccggtgacggcgcggcgtccggcggtgaaaggattgtgcagcgccgacggcctccattgcccgatgctaccttgtggcgtcggctggcgatggtggtgcaaggaagacggccggatcgggctcctaggtccagatctagcgcatccacagtcggggtcgggtggtgtggagtccggtcgtcgtgcaggtggtgtgaatattgtaggtacctttcggtgtgcaagtggcatttgggagcttccgttgtggatgctttggttgacagggtctccgaggtgaaaaccttgctctgctccggtgctagcaacggcgacgccctcgggtgccattcaccttcttgaaggcgttgcttttaaagcccttgtttcaactccacttcaagggaattctccgagtgaaaaccttagattcgttaggatcggacgttgtcgccgtcttgtcggcgttaccttcttgaaggcttcgttttaggagtttcttctcttgttggactactcttatttgcgttcagtttgtcaatgccgggttttcgccggtttttctaaaattaaccgtgctgttgtaaagtttttgggtctgatttttcttatatcaactatcttcttctatagtgaaattgtaggagctctctgcatgtccctaaaaaaactattaaatttgctcttaagaagaaaatgtgtggatctaactacccaattagagaaagaggagggagatttttagacgaggtctactcattgcctggagatgaaaaagcaggtctacgaggcagtgccaacaaacaccgtcaagatcaagatcagcacatgtcgttccaacaatccccatttatctcactcctctcaatctcttttgccgatgcttgctaaattattgccatcacgttggttgccctttttttcgctcagtccccacggcaaaactctagctccccctgtgccacactgccacataacttgcttgacggcctctgtgtcaaatccggcatgtttggtttcttgccggcatgctggtcagcatcggaaaacttccccttcaagagagggagagagctacaaatcggattaggcggatccagctcgtcatgcgaaccagcgccttcgccgccagatcgatctccttgaccggaatcaagtccagtcgatgcatggatggagcttcttctttgtgtttctggacgtgacccaccatagattttgctctgccatgaatcaagcaccgcctagctgcacaagcttaacttctagtttttgtttatgttgtcaatcgattttaaactaaaacagggtgttgtgatctggtctagcaagaaacggagagaggaaatttgggttaagaaagatgagctagcatgcataaaaccaaacgcacaactgccaataaggagtacacttttgattgtacatgttaacatatttatacaaatttaatcatctaattattaatatgtacttacttccgtttaaaaaaaagataacatagtactagaatatcgaatttagatatagaggatgtgtcacattctaattcaattgtcataatttttttttaagtagttggctctcggtatagctgcaaatctaaatgctacagtagctagtttccgcgcgcggcaacggggacccgaaccccgatctccggtgggaaatgggcatcatcgaccgtttggcggatgtgaatagcactactccatctgtaccgtccatgccacaaaacgagtggctcagatcgcacacaatccaagagacccatcaccttatcctcttctccctcccgaatccaaacccatcatcctcttccctccactccactgccactcgcgccacaagctcctcccactccaatggaggctgtcctacgacacccatccctttcccgcctcaaaccccccaaccccaatgctcagagaactccagccctctccatcaccgtccctttccggcttcgtctccccaaccggcggctcaccgccgcggcggtgttccaggaccagaccaacccaagaaacccagcgagcaagggaggcgacgacgatgaggcgtacggcgaggtggaccgtattgtgtccagccgcaccatcaagaatccggtgttcgcggaggacggctcggccaccacggtcaccgccacggagtacctcgtcgagtggaaggacgggcacgagccttcgtggatcccggcggaggccatagcggcggacgtggtggcggagtacgagacgccgtggtggacggccgccaagaaagcggacgccggcggagatcactgcgctactcgcgg

SEQ ID NO: 8152 - DNA, 44626 bp, Oryza sativa
  unsure (1)..(44626): unsure at all n locations
agctggagaaggccgtgtacgagtggggcgaagtggagaaggtggtggacggccgcggcgagggcaagtggcgggagtacttggtggagtggcgcgacggcggcgacagggagtgggtgagggcggcgtgggtggcggaggacctggtgaaggacttcgacgccgggctggagtacgccgtcgcggaggccgtcgtcaacaagagggaggcggcggaaggggaggggaaatgggagtaccttgtcaagtgggtggacatcgaggaggcgacgtgggagcccgcggagaacgtcgacgccgaactcctccaggagttcgagcagcggcaatctggggtggctgctggcggtgatgctccgccgccgccgccggtcgccgggtgacagcgtgtcgccgtcgacggagggtgttcgattcttcctggttttgctgtgtttaacagaacgggataaaatgtttgtgctgctgcaaaatgtatcattagcgctttgataatttttgagttgagcagaactttaacctcagattgcaatttgagaatgtgaagagtttcagaaaatggtgatgcatatggatccttcatcagttaagtatgattaggatggcaaaattcagtactctctcaagattagaagaagaaatgcttgcctcgtatcaaggcagccgatccaattggaagacattctgaagccaacgactctagctagactgcacaacaggatgcataagattcaggcacaatattgcagtctgacagagtgccaataccttgcacgaccacatgaacatatctagcagtctgatggctccaaatatcaggataatagaaaggaacagctcttagcatacataaaagtatatgtttattccttcaatgaataaataatagatcaaatatctttatcaaaaaacactcttagcatgttacattgtactcttccggtgtacagatctcacatttgctaaattgcaccaatgatgcagaaacaaaaggagatttgactctaaaagtaaatactttacaggtggccttgtgttcataaagaaccaaaagaaagatgccaggttgttggctccaatgtggtaaggtaatcatgaaatcaatcagcagcctgcaaaattaaggttgatgttatagacagtcaagtgcgctaagagcacaactgatggaattcccttagagctgcgttataattttctcagctctggaagtgaagtgaattttaatgtcacataaagctataagccttcaaggaatcaataggcatttgcgatatttgaaaaggaaggccatagaggtacatccaatgatgaatgttgaattctttatcagttcatatgattaggatggcaaaattcaagaggctccttagcaccttccacatcacttagcactacatacatcaccttcatgcaaactgaggtgatcattaactcacaatcatttcactacaaacttagtagttttggggtgcttcttagatcatcgtaaaacaggttttaagaccttcagtttatcttaagaacaaggtgcttaatatgatctaacgaagtaaggttgaatttaaggttgaacctgattgagagggttgtctggagatttcttccacaacttccatatcatatctttgtactgatgcagagtcagcccaggcttttcctccttgagtttggctagctctgcttcttcaaaagcctgcattaagataggatatgctgatcagaagagcacaaaaaaaaagggtactagatagaacacactaagaaatccagttggttagatcaagccagtgattgccaattggtctcaaactcactatagcaccaactaaaactaggacagaatttcagcctttgtaaaactgtgtttatgtacatcaactgctgcctatgaaccatgaatccagcaataattgcagtcacatctcaatgattctaagaatatttactatagtcagtattaatttctccccgagtactacaaatacaaggaggattttacagttgccatggaaagaaaaaaaacacacagataggttagtgccataccttgtacgagaccttgaggcggcgctcggggtggcgatccggtggtagcgcaggctcggcagcgatggacatcttgacgatggcgtcctccactgaccgtgcctcgatgatggagtcgtctctgttggtgttggcgacgagcacgacgcgctcgtactcctcctcttcggcggtgcgggcctgtcgcttcttggcggcctcagcctcgcgctcgaggcggatccgctcctcctcccggcgtcgcagcagctcggcctcggtgaccttggggacgacggggccgccgacgcgtgcggccttgcggtcggggcgccgcgcggcggcggcgagctgctgctgctcgagctcggcgaggcggcggttctccgcgcggcgtgcggccgcctcggcgcgcttctcggcgtcctcctcgcggcggcgcgcggagcgcgacttggggccctcggccgcctgccagtaggcctcctccttggcgcgagcgtcgcggtcgcggcgatccgcctcggcggcgcttcgtcgctcgcgcgccgcctccgccttggtgttgactcccatcttcttcggcattgcggcgggcggagcggggcggcgcggcgcggcgcgacgaggagacgagacagacgtgtgaactggctgcgatggggttcgcgtcgcggcgcggatgcttctggattcgtcttaaacgtaacccttccacctatagatgcatcggaccaccgatttattgacacgtgtaatgcgttgtgacatattgatacggaaacattactccctacgttaaaaaaaaactaatcatagttttggttcgttacgtttaactatttatcttatttaaaaaatataaaattatcatttattttgtttgttacttgttttgttataaaaaatttaagcatgatttatcttttttatatttacactaattttttaaataaaacaaatggtcaaacattgcaagaaaaaaaattaaacgacatcaagccccatcgtttggcctaaacagctaaagaataagctaaaatttgaatttttgaacttgattttgaagttgattttgagatgcttttaacgcaatttttttggttaatgttggcttttaagtcgttacgaacaaatctataaaagttttacttataaattaatttttatcgtctaataagcctgtcggggaatgaactcctccaccagggaaccgtgaggcccccctttgtgagttcggccgggggcagcgggtgagattcgaggattcggtgagcgaagctgtgtgatcttgagggggttcaatcccccaaagacgatgagacaaaaggggtttatacaggttcgggccgctaagaagcgtaataccctactcctgtgcttgattgattgagtgtagaacacaagtgcttggggttgtgagacccaagtgcccgttcgctcgaaagtcccccccccccccccggccgcttccgtgacttcgcgaggtgcgggagtggggctaggctgtagagccacgcggctggatgggaaggtaacttcccctcacttcgcatacccccgggcccatatctccgacagtagcccccagcaccatatcagacattggcctcctgaggtcggtctgacgtggtgcctcacgacttctcaagctggagttgtgggcccggcagggaatccaaggaaatattaccgagtggccaagttggcgtgccaaccacggcagcggtttggccgccactgaccgcgctaatgatgaggatgcttaaggcgcgaaaattagggggtcggtcagaccacgcatcgattccctcgcctgctactcctgtggcggtagtggtgacggttcgctcaggatgtgcccatgactgttgcgcgccctactccgagtgtgccgctgataggcgcactaaaggcagggcgcggattccatgggcgacgtgatgagtggacgcgagaaacgaagagacaaccgcgggcgcgagaatcgtgggggcaatcgtgggggcgtgaaacgaggaggtgagcgcgggtgaggcgaagataaaaggatacagaggtagggactttgcctccttcctttcgccatccgcccactcgtcttctcgctccttaagccctaacattctcgccacttcacactattccgcgcgccaagccctccgccgcttctctgccggccatcatggctcaagatgctggcgacacagtgctcccggcatcacgcattacgacggataggcaccttagcctcccccgcaagattatgtcggaaggcgccgtcgtgagggcgggggagtcgcggctgcggccacggtatccggagcgatccgtgcacctcttgtccttcgctatggcggggttgattccgccattcttcggattcttccatgaggttttggattgctatgaaatccatgccttgcatctcgcacccaacgccgtgatgacgctagccatcttcgcgcatctgtgcgagatgttcattggggggcagcctcctccctctaaacctgatacccccgagcccatatcaccgatgggagccatctaatttaggacgaagcattctgcttcattcggttctttcacacactcggttctctttaacgagcttctaacaagcacaacttcttcctagttagattcatcagcttctttcaaaactgcttatcggttctgacagctatagcatctcttaaaatcttcagcgctaaattcaaattactccatcaaaataaacacttctttagattctcgtcaactggctactcattaactgcctttatccgagggtaaaagactgaacaatacacttttctgtacaaatatcacattgcaaggtattatacattacattatgtacctaggaagagaagcaatgcgcccttttacattttacatcacaatctacatactacaaaatgattatacaacacctctcatttgggcttcttctatcatctcccaatctccgtatgagagaagagcagcttttactgattattacagtggttaggggctgtattaggtaggctatgcaaccgtggaacgaaaaccttccctcggtgtgacggtatgtcatgcggaattgttgtagtcagccttcacaacctgagttcttcactaaaaccataaaacactcgccttcaattgaatgaaacttgctctcgtgtctgaccttatgattgctcggttccctcaacagtgaaaccagattcttcagcaaggattggaagttcctggtcgccacccaaaacctgcatgaaggtcaatcaatttgtcaagaaagagcgaatgctgataagcagtcagcagtcttaggagaccatgaagatacagcaacgcaactgtcgattgcatgaacagtacctaaagtttagcgtgccatctaaagtttgcaatgtgccagtatctgaacagtattataaagttcagaagggttggtgtgcaatttcagagttcaggatgctagaagtgcttctaatcaaagtataggggagtatatagattttcagtacggcaagaagaaatacaatggcattatatttctggataataggctcaataaaacaatgccatcacaatcatgagcttgcttacaaacatcaaagatatggtaagtaccttgccgttgataatccatgtcggaaaaccttctataccagcagctgcacattcaggagccattttctttcccttgccagctccattaggaaaacattcaacatagtccagaatttttgtagcttctcgaccaaaaatctgcatgaccacatgataaggtaagtaaaaacttttctacttccagtttggagatttagttgtgcacacaaataaaaaaacgaaataaaaaatcatagcatcagcatatttacagaagcattagagtagagcatgtaagaagctacagaaaatcatccggtattctgtacagtggattcaagagcttgtgttgtacctgtttttgttcgttacaatgagaacaccagaatgctccatacatcttagcgccaacagagtgcaaatgttttgcaagtgcaatagcaaatggggttgattcggttgttatctctgtatcatatcgttctaaaacaaaatcatctgtgctgcatatatagaaaaagaaaactgaaagtcactcacttttggcgatgaagacaatgcaatatgtaagataaaagttcatatggtattaatcagggaaatcccacaacaaaatattgtaatagaaagagcggtgtttttcttaacatgcgttttaattgtcaagaccaaaacagctgctccaaacaagaatttatgatggaatatgatgttagaatttcaatggttactctcactgagaagaggatggcactcgagatggggcaattttctgattttcttcattcactaaacacaaaagccatgcctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcaactgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgcggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctgctgcttgaccgactgccagctaacgaggcacttgccgaggaagaagagaatcccgctcgtgctcttgctggtgtcgatgtcgccggcatggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctacatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacacgcttggcgtaggcggtctgtcgaagcgtgatcccggagttgtcctggtgcacttcgagccccaggtagaaggagagaggccccagatcactcatctggaaggtggccttcatctcctccttgaacgctgcgacctccacatccttggtgccggtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgctgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcaagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccacgtgtttctcggcctctgcaaaagaccgaggctcaccgtcgtcgcacgcaaggtgcaactgtgcctctaggtcgcgaggcaccagtcccggcaccggctggtcgccgagaagatcctccatcgtacagtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggtggtgtcgacgaagagctcgtcgtagtcgaagtcgtggcccgagggtgtgttggtgtcggagtcggtggagattcgggggctggggtagacacgctaggtgaagaagagctgcctactcccccagctccctcgaagtggacgtactcaacggtgaagtcgtcgtatgtcggagtcgaaccatcgtccaccgccttgtcccatacccaccctcgcccttcgtcgaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagatccttggcgaacgcgaggcagccgaagacccgcaggtgggagaccgccggcttgcgcccatgccaagcctcgtacggtgttctgccatcgagggccttggtaggcgagcggttgaggatgtaggcggccgtcaccaccgcctccccccagaagatggccggcatccccctctgcttgaggagggcccgagccatccccacaaccgtctggttgcggcgctcgacgacaccgttctgctgcgggctgtacggcgtggtgtagtggcgctgaatgccctcatcagcgcagtacgacgcgaattcagccgctgtgaattcgccgccgttgtcggtgcgcagcacgcgcagcttgcggccacactccgcctctgcagcagcctgcgcatgcctgatggcgtccgcagcctctcccttgctgctgaggaccatcacccacatgtagcgggagaggtcgtcgacgagcagcaggaagtaacgtcgtcctcctggtatggctggtgtcactgggccacacaagtccccgtgcacgagctcgagccgctccttggctcggaagctcgtctgctggggaaaggggagccgccgctgcttcgtcaccacgcagacgtcgcagagctgctccacgtggtcaaggcacggcatgtctcgcaccatctccttggcactgagctgcttcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctagagtcgaactcggtgaagaactcccgtcggccgatcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctccacccgtgcgacgtgggcctagccacgtcgtggctgtcgacagtctttggcccaatggccaagcttgccacagttgcggcaggcgtcgtctcgtgccggcttgtggttgccggtggcaacgccctgggcgcctctgcgggcaccaccctcggcacgtcttcgcgcccaccgtagctagacacctccccgcgccttgcgcggcttacggccgcctgtcggggaagatgactcccccttcctcccgtcaccctgagaggcctcccactgctcccgagtgagatggagcttcccgccgatggtgatgggccccgagagaggctgtggctcatcaccatcgacgaccttgaggcgacctaacgcctcctcgatcgacatcgtggagaggtccagcagagattcgatcgagcgagcgatctgcctgtacttctcagggacgcagcggaagagcttctcgacagctctctcctcgtcgtaagtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgataagggcatccagtgccctccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgctggtcaggggagagagagccgtgctgcctgcaagggccgcgtgcgggctccgggctaccgccggcacgcccgcgcccgtctgggttcccgttggcgggcgcgcggtcccttgggccgccgccgccgccgtggaggtgggctgctgcccaccgctctgctcgctcccgtgcccttcctcttgccagctcctcaagctccctgtcggcggtgatgtcgccggcgatggagccgttgatgctgttgcgcaaggtctcaacctctacctccgccgcacgtgccgcatcttccgccgcctccgcctccgcctccgccttggctgctgccaactccgctgccgccagtctggccgccctcgctgctgctgctgcagcggtctgagccgttgctcgcctgcgctcttctgctgcggcgagctcggcgtcctgctgacgctgagtgctcgaggcgaccgaacgccgagaccgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgcctacccgagggaagttggatacatatatatagccatagctggctgctagcctattgctgcaccctcctagtctaaaattcgaaatttgaatgggatgctgtcctagagggcatccaaactgaataaagcataaaggaggcataaaggaaatgctaactgctgctgtcctactaaccgcagctgtcctagcacctgaaaaatatgctaaagggtagatgctgtcctgaaaaaggtgaactactccaaaagcaaaaagaagaatcacgaccaaagaccacaaagacttatccaacatatgaaacaaaatgccataataaaagaaaaaaaataaaaaggtttaacagaaaacacatagtcgaaatgtaataaatgaggatgccatatacttagtcaggcatttcattatttgacgcttaagacctaaccaatttcagagaaacaaatacatttggcaccacaaattttcaagagcctcacccgtttaactgtgttgtagctgaactgtaggaatttgtcagagcaagagcaacaataattgctactgataattgaagaccaacaaacttctggacacgttccaaaccgaggtcctgcattaatacaataaacattagtagttgagtaggttacttaattactaaatgtctcaatgaaaaataaagggaaactaagcgctcaccttaactctgatggaaaataaagtgaaggagagaaatgcagacaacaagcagtatgaacaagacgtcccaataaatctagtgtttagaatatataggaaataagaacttgcagtggccattgaagtagagatcagaagtaatgttaaacgaatatccagatcatcaattccagggaggaacttcttcccattttcttgaagagagagcgttaaaaccaaaccatatgccaccagaccaagtagtggaagaggaatccctgtcaaattagagagagaccaactgttaaaactacagagcacatcaccagtttgctttcatcaaggtaacaaacgggaaacatcaagtttagtcaaaacaccatcatagatatatcaatagaaggatagataattagccatataataatgaatatctgagaaacactatcatcagccactatttcagatgaaattggtacttatacttggctttcagtacacacttcgatccttacattggagaaagtatagttattcagaatttccacagtttcaacggacatttagcaggaagtaatcggcaaaagcgctaagagattaccgaagacgacagagtagtcgctttggagcacgtcgccgcagcccccgccgctaaccgggcagaacgcctcggagcccgtgagcttgatataactgaggtaggcggtctccagaaaccccagcccggcgacacccgcagaccaggtgctcgtggaaatgccccacagggacgacggcgacgcaggaggcttcactggtggcggggccggagtcgaggggttctcctgctccggtgaagagggctccgcgcagcatctgaaccgcgcgggtcgctacacaaaccacggagagtcagagccgccgaggaggctcttgcaagcagcggttgggttggggggagtttaccttgatacgccaggaggaggaggaggaggtagtggaggtggaggtggtggcgacggcgaagcgaattgatgaagggaggaaggagatggagagagtcgcggagattgtcgccatggccggcggccgaggaggtgagatgtcgcctcgagctcggaggctttcctcgcgtcaaggtgaaggatataaaatgaacttattccatgtgcataagatatgcgcgcagccttgactctctgggcccatgagccgacgtcccagatgcggctctgcgtccagcccagtagcacacgtctaacctaccggcccggaggcgcaacctgctcgcactcacctagccggcggccgcgggcgagtgatgacgacgccacgacggcgcgctgacccatcgcccccgcctgctcgccgcctcctccaccgcctcggctccgcggcctccggtctgcaggttagtctctcgcggtcctgctaccggggcatttcgtcgagcgccttgcgggcgacgcgcttgggctggaatccctctcgtcttactgtgcttcgttctgttgcttccagacgctggcgtacagctcgaagaaggaaggcggcggcggcgacatgggcccacgcaacggcggttcctcttctaatagaagaccaggtgatgttttgatcactcgtgatggcccccggagagcagatggttgatgctcacacgtgtagatcagtaaatcacatctgtgcaattcgccctttcagcaaatgagcaaatgctattgattgtgctgcacggtagcttggttacgtttagctggaaatggcgtactttctttgtggtacacgggaactgcataggtgtttacttgtttagtattttgatcaaatctctgcttttagtggaataatgcaggcagaccttagctaactactggttacacagcgggaaacctaaaaataggatttgtgtttgtgcaggatttgttgattcttcttcatggagatattttgactcgagggttgttggtattactagaggggatatacctcgccatgcctggactgtcctacacatgctaaaacgaaaaggtgggtaataaatctcttgaacacttatttatatttctgagtttttgtgcattgatattccatactcatgccaccgtttgctcctgtacggtaaaacatgtattactacgaatgaaattatgcaatatattagtggttgtttcctttttgttgcattacaccaagtgagctattgtaatattatccaaaggcaaaaaaaaaagaaggtaatcttattacacttgtcccggcaatgcatgaacttctatcttaatgtgccatagtgcagatgccatgcccatccattaaagcatccccactaatcggaaacatgtttgaggtgaaggcaagcaatagttcaaaattgtaacgtgagatggttttggaactcaatttctcagcttccttcatgttaactatagatcctttgggaagcatgaatatgctgcttgaacttgtcggaagagtacacatatggaacattttgtggtgttctcacttttaaatatgtatagggatgtgtttatgtatgcttactctattaaagttgtactgcagggtttgcagcttatcttgttgggggatgcgtgagagatttgctactgaaaagggcacctaaagattttgatgtgattactaccgcaagcctccagcaggttttggtgcattaatttgtcataagtgttcattttctggataaaagcaaaagaaaaaaaaaagctaagttgacagacgttgcttttttttttcagattaagaaaatggttttccaacgatgtataattattggcaaacgctttccaatatgccaggttaatatgtatggcacaaaaattgaggtgtgttattcataggaaaatccacattatgaacaattgtctttgcagcaactttgccaaatgcttatttcttgggatttcttttgttctaacaggtttctagctttagcacgaatgcaaatcatgtgaaaggaagtaaaaatataggatgttcagaggagtttaaacgttatgatgagggggatattcttctctggcagaattctatgaaaagagactttacaataaacaggtaatcttctgaataaaatcttgtgcctgaaatgtttaacagatgttgttgacttctttttgaaacattgctggaggtaattactaacattgttgtaatcctttcatggcagcttattctttaatccatttaactttaagatttatgattatgtgaatggagtaagggatattagcaaaaacaaggtaacaattagcttggttcatctcaatccatgcagatatccagaaatatccttgtttttttccccctttggctaactccttgagtggataacaggtgtctacagtgattcctgcccgtgtttcattcaaggaagaccctggtaggtattcaaagaatattcctcatttctttaatctatccacagaaaatttagattctggtttatttcagccaggattttgcgtggcttgagaattgctgctcgccttggttttgagttctccagtgaaacttctgctgcaatacgggaactttctttgtccataacagatattgacaaggtttgttgtatcccaccatggaactatatgtatttattgcataattgccactagggcttgcactatctgtcaacctgccatcactttttctgtaattgctcaaatgtcactacttttctttcagagttgtcaaaatgccagtacactgttaagtcaatggtttttgactgtctctatgaccgaaatggcttcttgatagcatattaaaaaaacaagttatttctcttcctttatgcacaatcataggtgacttgcaatcacctatgaaaaatgaaagctagagaggagaaagaaaatagagatgaagggaatttggacaatttttagcctctaactagcatttttgcgtcacacttgaatccaatgagataagagcaattgggcaaaaaccctgtggcattttgacaattagagcatgcactgatggcaaaatgtaccattgtttcttttttttctaatgcttttgacctcattactgtgtaggcaagattaatgatggaattgaattatttattgtcttatggggcagcagcttcttctcttaggttacttagaaaatatggacttctcgattttttgctgcctttccaggtaggttgagcaatgcgatcatgccattgcgtaagtagagtcatgcttgtggtactgaccacttccatctttatcttacttgcatatgtaatgatattttcattttaggcagcatatatgtcggatcagatgaaggataaatcaaatgacacagatttaatgctcatggtgagtaactctggaaatgtgtcatactatatgatttttttttgcttcataataaaaggtgaaataatttaaaccacgcacatgtgttggctagtgttagctaactagtgttgttacgcatcaatatccatgaacatgaagtattggctgcatagttctatagttttgttactgttcatcagctcttgacagtcacttcttgttagttgccttaatgtaactatgtaagtagtgtcttcctggtttccttttctttagtcagtgacttagaagtgtaatatttaagttttaagactagggctcgttatgtgtttatatatgctgtataatgatgtgcattcacatgtgcagaaactactggctaatcttgataaattactctctgctgatcagccatgcccctcctgtttgtggtaagaaactttaaatgaatgcctgtgcgcatttaccttcattatataaaggggtgtgaaaatcatttagtctttgttcggttaatccctgtgaaggagggatcggaggggatttattccacacctattgtggtgtggaattattccccctcaatctcctccaatactcttcaatcccctctaaaccgaacgaggccttagtgttcttttttgtattggctggtcctacatatacactttgcaggagatgcatagtactagactacaatcatcaaaattcaaaaaccagaagtgtagctgattaaagatttgcactgaccagagtgatagagatgtatagtgaagttaatattcctttctttgcagtcttagggacacactgatgtgcactgtgagtctagcggttctgactttccagttttcatcactagaagatatgcatggatttctgtgaaattttgagtgtccagtagtatactggataacttgtgtgagtcctagcccgaaggacaaagtggattatcttattatctatgtatgccaccctggaatttctcacacacttgcgcacgcacctatgcacactgacacacacattgcttttttttttagagtgttaccttttttttctacactagtattatataccactgtcaatttgcagttgaatgttcccattttgtgtctaatacaattcttgtatattttgagcaagtcacgtctatggcatttcatgttattccacaggttagcactgttgacatttcacagtgcattggtaaattctccacatgatgcccaggtaatcagggcttttgctgcactaatgtattttggatcatgggagggcgcagtcaacttcttgaatcaagacattggagcaccagccccgtttattccagaaacactagggccttctcggagcaaactggagaatctcatggaacaaacatcacatttagcatcactagtcaagtcgtcagttgatacgttgacatctatagatgctctccaacaatcactggccaaatactcaaaggcttcacaagtttcaggactggtaagtatttctttagcatacgtctcaactcccaattgtcatattaattcctggtatgaaatccatagttgaatcattgaatgttgcttgggctcttctgcaagtaagcatgcaaatattgactgatcaatcattgttcagagccacctaatggagttctaatattgtgtagtaggaactgttctaacgatgcatgaaccattgtttaattggccccatatttgttcctaaatgaatttttacattatacatacaaagcgtactaaaattttgttactgggtttgttatcaggtgcttgtatctagcagagagagggagagagtgttgagaatatttgagggccttgatactgacttaacttcatatgaagggacaagagggatgcaggaaattgattataagttactgaaggatgggcaccctggtgaggtccggtttgttcttgggcaagtaatcatggacactatgagcgaggagttaccacgtgtatccactgagtatgatcagctcaatatggaggctagtgaagatgatcttgctgacggaagccgtccttcactgtccacattattttccagtaaatcgtgatggctaagccgtagtcactcaacaaaaattagccaggatctctccattccatgattccataatcaacgcgctcagcgcatcgaagtgcttgggcgtgcaggatggtcagttggccaccatacaatgcaggcgaacttttaccgcagctaaactcacgtggatgctggagaatgatgttattgcccaagtgcctgccttgacgtctttttgtagtagaactgagtctagtgcgtagatagtactaccagataattgtaaccttatattattcactttggcttgttagtctccgcgtactgtaccaatgttgagtcgtactgccccttgaacttttgagcttaggtgaactgaaagtttgaaactgtcgccatggttacttgggttgaaaatacttcatcagtaatttgattacatgtaacatagcgaactgccatgggatttgataaccatgagatatttactggatttctgatttgcaatgagttatatataccctttcatccaactagccatttgggtataaagatttcttgctgacttatgatgtttttttttccttcttagaggaccagtaaggtactatattgttttgatgggccgagactattagatggcaaaaggggcaaagcccaattactgaagcccatgcatactctgtccctgttggccttggacacaaatcgtgagaaggacaggtgagaggattctcctattgtgaagcccactactaaattgatcttacttttttgtttgctcgtttgaccctgtttttcaaaaccgaagatcacagctgaccctattccgtgaaggcccaataacggtgttaactcagaagcaaattgtcatttttgcccttgctcatttaaccatattatatcaaagcttttttttattcatttggaccttttcaaatatttgtagtaaatttggcatagcttgacaaatttgaaacaagtttaacagaattgtcttcaatttgaaacgtttgattcaatttgacattttttttacaaaaatttcaagcgtattgtcgaacagaaaatttcagatccaaatacatatccaacagtagtcggcgccgttgctccttcctccctccgcggcagcaacatccatcacctctcctccaccagtcggcgccgacgtcgtccctccctccctcgctccgcacggcagcagcagccgccgcttctcctccacgcgcccgtgcagacgcccctccctccctccgcacgggtgccaccggcgcctcgctcacaccacgcggcagcgggcaccgctgcttctacgtgcaccagcaccaacgatgcccctccctccctccctccgcgcggcagcagccggcgccggcagccgcttctccttcgcgtgctagcgccgacgcccctccctccctccacatggccgcacccggcgtcgctgctccaccgcgcgccggtgcgggcctccctctgcgctgccacagccagcgccgctggtcctccgcgcaccacgaatgccgcccctttctccgcgcgcccaggccgaccgccgtccctaacctttgctcggcagacaccgctcctcctcttcctcccttcacgaatcacgccccggccagccacgccagtacgccactgagacgtgggatgatgggatgaagggatttgcaacttgggacaagtaatcaaggtcattttggtccattcatgttagtaaatttattttttctttttgttaactgaaaccctaacgggctagtgaaaacagggtcaaacggtggcttcgattttgaaaagtggggtcaaatgagcaaacatgaaaaagtatggtcaatctggtagtttggttttaaaatagggtcaaataagcaattgtccctttagagtatgtatactttctataaagttatagtccactaagtctaaagctcaacatgcaatcataccacatgatcacccaatagcaataattacatattaagcctcatacaggtatacaacatcatctacaatttatttatttctacaaatcaatgtgtaagcatttccaatcatcaccctcacaccatttgcacaatattttaacaaatccatctaccatttttataagatctaatatatacttataatatgtttcacattaaggcgcaatatcatttgtttgtttcatgattatcattgataaaacctgatgcttcatttttactcctagtttgattgtcgaaaaaaatatattgataattgctttgtaattatcgcagcaaagcgcggggaatcacatagtgttcttaaaccgtaataccaatacagatataacgcgtctcttaacttataaatcgggtgctttttgccatgtgtggcccgctgctcgacagacgcagggagagaggatgaagaaagctaggaggagagaggaggaagctaacatgtggggctcatcagttgtttcttaaaatattaagctgggttttctaactttttcagattctcaccagctatcttctcaccggctgcttctcagaatattcggactcccacaaacaggaccctatacacattcgacagcagaatacgtattatgctcaaatacgccttcgcgtggcggtcgcgtaagataaactgtgacggtgctagaaccttctatccacccacgactatattacagtccggtccacgtgggggcccaccccacctcccttccctcgcctcgccgactcgccgtgggcccccaccgacgcaaaggaatcacagccttccatctctgtcgcgcacttatttccgccgttaatctctccgcccaaagttattccgccgcctcctcttccccccctcctcgttctcctccctcccacaagcccgtgcagacgagacgcgacacgcgacacgggaagaggaggggggaggggaacacacgccacactcctctcgcccgcatcgcactcgcaccgcacgcgtcgaaggatcgggaaggcgcagccccgcgtcggatcgagagctagggttatgagcggcggggacggggaagaggcagccgccgcggcggcggccgcgacgctgcacatccggtgcaccaacggctccaagctcgcggtgcgggccgacctggggctcagcgtcggggcgttcaaggcgatcgtcgccgagagctgcgacgtgccggcgccgcagcagcggctgatctacaagggccggatcttgaaggacgagcaaaccctagccagctacggtacgtgcctaccctcttctgtgcggttagaactagcttgtgtggttgatgcgatttgctcggtctgtgcctgagatgcgatggtttaggtccgattcattctagttcgtatgtttgatacaatgcgccaatgccgttgttgtaggaggagtcaggagtgcgaaggaaagctgctcctttcatgccgtgtgtgaattatctctttgattttccatgttattacttggtagacgatggtattattgggtaagcagcatcagggagacttgcacactaatttataatgcagcccagtgaagatgcagtggaaggcagtatcagggagccttgctactctaatttataatgcagtttagcgaacatgcagtagaaggaaaacaagcacttccctcccttcttgacatgaaagtgattccaaacatcatggagccaccaattgcattgttaagtgcacacgtgcgatgtgaaattgtatctggtaatgcgtggttagggtatttttgcaggaatataacattccttgctggatattgtcagcataatggcatcttagtgattagcgaatatggaagctttataatgctgtttttattgtcctgcgtcattcgttgcaagtgcttgttatgaactactcgtaatgatccacgtgtaacgtgataacttgtacatctggtcatggccttatgatgtagcattaattattggcttgttatgacatcaacagaagctaaatgcgcagcactatccacatgggcaactctccacagcagtgtagaactgaaagagattcaatcttccaaacgtactacaaaaactgctactgtgatgcatgctgtttggtgcatgttatattccttttcaagtaaaaggcagagggttgtactgtttattgcagattctttcgggccactagatgaagctttatatggaattgaattaatgagtaaaatttgatactgagcatcgggttttgatcccacctactgcatccatgcccatcatatcctcttgcatttgaacctattcaaatctgcacccatgtgtttccgaatcatttatatgaggtttctggtttttcttttcaacgttgggtgtggatattggtcttcgtgaaagaaggttatcctcttatgcagtctttgcccacctttgtgcttttaaaagtgttattacctctgtcccataaggagttttaggattggacacgtgtattaagaaagttgatggaattaaacggaggaagattgtgattggttgagaagaggaggtaggtaggtaatttgaatggtggatggttgtgattggttgagaagagaatgtaggtggagttgttatatttaggggcaaattttgaaggctagaagttgttatattttgggacggaggtagtaccaatttttattttgctcacgtgcacatcaacttatgagttaccagatatgctaggtccatctactcaattttgacaaatgcttttagaaatcattactctttgaatgcagcaagtttactgctgcagtgcatgtttaaccttgagtcacaaagattttccaaatgtgcttattcttatgcctattttccctcttgaaggtgttgagacggatcacaccattcacatggtccgtggtgctgcaccaccaccagcgtcaaccgcacctcctgcagccaacaatgtaactcctgccattaatgctaccactgcttccaattcaccagcagttggttttggaggtttgttgcatggtcttgggggttcaggttctgctaacagtggagggttgggctcatttggttctggccttccagaactatcccagatgcaacaacagctatccgagaaccctacgttgatgagagaaataatgaatatgccactcatgcagaatatattgaatagccctgatctaattcgcaatataattatgaacaacccccaaatgcgtgaaattgttgatcgtaatccagatcttgctcatgtcctcaatgatccaagcattctccgccagactgttgaagcagctaggaatcctgaacttatgcgagagatgatgcggaacacagacagagccatgagcaacattgaatcttctccagaagggttcaatatgctccgccgcatgtatgaaactgttcaagagccatttctgaatgcaacaacgatggctggggagggtgatagaagttcaaacccattttctgctctcctaggaaatcatggatcaaaccaagccagagatccagctgcaaattcaccaacgaccacctcagaatccacaacaggttctcctgctccaaacactaatccacttccaaatccctggagcacaactggtaagttttgtgtactttgttttttattttggtgtatgttttcttgtcctgttttggtatcctagattcgcagatgggattctctctgactaatacgtaaatcaacagctggagctgcacagggagcaacaaggccctctccagttaccaatgcaaggagtgccacagctggtggcctaggagggttaagttctacagatttgggaggtatgctgggtggtggctcggatacttccttcttgagtcaggtgttgcaaaatcctacaatgatgcaaatgatgcagaacattatgtcaaatcctcagtccatgaatcaggttcgttgctctaatctttcatggaatagttgatgttgtgcttcttgatatgcatgatacacagtgttttaattatctaatgatgtcgtcttgcttgcagctgcttaatatcaacccaaatgtacgtaatatgatggaatctaacactcagttgagggagatgttccagaacccagaatttgttcgccagttgacatctcctgaaactttgcaggtaaattagttatactgctgtagtgtatggaaatcagatggcttatgatgatttttttgtgtgtatagcaattaatctcattccagcagtccttgatgtcacaacttggtcaacaacaagctggcccgtgagtattccccagttcaacttaacctgtttaagctcatcatgtttatgtataccttttctttttctaagttaattgttgagtgtaaaatcaagagatttttatttgtaagtctcgcctatactactgcttattgaatccttttctttctttctttcttttttgaaccagagagcgaacccaatcaggtgctggtgcaggtaacttcctctactgatgttcactatcagaactgtctttcacagaactatcagatacatatgtcaacttctagagagtcatataggctaagattttttttatatttgttgataaattgcagaatcatattatatcatttcttgcaataagtttttatttactaagagagcaataggatgctcaaattttgcctttttagatatttatatcgatcatgtacctagatgaaacaaatgaatgccctccagaccaaatatagttttctaggaaacaattttagtgatttaatttgttgatattttgtaccctggtttactttgttagtggtagttgaatcaggcatccaactcaaatgggattctgagttcatcattagaaatcaatgtgaaatgtaagatgttaccatatcttgtcaactggtagtatattaaacatggtcagatgtcttatttagattgttgaattattgatagtatatattttggtgcttcattgaaattaatttagaatactttaatggcacgacttatgagagtactttaatgccaggcaatactaacctcaacaatctgatgagcatgttcagtgggctcggtgctggtggtggcctaggtgttcctagtgcacccaatggtaagtgattttctctaaattttggagtgcaatactgcaagaaatagtcacattaatatttttttgaaattcttttcgagttggagtcggttggtttgccctcattaagcaatgccaatatttgcagttccaccagaagagctatatgcaacacaactagctcagctccaagaaatgggtttctttgacacacaggagaacattcgagctttgattgctacagcgggaaatgttcatgctgcggtggagcgacttcttgggaatattggctgatagactgttgtgatcgaagatgtcctcgacttgttacctgtagctcagattgtaagattgtctggttcattggttttataccgtcagattcaaaggcatcatctaggtacatggtttagatgaataaatgagtcaagtgggttaacctttccatacatggttgtcatgtcgtgatcgagatattggtgtattgatggtactttgggttggtgtatatacatattgagctattggtggttactgcagtgtacatgaccgttgtttatgtttacttgcctgctcttacaacctatagataccctaactcttcactgaagatgtgctagaaatttgctttctcatgtgttgatggcattattggattgaaaaggggctcttgtgaagctaaaactctacaatagtgaaagatggaaggtggttggctacctttgtcatatcaggctctaacctcttctgccggatgtatgaatctattgttaagcagctcaaccgggtgacgaactggtgacccctttgcgtttgagggcgcctttcggttctcaatctgttattgttgttgtggaatgttatcctcctctctcgcgtctggcgtgccagtggccgcgcggcgcaagatgcctccatctgcatgcaagatactttacatcagtgagtgtaaaaaatccttgccgggatcaggtgaaaaatctctgcacatatggtacccgaaaaaacaaccaatactgtctcaactggcttttgtcgtatgtttttcctgccttttgggaaatggaatagtcacacacacatggatatactatacgtatcgggtcaatgtgaacagcatctgcagcccgatcaaaaattcccattggccgtcgcgttcacattccagaggctagtgcagttccaaaaaaaaaaatcgctacgtttatctgacgagcagagaggccgcagcagaaacaaatcccgttatttttctggacggcgagcgccggcggtggagcgtgtggatgaggtgcggcccatgtccactcatcccaagctccccccatgtctcccatccaccaccgctcgctttgcaaaagcacacgtctctcgccgtctcgcgtactactaggcctgcgtgcgccgtagccccacgtactccacatcatttgagcccggaaagatccgggacgcgacaaaaaaactcacgacccagagggctcttctttctcttgtggcccgctataagtagggcggtgtgtggcgacattcgcgagacgttcgtacgtaacgtgaccgagcgcgccggacgccgtcgtcgttaattaatcagccatggatccctacaaggtaacgaacgtgctctgctctgcttctggggcgaggggtttgagagtgcgttggttttttgtggttttgatgcggaatttggtgtgatgcgcgcagcaccgcccgtcgagctcgttcaacggcccgctgtggagcaccaactccggcgcccccgtatggaacaacaacaactcgctcaccgtcggctcccgaggtacgtatgaccacgccaatcccccttcctcctgtggtttgagattactttttgtgtcttctgtggtgtagcctttgctgctaccagtttaaattcaagaacgtcatcccagtaaatctgtgctagtctggattcatttgttttttttcctaaaaaatactttgatagtatttggttacaacttataacaccatgtccagaagattagaacctgttgtgttttcaagctacaggcggaatcatttgaaaattgaattgtttcctagttcctcctacaaattgaaactgttgcgtttgttagagcacatgaatttcatacgattctgtacatctcagctaggtccagactccgtggggagcaattcactacagtaaattagtactaattacgattttacgatagtgttccgtagcatgtttgtcagtttaattcaagtcgagtggtgatcgatgaactgaactgaactgggaacactgaaaattcaggcccgatccttctggaggactaccacctggttgagaagctggccaacttcgacagggagcgtatcccggagcgcgtggtgcacgcccgcggcgccagcgccaagggcttcttcgaggtcacccacgacatcacccacctcacctgcgccgacttcctccgcgccccgggcgtccagaccccggtcatcgtccgcttctccaccgtcatccacgagcgcggcagcccggagaccctccgcgacccgcgtggcttcgccatcaagttctacacccgggagggcaactgggacctcgtcggcaacaacttccccgtcttcttcatccgcgacggcatgaagttcccggacatggtgcactcgctcaagcccaaccccaagtcgcacgtccaggagaactggcgcatcctcgacttcttctcccaccacccggagagcctccacatgttcaccttcctcttcgatgacatcggcatccccgccgactaccgccacatggacggctccggcgtcaacacctacacgctcgtcaaccgcgccggcaagtcgcactacgtcaagttccactggaagcccacctgcggcgtcaagtcgctgctcgacgacgaggccgtcaccgtcggcgggaccaaccacagccacgccacgcaggacctctacgactccatcgccgccggcaacttcccggagtggaagctgttcatccagaccatcgaccccgaccacgaggaccgcttcgacttcgacccgctcgacgtcaccaagacgtggcccgaggacatcgtcccgctgcagcccgtggggaggatggtgctcaaccgcaacatcgacaacttcttctcggagaacgagcagctggcgttctgccccgggatcatcgtgccggggatctactactccgacgacaagctgctgcagacgaggatcttctcctactccgacacgcagcgccaccgcctcggaccaaactacctgctgctcccgcccaacgcgcccaagtgcgcccaccacaacaaccactacgacggcttcatgaacttcatgcaccgcgacgaggaggtcgactacttcccatcccgctacgatcctgccaagcacgccccccgctaccccatcccctccgccaccctcaccggccgccgcgagaaggtaattctgttgattgatttgcgtttgggttttacatttcactatattttctttcttaattactacttcccccgtttcagattataagatgttttaattttagtcaatctcaaactataagtttaactaagtttatagataaatatagtaataattacaacaccaaattagtttcattaaatcattaaatctatagttcaatatatttattatgagttaaaaatgttactattttttatataaacttagtcaaatttaaaacagtttaattttgaccaaagttaaaacgatttataatctaaaacaggagaagtagtaatagctagtcaatttattaactggttttgatcgatcgggttgcgagtgcaggtggtgattgccaaggagaacaacttcaagcagccaggggagaggtaccgttcatgggatccggcaaggtatgtacacacatgcagatgcagcaaccgaattaactgtcgagagactgaactaaactgaattagtcaactagactgattgactgatgaacaaatgctaaatgcactgcaggcaagaccggttcatcaagagatggatcgacgcactctctgaccctcgcctcacccacgagatcaggagcatctggctctcctactggtctcaggtaaatacatcacattacagtttgttccataaattgaaaaaaaaacgtacaacatgatctgtataatctgttcttggttctgaactgcaacttgaacaatctactatgtctttcgatgcaggctgacaggtctctgggtcagaaactggcgagccgtctcagcgcgaagccgagcatgtaaggagatcgatcagcgttgcaatctgcttcagtcacggaaggcctcagcctcactctatcggataataattgctactcatactctagcaataccgatcgatcgagtctattttggaaagaggacatatatgatttctatcaccgcacaattcgtgtaccaccatcatgtaataatctgtaacctgaagacacgtttctcctgatacttcatcattattgtaagcacaccttttatcaataatttatatacagtaaattaattatttaattataatccctttttttggaattcttgcatatggccactttattggcataagggaataagttcactttagatccctcctgttgcgatagagtttgatttgcatccttaaccgaaaatatcacatataacgtgctccttaacttataataccggagtatctaaagtcccatggcagtattgtgagcggctgagatggcgacgagttaacgtaggacccacatagatcccacatacaagcatcactttatttttttccctcaccccttctttttactcatctctctccccaatttcgcatcctcgtcgccgttgctaccatcctcgttagagccccaccaagaaaaacaatggagcacagagtagcgatgaaaagacggcatgcggctgtgccggcgctggccccgccatgggcgtcacccggccttgggaagcttgtgtggggcagggtttccaatttctatttcagctgaaatttcggccatttcagttctactaaaattctggaaattttggtacttttgggcactttgggagcaattttttttttgaaattttaacataatttactgaattagaatgagaaaaacagaaaaatttgcccgagatgatcacttgcccagaggaggggggggggggggggtttcgaaaattccgaaattgaaatcactggtgtggggtggtggcacggctagccattgcgctgtcgccgatcatgttgttactggtgacgacggcggccaaggagcaactggactggatcgttgtcgctggcggggcctctagcgagacaaagccggcggtgtgggcggccacgatttcctcgtcagagaaaaggggaaaagaggagagaggggaggaggaagaaacaccatgttgcgcgcccccgggctgcttccgcttctcatagggcgcaagtgcatgaggacatcacagacgggctcaccgaaggcgacgatgaagtcgtgcgaagccgacgcggggtgcggtggtggatgctgtggcggcgaaggaggcttgaaagaaacggcatcgcggtggggaggaaggagataaagtaacagctcacaatcctggcatgggacttcagatactccggtagcagaagtttagtgatgagttgtatctggtatttcggttaaggatgcaaatcaaactcgatctcaataagagggactaacaacgaacctattctagtggattaagcagcggccgggatgggcatgaacctactttgtgggccatcagttgggctactgaaatttcaggcctttgcagcaacgcaacaacagcccaataatatatttttttgttctagttgggacacgatagtttggcactaccacaagtgctgtgcacagcttttttccgttcttacagaaacaacaacaacaacaacaaaagatttgttaaaaaaaacaacaacaaaaaaaggtcaataggctagctctatttgaaattgaccctggggcctgggttactacgagtttcaaaaaggaatagcaatgtgccgacacagtgacttttacaagtgcaacgttgcatttctacgacgtacgcttctcttgcactccactagaaagcattagcttccttttaaaagccgtacgtgtacgtagcactaacagtgcattaccgaccgcccattcgtacttcgtagagctgtttcgatttcttcatcactcttctgcttttagttatggccatgacgccaacgaagccgtcaaccaagcacgatccttatctgcgtctgcatgtcgaagtgtcgagctaagaggaagcctactctatcgacactcacgtccagccgtccacataactgtgtgtttggttcaagggatgaagtgggttgggttaggtcgaagctattttttaagtcatctggtttgaaaataggtgggataaaataatctctaaaaagaatattcttttaagatccgaataaaattggtcactcaaaaactggtggaccaattcatcccactttttttttcccactgacatataggccatcccctaaaaactaggactatctcctacctcatgctaaacggatagtggggacgatcccatcctaaaaacaaggatgagtctaacctatcatatttcattcccaaaccaaacacatgccaagtacatacatgcatcaataaatcaatcatccaattaaccatattgttctgctttaatccaactgagtttttcagatatttccgattattaagttttttttagagaagggtatttttatcccgcctctataccaaccagatatatgcaaccattttaatttaggaacttagtctatcaaatagggaacttagctcttcaaataacccaatctgaaattcgctcttatagagatttgaactcaggattttagagtgctactcaggtcactgtagattactccctccattccaaattgatctacatatagttttttgaggttattcctaaatgatctacatatttgtgtacatttattaagtctattcgttatttatgcattagagtaaatggatattgatgcatgcattcatgcacacaaatatttataacccacatgtaatatcttgatttgctattggctaggaaatagtggggatggtgtatgcatctagtttgttgttagagtaaatatagtatgagagagatattagtttttttttggtcttggtgtacctataaaatatgtagatcaatttggaatggggggagtattaagctacttggaaagaacacaagaacttacctctacacgaccggccgtacatgatttggctgtggaatgtggattcgggattccacgcgtgctgcatgcagagagaatctacaagtagacgctaaacaaactcgaagagtgttaggtttagcggagaattaatggcaggatcgtatgatctgcgagtttgcaggacaaattaagtgcgccacgcattagcgccaagttgggataacttatcaatcgatcgcctcgttcctttggtgccgggagtcgaatcttggttaatttctgctactgcatgcaacccgatcatcaggtccattgatgatataattaaaattcagaatctgcgatctgtatgatgtctgaatttagtgatccgattaatgcagagatttgtttagatgcaattacttcttagtgctcacgaagctgtggatgagacggtcttagcttcaagtgtaccaaacggattgattgttcagactaagaatatatacgatccatgcatgatccaccagttgtggaactggaatatttttttttaaaaaaaaaagaaagaaagaaaggggagaacctaataccattggctactggctgcagggaactatatttgatacgacgttagttagttaatcggtattaatttcaacgcgcaaatgtgtcactttaatcatgcaaggcgacgagaaatttcttgcacaaacagctagctttagctttattgaatctttgttctgaattctcatatgaatatgatccattggacttttgttatgtctggacatgtcacggtctctgtgtctagagaagttcagaaaaatcgagttggagagatatgatccatctatgtgcttgctagcaagaaactggctacgtgctacagcttaatttgttcaagccagaattatttaagcagtgtagcaagttgtcagttagcgatgtagggacgcaagtgtgattttaatattccttcgctttttgcaacctgcgtgccgcccacggttgtgttaattatcacaactaattctgctactggaatcctagaaattaattgtactagtactatcgtaagacaagaaaattaagaatatgttcacacatcaaccaaacgtagttagtgttaacctttcttcctcttttttactcctgagaatacgtacaagagctatatgcaccaagagtactccaactctccaagacttgaaaaccactaatgtcactatcgcgagctactgcttagcaacgattatgcttagcaacgagtattagatatagatatgcatgattcatcagttaattttgcaagagattcgttggcagcaagtataatcatatccacacatgcagggcggatccagcaataaactgacaagacagtccaataccactagggcaagtatcttcagttctttctccattaagtattaatcaatcaaacctagcttaagatagataccagtaggccgatccacatgtaccgcgggctcacaacaaataggaaccaatagcttaccgtcaaaggattaacaagaacgcatgcctatcgcattactgaccagtactgttaagctcaatcagacactaattaatcaacttctcagttgcttgcatcatcagctcctttaatttaacctaatctttgtttggaaaaagtcttgcccccacatgaagacccccacacaccacaaataatggattccaagttcccattaacaagttccctttggatcatggaccaccatgtgaaaaccctaatgaccttgtggtctgcacaagtttgcatataaaagttaaaactggtgcttaattaatctgctcccattaattttcaaggtggatctgctgcaatcagggaattttttacagcttaccattgctattagtggatgacactttacctacccaaagtcactttgcttaattatgatgtgttcatttcaaacagtgattagcatcagatgcagcctgcatggccctccttttttttttcttcttcacatgagatgggacttactggccaattcggctcaccaaccccctcatgttttggaagtcgcttcacctaccgccaagttcatgcctgtagcagggctaaattcggcagtgaaattttatgtggtaccactagtctactactagactaatcaaattaattaagcatggccagcaagctggttgattcggaatcttttctccctatggagctgaactttggggtgtcaatatcaaagcatgggaggatctttgattggagattttaatcaacgccacatacatcgatcttaagtctgtcagcaacaccagctctcttgcttgcttggattaaacttttgattcctcctttaataatagttggaagtagatagcaagtgagagttgaaacgccaacatgtctcgagattcaggacagctaacgaagggaaaatagctcgcgtaacaatcagtgtactacacatgtacgaacagggatgtgcgtacgtgtaatttatacagactttttttttaaacaaaattggccggttgatgtcatgcagttggtactaatttatacgctggatccgtgggcaatcactgaagtccactgcaattgcaaatagtcagatcaaaatatcagggaataacaaaactttcctgtgaaacattgtgctatacgatcgacagaatagtttcaagattgtactaaaccaaatgcaatttgtccacttccaagattaccggtttcaaacctaaatcccatagtattcgtcccaggcatcaaatttctgaaaaataatagaagtataatatatattgctgattgaaacattaaccagtaatcttgaagtattatatcttgttgattgaaaccaatttctccacttcaagattgttactaaacttttctacaaatttcaatctcgaaacattgaaaaccaatttccaaaaaacattgtaccatctggccaagaatgaattgctaaaagactattacaatcttacgcacataagaaatactccatcagtcccataatatagcaatctagctctagatgagacgttcgatagtataataaatttggacactcttctattcagattcgttatattataaaatactatatttggtcctaggtttctatattataaaacggagagagtgctcattttgagatttatttatatatgaaaattgatttattttgatcacagagagagagagagggtacaggtgaataggtgatcaggtgagggcgtgaggcgaaagtcacagccgcacagcgcacggaacgtcgccgtcgtcgtcttccccgtgagcacgacatgccatgtccccatgcatatcctctcccccacccaaaattacccgtcctgcccctcccggccccacccaaatccggttgacctcaggcccccaccaagcccattcccgccatttccccctccctcccgccaaataaacaacgtgttctcgtgggccccaccccgcgccgagaggctgcagcagattccgtctctgcacaaacaaaaatacaggagatagaatcaaagagagcgcactgcgaggaggagcgcgaggcctactcaaatacgattccaccaccgcctctcatctcctcctttctcgctgcgagaagaatcccttacgattctcgctaatccgagtggccaaattgactgttccattggaggccccctcttccccactgttgctgtgttcgatcgacatgctctgcttctgcttctgagatagcaggtgggtcaactactcaaccgcgattcgatttgcagtaaaccgggtggtttttcgcgtgttgggctagcttagctatagctagtaaatcgcggggggtttgggtttgggtttgtgtcattgtggcgtgatggcgatgtgcctttcctttccatgatggggatgtctcgtcgggttcctcaaggctcgcgtcttgcggcgtttgtgtgcgtgtgtggtagtggattccgctgtggcagccatgctcgattccttggattcgtagaggatttggcataaaaaaggtttcctctctggtttttcaattaatcccaggttcgtggctcgtgtttgttcgcctccgcgcggctgcgtttcggcggattgggggtatgcgagggctgtgaggttggtggtggtgcttgtccggtcatggagcagaagccgtcgccgccgccgccgccgaggagcgacgaggaggaggatggattgatgggatgcgggatgggcgggacgggggatatcgccggcggtgacctggatctcatggaggagttcttgctggcgacgccggggttcgatttgtcggagttctggcatccgggggcggcgagccccttctccccgctgttcgacatcggcagcagcgtcactaccttgactacccccgcgccggcggccggcgaggacgacagggacgaggcggagatgcccagccgtggcggcggcggcctcgaggtgagccccgcgcaccgcggctggacgttccagacggcgccgcaggaggtggccgtggagccgacggtgaaggagcggctgcgcccgcgctggagcgcatcgcgtcgcagtcgcagtcgcaggcgcagcggggcgacggggagctgctcgtccaggtctgggtgccgacgcggatcggcgaccggcaggtgctgacgacttgcgggcagccgttctggctggaccgccggaaccagcgcctcgccaactaccggacggtgtcgatgaagtaccagttctccgccgacgagagcgcgcgcgccgacctggggctccccggccgggtcttcgtcggccgcgtccccgagtggacgccggacgtccgctacttctccaccgaggagtacccgcgcgtccagcacgcgcaatacttcgacatccgcggcagcgtcgcgctgccggtcttcgagccgcggagccgagcctgcctcggcgtcgtcgagctcgtcatgaccacgcagaaggtcaactacagtgcggagatcgagaacatctgcaatgctctcaaggtagatttgcgcaacactgctccatttgattctccaaagccgaaaaaaatgcccatgctttgcaggccaccatgttatgctcttaacgtattcgatgaaatgtcattaggaaaagatgtgataactgctgggcacaccaatccccaaagtaataaatcttttcacttctcctaccttggtgtcatccttgtcttaataaaactacatttcgtggaaaattgcaggaagttgatctcaggagctctgatgtttcaagtgatcctcgttccaaggtgagatgaaagatattaaagatcagagtgctttgctgaaatgttgttctcagtaacagatgctgcccgcttgatgccaggttgttgatgcttcttaccgagcaattatacctgagatcatggatgttctcagagctgtttgtgatacccacaatctgccactagcccagacatggataccgtgcatctgccaggccaagaggggaagccgccactctgatgaaagctacaaacattgtgtgtccactgttgatgaggcatgttatgtccgtgattgttccgtattaggctttcaccaggcttgctccgagcatcatctgttcagaggtgagggtgttgtcggcagggcatttgggacgaatgagccatgtttctccccagacattaccacctacagcaagacccagtaccctctctcgcatcatgccaaactttttggcttgagggcagcagttgccatccagctgcgaagtgtcaagactggaagcctggactttgtcttggagtttttcttgccaatgaagtgcataaatactgaagagcaaagggccatgctcaattctttatctaataccatacaacaagtatgctatacattaagagttgtgaagccaaaagagctggtaaatgatggaccatttgaaattagtcaaccaaccaggccagaattttatgccaagtctgtgcatgaagacttggatgagctctgtagtggtattaatgttcctggaaggacaacatcattggaagcatctgaggaggtatcatcatggatagcgagcttagtggatgctcagaataagggaggaaagggagaaatagatgttgacttgccattcggattcagcaaacaagatgatgaaggatttagtgttacagctggctggcatacttctccagttatggcacctgacggtagcatgttttcagggtttaagcggcatgaagattatgatgtcaaagaaaatacttgttccagtgatccaagcaattcaaactcggacaaagcagtagaaaaacggcgcactaagacggagaaaacagttagcctgcaagatcttcggaagcattttgctggtagcctgaaagaagctgcaaagaatttaggaggtattttaatgacaaatgatctctgaaatggctggcttccttaccttttttaaaattattttttgcagcttttcctgtacatttatctccttgaagcatggctcaaaagaagtgggataagtttgctcatagtaataatctgcttacagtgcatgtaaccctttcagataagttccaggataaaaaaaaatgacaggtgtacaatcaggcggggaacttacaatgtaattaattgagataaaattgataattcaaatgtcttggtttttgcaatagatccaactgaaagtatataggactaatgcttcattcactatttgcatagatataaactgcaatatctgtggctgactattgatcttatgtttctaccgtttgttccagtgtgcccgactacactgaagagaatatgcaggcagcatggaattaatcgttggccatcacgaaagatcaagaaagttgggcactccctgaagaaattgcaaatggtcattgattcagtacatggtcctgaaggaacagttcagctcagttcactctatgaaaattttaccaagaccacatggtcagaaagagagttacaaggagatgtccattttccagcatctgagcaaaactttcagctggaaccttcagttcctgatcgtccatgtgagggcagattcacttcacatacttctggctctaattccatctccccatcctgcagccagagctcaaattctagccttggttgttccagtgttccaaagactcagcaacagcatggtagtgctcctcagcttgcagtcaaagaggaaatatctatggatgagaatcagtgctccacactaatcaaatctgctagccatgcagaggcagagctgcaaatgtttgttgaagaaagacctaccatgctatttaggtctcagagtcaagtacttttaagtgaacacaaaccgatagaaaacatgtcaaacgtgcaaaaggctaggtctgattctctcaaaataaaagccatctatggcgaggaaagatgtatattccgtcttcagcctagttggggctttcaaaggctaaaagaagagatcgtaaagcggttcggcatttctcaggatactcacgtggacctcaagtatttggacgatgaatctgagtgggttcttttaacctgtgatgcagacctgctggagtgtattgatgtatacaagtcatcaagtaatcaaacagttagaatattggttaatcctagcattcaaccgttgctcaatgcttccttcggtcaaactggtctgtcttgacagtggtgttgcagcactgaaaacaatcatctcattgctccttcaggtaaagaatgcctgacgctgcctttggttgtaagtcaagatggcgtatgcaggcttcagatttggatacttgggctgaggtgcaaattaatggacagctgcctgttgatgttgcagttgaaccgtgctgtgttcttgaattggaaatgaagtaattgttgatgttccctgtcggtgcttggtattgatttgcatgctgaagttcatgcagtggagtccacgggaatagaagatggagctgtatgccttttgttcagtttcataaccataggaactttgtgtaggcagactaaactagtgtacataattgtaggtgagtaggtcagaggatgaaaataattggcatttgtcgaaatgaagctttgggatagatttagcagtcagttacagttcaaaagtttgtagctcttttggggtttcatctgactcaatagttctcaagtgttcacttcaaggtttcagcatttgaaagcctgcctcaggttacccgttacagcgtgtctgttcagccttcatgggagcatttttgcaattctgaaatgtcttcccaccagtgtaagtattgatgaaaatattagtgtatatttttcctttctttgttcatctcattagttgcatggtaagcttatcttgcacccacatattgcagaagcgaaagggttcacaagaaagcagttgcagtgctggcaatgaaacaagatcatcatcaaagtcgagatgaattctgttgtttttagatcagtgttagcattattgttaatacaatgttatttatatgttggagtagtttcgatgttgctcgtgtaaacctgctcttttacgggtgaagatttttttttttgtatatcatgtacagtacggtagaaatgtaagaattgtgctactttggcctggtttttcttcaaacttccaacttttctatcacatcaaaactttcctacacacataaactttcaactttttcgtcacatcgtttcaattccaattaaacttccaattttgacgtgaactaaacacaccctttcctttgtgacattggaacagatcggaagctctctttttctcccttttatagttgttaaatatgtgtctcaaatttcagtatgaaaatatatttgaattaatctcctagtcgcacaggagtaacgtctaattgttatgcttttgtaatcaactcttaaaagtgatcttgtcggttggcgtccgtggtttttttggttttttcatctatcctctaaacacaaattctggcatgttatggtttcagagctaaacccgtcgtatgtttatcctcaagtctacacatttatctcagaaatcacatcctgtatatgtgcttctcctgaaagcacaggtctgggtcatcttgtcgctctcctggacagtgactcgattcggttcatcactacggctaatctcatggatcagaggagtataatcatttgcaaagtgagattgtttaaagatgacacgcgccgtagaaagaaaaaagaatcaatacaattcaattcaattcaatttcaaatctatgttagtatgcagataatcccaaagctcatcgcggcttggaataaggattacggtgcggcgaccggtgcgcagcgggcggcggcgcccgcggcggcagcttcgccgccgccggccgcgcggtgccgacggactcgatctcctggagcgcgacgacgacgtcgtccatggacggccggctcttggggtcgccgcagaggcacttgtcggcgagcttggcggcccgcgccgccgccttggccgggtagtccccggcgagccgcgggtccatcagccccgccagcttcttgccgccggcgatgtacggccgcgcccactccaccagattctgctggtggctcggccggttcaggtcgtgagccctcagccccgtgagcagctcaagcagcaccacgccgaagcagtacacgtcactcttcacgtacagatggcctgaaaaaaaagtgaaaacgatcgcgaggaagacgacgacgcagcctgcagttagtcctttgcgatatatacaaccgaaatttcggggattttggctaaatttgaatggaatttgcatagttaagagaagagagaatcccttatatgccactctaaattaaccggctctcttatataccacttaaaattggcttctctcttttatgctaccagttcaaatttctcctcctttttatgccattgccgtcggtccaccgtcagttggccgttaattttttttgtaaaaaagacgcatttgcccttaagaattagtatacaaccaacaataggtattttagtactaatatagctactggatacaacatatgaaaaatgattttttttctgcatcacttgcaattttagccattaccatcacaaataaattttcaatgtaagcatgaaacatgcatttttccaacaatatttttaatataaagagcatttttcactggttctgacaaaattttgttcaatcaaaaaagatttaaaataaattagttatgattttttgaagtttacacattttttagttgagaggacatattggtcatttacgaaaaaaactaacctttgactaacagtcaactaacactatagtggtgggagtggcataaaagggtgaaaaaaacttaaactagtggcatataagggaactggtcaaattctagtggcatataaaggattagagagtttggtgcggtgcatgcttaccggtggcgacgtactccggcgcggcgtagccgtacgtgccgatgatcctcgtcgtgacgtgcgatctgccggcgaccgggccgttcttggcgagcccgaagtccgacagcttcggcgtgtaatcctgatgaaaaatgcgtgtctcaaatgatggagtttggaagatgatcacgatcgatctgcgaatttcgcgagatgagttgagaagagaatttaccacgtcgaggaggatgttggatgccttgaaatccctgtatatgatctgccgctcagacgagtgcaggaaggcgaggccgcgagctgctccgattgcgatcttgagccgtaggctccatgacagagggtcaaatgctcctcctgcacgaagatcggtcagactccagcaaatcagacatgcatgatactattgcccaaaattatttatgtgatttgttgatgaatcactgtatgactagtccgtagttaagaattgagatcaaccaatgcaggatggtcgcgtttgtcaaagttcagatcaatacgatgaagtacggcactgactttgcagaagtcaagccggaatttcgaagggcaagtttgtctgttcacattcggacaaacataaagatagtttcaggtactaaatgttactcgtattagaaatcgtcaaattatgttaggtaggagtgggagactaacagctgaaaatgaaccaattttgtggaagcatgatattcagacatgagagtagtagtacaatgtcagagttagattgatggtcgtagccttactcctgaagagatggttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8153 - DNA, 738 bp, Oryza sativa
  unsure (1)..(738): unsure at all n locations
taaggattgcttttgatgtacttatttgatgtaggttcgatccttgcgattagatgtcaaggaatgggagccagtgattatggacttgttccatgaacttggaaatgactacactaattccatttgggaagctatgcttccgaaagaagatcaagggtatgttgaagtgtatgtaaatgtatattttcttaactatgttttgccttcatgctttagacaattttcttcctagttacacctctcttctgaaatttgtaagtagtggtatattgactaatacaaacatcagccaatatgctttttgccaannnnnnnnnnnnnnnnnnnntagttttgtacttctgcatgtattgtttagtcattttattttcttttattttactcattggattattgtcaatttaaggagcataatactgcactaccgcatttgtaatggactatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggtaagctttattatcttctacagatgagttggaagatctctcttttaatctgatagtgccaatgaatatatttcatacattaatggcattggcatcagacatgttcattgtgtgtggaaaaactaa

SEQ ID NO: 8154 - DNA, 2015 bp, Oryza sativa
  unsure (1)..(2015): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcacagctagtgctcatataaaggatcaagaacataactaatagaataacaagttggaataactcacaatagcatgtacatgacaaccataatatatacaaaatagaaatgtattccaacaatgaagccaatgtaaaaggttacctgtagacaactccaatgttcggagtcaatgactgaatcttttgcacctgaatttgcatataactatgtattagtgcttctgagaaacaaacaacgaatagcatgtcgcaactcactaaaagaggaattcagcattaagagtgatgttagacttacagatgtttcatcgactaaaatagaaggcaatttcttctcagtggcgataactacaccattagcagctgcaaacataacaaatatacctcagaatcaataaactaggctaaaagggaactgaagagaatcaacagactgtagtctctgagcagtaactacacaaaaacatatgatagaacaatctggtaaaaacatatgcagtatgttctacaccacaaatttattacatacaacaattacatctatcagcgtgaagaacgcatgtcaaatagtttctttcaatttttcatacaccaaaacaaaattcatgggctaaaaccccaagactttaaattgcataaatactgacaagtggcaacaaaagctgattttaagggtatgtaaacctaccagtaaggtggacgttgacagggcaaacaaattagaattttgcactgatactaaaatgggcttccaaaccctaataggcactagatcagactgcacacacatacaactactaatgggaaaactaggtcagcatatacattcaacgccgtaaattggcatagaaaacttcatcatcacagatgaaaccaagcagcttgtatttcttatgtggttataaaggggagcacttgccattgctgttacaagacatacatttatgtagattaataatgattttccatggaatccacaagcatttgtaagcgaaaacgaagcaaacattacaaaattcccaagtatcactaaagcagaatagcagatgcaagtaacatggcacctattagtaacctaagccgtagcaaacttcacactccaggtctccagaacaaataaaagctctgcaacgacctaaagttatgcgaaaagtgcaaaatccccaacaagcgccacttcgtcatgtgaaccgaaccagccaaaatctcaaacctcccctccccttctcgattctcataacgcaatagaagtatagagaagggattgcttcacgggacgcacctttgatcccgagggacgtctggccggatccgaccgcggtgagcgcgtgctcgatctgcaccagcttccccgacgggctgcaaacgaaatcgccacaaaaaccacagatgacgaaaccgaaaccgcaccagatcacgcccgatctccgggcgagggaggcgcaaggcagcacatacctgaaggtggtgagggagaaggagtactggctgtctcccatggccgccgacgcgcaggcctacctgtgagctgctgctcttcgtgtctcgcggcggaagaggaggcgaccgagcgagcgattgcggcgagacggcgtgggaagggagagggaggcagagcacaactcgccaaggaagaagaggagagagagaaagagactggatggatggattgctccgcaagaaggtggtgggtcttgggccggaaatctggcccatctgttattgggtcag
